United States Patent 11,913,074 (METHODS FOR ASSESSING RISK OF DEVELOPING A VIRAL DISEASE USING A GENETIC TEST) - sequence listing, part 10

SEQ ID NO: 296 - DNA, 89233 bp, Homo sapiens
  source 1..89233: mol_type = genomic DNA
gtttaattcctggtctaattgtagttgtcacatccaaaccagtcctccaacaatagcctgctgaggctggtcatgaaggggctccgagcactgtcagcaactggcctgaacttcaggctctcccaagatctgcatcttctcattggaagcctctcactgaaacaactgttcctcctgttaccctctatctctggaggctgatttattctaattccctttattcctctatctcacttccacctctttttctgcagggtcctggccaagatagctcttctagtctagctcacccggcccaatctttcttataaattttcttaaatgtaacttcaactcaaccaacttcaaggtcacctgtgattctttctgtagtcaatattccatctgtttgcactgaagctttattccttcaatgcctaatttttatgaaactgatgagactaagtttctagtctcataagtcatcaaatctagtgtcatgagcagagaggttgttgagatgtatgtggcaaggacaaaggacagctcttcaacaattgcccttcctgtttttcctgtaggaatcgtaacatcatttacatgttatatcgaaatgggccatgtgtgtgtagctggccttttttttcctaccatgtacttgtgtgttctggaatcagtcagctagaaaatatttaccaagtgtcttaggctttttcactgtagtgtgcatttaacgtacacagtaaagaatgaaggctggcactaaactgttagctaatcatccggtgttccatgtgaatgacagaacacggaataaacctgatgacaccaccactttattttgagctaaatcctcatttaagtgagaacaggacaggtttcaccactgcctcctttggcaacttgagtggtggtgttcccaccgagtttatggctgcaaagataggtcttttctcgtatttatgtataaacaggtaccagttttgattttatttaatcatttcatacattaacatacatgacacatcaaaatgagaaatgcacagtttaaccgttcaacagctggccttacttcaaaagaacactatattcatattaaacatttacagtctttccatctaactttacacatgtcctaaatcattttccagcacttctcacatagaagtctagttttgctctttaaaatcaccatctgtatcacccctagtagacgcgagggtttccccaattacatgctgaagagagccagccaccaccccacctaaagacatccaagcagctccagagcctgcctccgaggccaccccttcgccacggcagtctcgattccaagaactgattatctgacactagtgaaccagcactaaaggctgtaggatgtgactacatcacagttccagaaggaagggggaccatggccaagagaagccctaaatgacagaagctcattaaaaccaagtcccccaaacctcctgaaacatcgttagcaaggagctactgctttcctttcttaaacatgttttgggcatgaccacactctggaagtggtgaactgttacacatttggtgtgtgtgtacataacatcaaaaactactgtgtgaaacttgagaatgtctgattaaagatttcaatgtatatctaaaaactaactcaaatcgttgaccagcactttcccagtatcataacaatgcggctgaccctcttctgccttcactttacaccccatcatagcacattatttgtgcacaactagtgaggtctgtgcggctcatcatccccataaccaagtcggtctgtgttgagtcatatcattctgtgctggttttagaagtcaccataggaaacatgaagtcacatcctggtcaaaaaactgtccatttctcaaaaacagagaaaaacctgagatacgaggcagcaactagcgacacttacaggaagggaaagaacaatgacaacacccgcccagccccacccccaaaaagctgctgttgtgaattaaggcttcaaaagaggacccacattgtagctgataaaactcaagccaggaggatgtttgaaagccaatctgcactatcacttgttccagtgacctcctatgttcagctgccaggaccgattccatacagtgattgtaggttgaggactgaggacgcccctttgctctcgctccattttgatttgctttttccactgaagacacgccggccagcgtttccaaaaacagcttggccatggctttgcactctattcacaactgatcaaaactcaatggtcttctcagctttctcaaccgttttattctgaatattccttcctcactaaagcctctctcagccctactagtaaatgtgaaagtctgaggcaatcatagaaacatcagccccatcgcatgccgaggggataaaagccactaaggaaacaggtttcctgcttctcctcagcaatttgtacctttcttaatcttcccataatttacctccctaggaagtttcctataaaattctgccatattattacattttaccaactgtatccatgcagtgaagcagaaagggcaaaaacatctgctttggctgagaatttgaaggtgctgctgctctgctaccaacccaaataaattcacatttggcttgaaaccaagttcatctttatttaaaggattgacaatcccattttaaacaattctttgatttacaaagagggaggtagactcgttagcctcccaaccttagcttaaatcgtgatgttgccaggttcctggtggttcagctgaatcctagacagtttcccttctcttcataaagctgagaagaaaaaaaaattatctccatctaggcccacgggaattttgtgcatagacagtttgaattggtctgaaaagtgtgactagctacctacctattcacaatgcctagaaaatgggctaccagatatggtagtggtcaaagccccgactttcctgtctgaggtactgggtttgctctaaggtagaccttggcaaggcccctaatggtccgtccagcagagtgatgctcgtgtccctcggctgtcaggtgagcgtgggtttgtgaatcagctttggataggatcatttctcttggatttaccactaggctctgtccctaacagggtctacctacctgacccccaagctggctcagtctcagcgctaaggtgtactatggaagggtccggacaaagactaatatttgagatctcttagtagcacaacgtgaaaatggtaggggattttgtcctccaacaccaaagacacttgcttttttaagaacaagaggatgtgtaattcactgaataaaatggttttcctccgtctaggggggattctagcatctgcccttccatttttgttgagagaagtattagctgatctctcaaatgcagatgttaagagagtaacaactgggttgatccacctgttgcttttacaccatagctccattttccaaaaatatatatgtatgtacatatatatatttcagatttacagggaatttttttgtgaacaagaaaaaaaaattgtctatagaagtcacaagtgtctttcttctcaggagacctcaatgatttccatgctgcccgaaaagctagactgactgcccactttccccagctcttcccgtgacctgttctctgacatgatgctctctccaaattccatttggcagcttctgcgtttaaactgcttttcaaaggggctctcttcatgccagctccgccgcgagtcagctctgtcacttggcttctgccgcctgcgcacagaatagacttggtctccgcaagtgggcagctggctgcagctgtaggcagagtaactggcactgcctccgtagatggctgaggcagagtagaagtgtgaggactctgtggcaaaataccagctgctggtcagggaaggggtagaggtctggggggccaagatatccgagtgccagcccttaaggcccaggccagcagacttcgtgaggtgctgctggctggtggaaaggccgaaaaggaagctggtgtggtaattgtcctccacgctcccacttcgatgcagtggagataaaagggacctctgggcggtgccactgctgctggttctgaccgaatgcaatcgcttgctctggctgtctgaaggcctggcggtctgcagcttcttggggatgctggcttcctccttatcaggactggtttcgggagtctgctccgatagttcctgaacaggggagaactggcatagcttgttggtcccatccagagtagtggaaggtttgtagtattccaaagcatcttctgatgaggagaagccatgtaaggatgctgccatgctggctgaatatgaaactgatttgatatccagagagaaggaacgcttgagcttattgctgtcttccagcctgtctgcggacaggtgcagcccactgagcgcctgtaccagcgggctgtcctctaacagcgacggctgcacgctgggcacgctgggcacgctggcgggatgcacgggcctttgtcctgctgcctctgaggtagcagagtcggcacagggtggactgaggggcgtctcgcttttctgtccaccctctgagacagcagggacaggttcatttggcttctccaggtgcagcagcttgagtttgctctttggccctgatgctccagtctggttcttaatcttcttctcatagtccaggagttggcccagaaaattgaagtttggagatatagtaggtcttttttctttcacaaatctgcagagagaggaaaaaacaaaaacccgaattttacaactacactttatcttaagaatattaagtgaataaatgagatagggaattatcaggcagacctcaaaaactttggaagatgattggtttacaagttcggggagatgcttcaaggtggagaatacaaaggccctaggcactggggaagctttgcacacatcctggagtatgccagaagaggcagctgggccccaaaggctctagtttttgtctccttattttcaaaggcccagggctcccaatgcagctgataagagatggtatggggttttgttggtggtggtcttttttttttttaagagacagagacttgttctgtcgcccaggctggaatacagtggcatgatcatagctcactgcagcctcgaattcctgggcacgtgcagtcctcccacctcagcctcctgagtagctgggattacaggactacacgcttggctaattttaatttttaaagtttcttttgtagagaaagggtctcactgtgttgcccaggctggtcttgaacttctgggctcaagtgattctcccaccttggcctcccaaagtgctgggactacaggtgtgagccaccatgcctggccaagagatgattatttattcaccaccaaggacacccctgacacacacacaccagtgctaccatcaaaagtacagtataacagccactctccttcttcaatttccaatgtcatcccctcttaaagtcaccagtcacttctcaagacagttcacattttaaatttaatgacaaaaagaagatggtatcagatgatcaaagtatcaaagcaacacttctttttatagtcaacatgacagactaaccaagacaaagtggtctctgtgtgctaagcactgtgcttatgcactgaatcatcatttcatcctcagaactaccctttatcaggtgggtgtcattatccccatcatatagctccacagaatccttaagtgacttgcccaaaatcacacagctactaaatgatggtgctggattcaaaaccaggctggtcaaatatctgggtccatttttgtaaccactatgttaaaaaaaagattcatcaaaggatcaaaactaatactagatggctttcatgtttcatggaggaaataaagactcagagatgacagaccaattcttcagcggcccctgcacctcatggatacttttcaggtgatggaggagtagaactacactgaaaatttgcatttgaataaggaacaaggaaaaaaaaaacttggaaatcaagtaacctaaagcaaattcacaaaaatagaaataactggctcaagaataacaagtataaatgtagggtgctcataatgagacttcataacgtgatagaagggtgccttttcttctgatttctacatggagcaggaggacctcagggaggtctgaacggcggcatgagagctcgtgcagatgaccagaggacccacgtcctccaggctgctgacttaacatgggaagctgtttgggcagctcatttctgttttccaaactttgcaatttgagaaaaaaaaaatccaactgttaaatcaggcctgctccatgagtctctatatttttgattccttatcagataaaaatgaaccatctctacccaacgatacatgcaggggagtcagacaaatcagagactggaggcaacccagtcaaaatcacacacacacaatctggccgactctagaatgtaggaaattttactgaagaatggagtctgacagttaatctggttcatatttgcatttatgaggctttttcttcccagcaatccaaagtttgaagcagaacagagattctgcagtgagcattctattagagcttccccccatcatatgcaaattaaaacaaaggatacttttgcatttagggaaagcaataaactcatgtaacaggatagagatctctgcctggatctgttgttccttaaacataaaaagtggctgaggatgagtctgacacatgtgaaggcagaattaatgctaaatagtaaaacagcattcttttccaatcttcacaagaccattaaaaaatccacagtaacctgtaaaaaatgtgactaaaataatcatgatctgctttaatttggttacccatcctcatcattctttatgtttcaggtcaaatgaaaagccaatcacagaagacattttcctgccctcacctgtaagcttcatctaaagacatgtccatcctcttcatgatgtaggcgatagcgatggtggcggagcgggagatcccagctaaacagtgcactagaacacatccattggaggcttttgctttctctgtataagtcaaatgcaagaaaggtcactactaactattttgttcagcagtgaaatcttgtttccatttacttactcagtgtcttccacctgaaaacctctacgcaaatctcatctgtgtatatcatatttatcctcgcaatattcttttgaggaggcaggggaagataattccctcaccactgacatgcaggacaactggggtccaaaactgtttgttaataagcaattcgttaataagcaagctactactaactcaggtttcctgacttatgttagtattttcccctaagatatgggtaatatttaatatattcctgttatctgacacttcaaatttttccctgattacctaagaaatataattacattttttaaaatcattattactattttgagatagagtcttgctctgtcgcccaggctggagtgcacgatgtcggctcattgcaatctccgcctcccggattcaagtgattctcctgccttagcctccagagtagctgggattacaggtgtgcagcaccacgcctggctaatttttctatttttagtggagttgcggtttcaccatgttgggcaggctggtctctaactcctggcctcaagtgatccgtccacctcagcctcccaaagtgctgggattacaggagtgagccactgcccctggcctccctattttaagcaacttttctgtatgtcataaaatggctcaactttatttactgagttttagaagaaaaccttgtataggctatgaatcaggtttagcaggtcactttaatgagatccaagagaacttttatcccttccttgataccaggagttattgtcttatggcattatctcaattccccacaacatgatggaaggactcacggacactttgttagaaccaaagaaccaaggaaatccaagcagtgctgccatctctcactgctgaggggcttaacaatatgtacatgtggcaggggacgaggttattccacacagcctggaagctactaacattctggccagttccatgactgcctcaattctaaataattacatgtgtgctcagtcatgaagctgaattctccccttttcattcttggtagatactaccaaaagtctactgaaccttgtgttaaaattcttgcgattaacagatgcgcaaagaatcttactttggcagctgaataatacaaagctattcaatctcactgcctatgctataaatataagtttctagtgtaatgattattatatataacataattattcatcatatataaagcaacatacaggttttgggtagcatatgaataattaagcagcaagcagcttcccttctagatcaggaaaccaaacacaataaaacactaacaaatgaataccaagcaacactcaaacaaagaattgcatgctatacaagtaagaacatataaactcgtgtacacagtctcatgccttcctgtgcctccagcatccccttccttctcagctatcatttaccccacgttactctcagtgtttccttccctttctgccctactgctaagaagctcaaagctaaggtttctactcaatttcaataagaagtagcaattcagactttttgtcagttactgtacatttcctagcccctattacttgattattgctcctttataccattataatgtgtatgtgtgagaatatgtgtatcttttggttctaacctattattgaaaactgcttcaaatccttactggaaggagtctgggtttttgttttttaatgttgacaatactctctcattaattttaataattatctatctcaaaacctagattataaggacctagaaggatcttgcttgcttctaacaatcccccaaaagacttaacgctaggcacatggtaggcatccagctgatactggctgatacatattttcaaaagagattttaataaaaaaagaagaaggctggaaggaaataaaacaatgacagtaacatgcgttacgatgttgaggttataggtttccttttctctgtttttcaaattttctgcaatgtgcttacaactgtttttataaccacaactcttttgatgacgtcttttaaaaatgaaaaaaacaagtgactatactggagttgaggttcaccagcatgcatcttgggagacatgagccctaaactgtgtcttcaagcaaaggaattaatttaacacacacaactggcagagaggagaagggaaatgtgtgcgagaaagccctgcagtgggactgagcaaagtgctcattcgaaaacagcctgccttggagaagaaaccagagagaaggtttgagaaggtttcaaaggtgggaagcaggtgtttgagggtggtgggaatgttaggctaagggctacatttgttttttcagacagggtctcactctgttcatccaggctggagtgccatagtgcaaacatagctcactgtaactgtgagctcctaggctcaagcgatcctcctgcctcagcctcccagctaggactacaggtgcacaccaccatgcctggctaatttttgaaaattttttgtagagacaggatcttgctatgttgactaggctggtgtcaaactcctggcctcaagcaatcctcccgcctccgcttcccaaagtgctgtgattgattacacacgctgcacctggccaaggctacctttttaacgcagaaaactaagaagcctcttcaggtttctgaataaagaacgagaaggcaatgatgatgaaaactggaaacaagcaggtggccattaccgcaattaaggctaaaatctaggttaagaaaggggagagagaactgcaaatgaaaagggcaaagatgcagtgaggatgagaagttacaaaagctaaaaagaaggaagtaatactaagaggtgttacagagtccagctcaaaggacagaaaaaaggaggaacttcagataacaatttttaaaatacttattaacagccaattatgagtcaggtactttacaaggtgttcaatggacattatctattttacttatttttattttatctttttggtttactttttttctttttttttcattttacattatctattttaatcctcacaatatccctgtaaggtaggtatattaccttcagtttccagatcaagaaactgaagtgcacagaagtttgaagtaacttactcaaaccacttcactaataaccagggtaggcaggactcaaatacagacagtttgcctccaaaatacatggtcctaatcacctccctatgttgtgtccatgcagtcacgagtttggcatgaggagagctggaggaagagcccaggagacagtgaagaggaagcaagaggctgtatatgtagccagctgggtttgggggcacctcatgagtatcccatagcacaaacgggcaaactctgttactggcacattaactaaaagacaaaactccacataaacctgagtccttccaaccaacccggagacttacccaaatctaatctaaataacaacaacaaaaaagaaaaaatcactatgagcctgtaagtcattaagggggtacatcttcaaatgacatgctatcactaaccatggcttaaaaccccacagatccctaaaacttaaagtataataataaataaaaataaaaaaatttaaaaattaaaaaaaaattttacatttatctttaagaatttgtgtttgagaataattagctcttgccattctactactctgtatgtatgtgggttatcattcttgtgtctttcttctgcttgagtaaataaaaagcaagaacaacaacaaaaaaccccacagaggagaagacttagcaattgtagtgaatatgggctgaattcaaaaagtggcctggagattttgccttgaattacttgggtgggataaggatgatggctctaatagaaccaagcaaatgaaatactgataagtatttgcagatattacaaataaattataatatgtattttgtgtgtatgtgtttaaccaagttgcaaagtagttaaagttcttttgtatgaatgaaagtggcaggatgaccccaatatcttccatgaaaggaaaaaataagttgggagcaaagttattcatattctctattctcttctcttttctactaaactttgtctcctaaagcccacacattgtcatgacttaagaaaatcatgttctcttctaggtagattttgatatctgatttttagctgaaattagagccaatgtctctggaagtgacgtgcaatgggaacattaaccgtaatttattttttttatttttattttttttgagacaaagtctcactctgttgccaaggctggagtgcaatggcgtggtctcggctcactgcaacctccacatcccaggttcaagagattctcctgcctcagcctcccaagtagctgggattacaggtgcccgccaccatgcccgactaatttttatatttttagtagagacgtgttggccaggctatcgcaaactccagcaacctcaggtgatccccccatctcggcctcccaaagtgctgggattacaggcgtaagccaccatgcccagccaattgttattttttaaagagacaaaaacaatgatttgctgaatgttttttagaagtacaatgggagggtgtgtgttaacttgtgggggtttgtttgtgatttttttttttttttttgagatagagtttcactctgttacccaggctggagtgcagtggcgcgatcttggctcactgcaacctccgcctcctggattcaagcaattctcctgcctcagcttcccaagtagctgggactacaggcatgtgccactacgcccagctaatttttgtatttttagtagaggtggggtttcactatatgttggccaggctggtctcgaactcctgacctcaggtgatctgccagcctcggcctcccaaagtgctgggattacaggcgtgagctacctggccatttgtttgtgattactttaatatgaactaagtcatttatcttcagatgtttcacagaatgaatcctaattgaagatgaaaccctcagcaacctggaaatcttgaaaaaaaggcaagtgttttggaattacttaaagttccaaaagcattaaatagaatattcccctcacaggtgaaaattataatatggggcttaatatacataattccactttttgtttttgagacagggtctggctctactgcccaggctggagttcagtggcacaatctcagctcactgcaacctccgcctcctggctcaagcaatcctcccacctcagcctcccgagtaggcgggaccacaggtgcactggtagagacaaggttttgctatgttgcccaagctggtctcgaactcctgggttcaagtgattgcttgcctcggcttgttaaagtgctgggattaaggcataagcccctgtgcctggccaattccacttttttttttttttttttttttttggagacagagtctcactctgctgcctaggctggagtgcaatggtgcaatcttggctcactgcaagctctgcctcccgggttcatgccattctcctgcctcagcctcccgagcagctgggactacaggttcctgtcacctcgcccagctaattttttgtatttttagtagagatgggttttcactgtgttagccaggatggtctcaatctcctgacctcatgatccacccgcctaggcctcccaaagtgctgggattacaggcgtgacccaccgcgcctggccaattccacttttttgaaagaactagttcttttatttttaattatggtaatggtaaccaattcagagtaattatggattagggtgctccaacttatgtaactgggggaaaaaaaattccttacatggaacatcaagagtcactgtggtatgttgctcaggagctagcagtgtttctcctctgctcagccactgtccactaaagccacattccaaatacacatcaccaagttaccacccagcagatctgatcctgtggcaccaaaatgcctcagcagtaagtacccaggggccagagaagctccagaattgaacaagcccaggaagcacaacaaagtatggcacagatgagatcccgtcaagaccattgccaggaaaataaccaaatgagagtgtgtgtgtgtgtgtgtgtgtgtgtgtgtgtgtgtgaaaattctgttagatcaaacactacctgaaattattggcatgtggaccccggctcagaaacactgacataaagacttaaatgtaatgggatttgttttcaaaagatttgacttttctctgtaaaaaacacagcaacaaggcaacagggaatattaccaaagtttcccaaaggcttgtataggatttgaaaaagttgggggaagaatttaaccctaaaagcttaactgattttcaaacacctgcaaatacataattacagatcctgtgaagcttaaccttggtggtgttaaatgttagctagaatgtcacaaggccagtccttagggacagtgtgacacacacgtcaccttgaccaccagatgagtaagctgcaccacgtgctgttttcagacttttgaaatctctgaaataggctccttttctctaaagaaaaaatggggggctgagggggttcacctacacatgagacgatcacccacaggacctgcaatattatttgagctacttaccaatgaaatctactgatttgtccaaccacggcaaaattttctcacaaaagctgtcattcacaggcacacgcaggaaatgagactcggggataaagtcaggctttggacaggtattgctggcatttaacacataaccaatcccattctgctgcatcagctcctatggagagaaagagtagcagttaaagtgactaataatatagtaaacatgatcattctgaaagagtgaagtttaatgtgatgataaaaatgcccagtttccttgaaatataattcattcagatcagtgaagtccaaaaacctagcaaaatgacatctagagacaagtttaaagaaaaaaaaaaatttaaggacaacaaacgctatttaaaatagtatgcttgaagcccacacatcattcatatagtcaagtctctattatcttcattactagagagagaagtggaacaaagaatacaaaagaaaacaacagtttatatgattttagaatatatggacacacaacattttcttcccacacggaacacgctggttctctaagatacaattctagtcattcttctcactctaaatactctctttgaaggctgcacttacttctgtagtcttaattaccagttctacatgctgatggcgtgtgtgtgtgtgtcctcttaaatttccaacccgtatctccaactacctactgactatcaggatgttccacaggcccttcacattcaaaatgtcagaaactaaacatattctctttttcccttttctgcccccaactcctgcctcctctctgtaatccccaaattggtttagggtaataacatcgacccagccaactaagctcgagaataaaatggggctcctttctcttccccatgaccctcatccaaatggctgccaaatccttttggaataacctcttccattgatcctctctcctctctatacccattcactgctcagtagccaagataaccaaaaaagccaccaggagctcttgaagtttgcagtggttttctctccaaaccatgttctgaacaactagaggaatctttgttatgattaaccccaagctgggtgctttatccacattcttttcatttccttgagtctcatttcctgctcctgtcccatatagcacccccaacgtcaaatgtatacccaccctctgttcacacgattcctgtgcttagaaggccctgtccttcttccagaagacactcttcccacttttcctactttaacctcatctgtgaactctttcccactcatgcataattaaccattcagttctctgtccttccaaagtactttgttcacaccattaattaagcacctaccatagtgtgttaccattaacagataattctcatctcccctgttatgtaatgaagtaatgagtaagatcttggaccgcgtcttgtttttgcaccttcagcccagctatagaattgcactcaaaacaatctgttcaactgacatccatccaccatttagcaggcaagcccacacaaacccgcttcatttagtcatccccctgctgcctctcaggagacgttccaagcctggaataattatcttagtctaagcaatcttggtcatttcttccttctcttggaatactaccttttctacaaatcttttccaactacctgaaagaaaatgggcaattttcttcctatattacccttctgaaacatgccagttccctaatctcttcatttactacatttggcacaataaatatactttattttacataaaaggtgaacagcagccgggcgcagtgactcatgcctgtaatcccagcactttgggatggccgaggcaggaggatcacctgaggtcgggagtttgaaaccagcctgaccaacatggagaaaccccaactctactaaaactacaaaattatccaggtgtggtggcacatgtctgtaatcccagctactcgggaaagttgaggcagaagaatcgcttgaactcaggaggcagaggttgtggtgagctgagatcgcgccattgcactccagcctgggcaacaagagcaaaactccatctcaaacaaacacacaaacaaaaaagtggacagcataaatccagattgtgtatgcaaccatctcttatctctgagatgacaatgtcaataaacagcttttggaactaggtggatttcttagattggccaacacccttcagctatgccagagcccaagtcttctgatggtctcatgcttctgttaggttaacaatcaggctacgtagatcttaatggtatttactacaacctttaaacttttgtacatgtagcaaaggttacatttgtttttctatgtgtgaacccaaggtgagtttatctagtactatctgatcaacaacagggtgcagaaactgattcaggatcactcatgtaagaacagaagtgggtcactggagttaaatcagcctttgaggactttctcaccaatagtcctttccaccaacggtactacatttttctcctttccaccaatggtactacagatatgttaaattaaaagtaaaggaattagtaatatccctatccactcaattcaataatgaagaaattacagaagtttctgagaaatgaggtgactctaatagtgttacacactgtacacaatcaaaagacaacaggaaattctaagagaaaacatgttgcaagtcaataaggactgtcaaaattgattttccatagaaaaaatacgatgtacacttctgacaagtaaacttaatagcctacattttaaagaaatgacaacctatattaagtcaaaaaatatttattgagcacctttgttagagaccttttaattagacaatgacacacggtactgattaagaaaatcatatctaacatttaatgaatgcctacaatgtgccaggtactgtattaagcatttaaatggactgtctcatttaattctcacaaccaccctttgatgtgggttcaattattgacctcctggggtcaagtgatccacctgcctcagactcctgagtagctggaactacaggcatgtgccactgctcccctcaaatttttaaacattttttttgtagagacagggtctcgctgtattgtccaggctgctctcaaacttatggcctcaagcgatcctcctaccttggcctcccaaagtgcttggattataggcatgagctactgtatgcagctagtaaaatattttaaacgcaaaatggactgagaaaaaattaaataatttcaatggctttatttataaaatttttagcttaaaaggtctattgattaaatctactatccagatgctacctgaaaatttttttggaatagtaagatgggacttgataaataaaacaagtacaatttgtaaaaacaaacaaaccaaaaacaaaaaaaaacccttaaatacttaatataatttggctactaaattaaatatcataaataagtgccttcttatctggattggtagtcagtggaaaaagtcagttaagggggaaatcattaaaaatgatatatacatactcgaaacatcattttaacttaaaacaaataaacatgcatgaatacactgatttctgatgcaggaccacagcttcttgttttctaggttagctgactggagttcgtaagcaaatcacacctaagtgcatctaccacttctacttttcattttttaaagaagagcaggaacttgtaaaacactatcagtgccaaagccttctagattaaaactgtcccccaaatactttacagctcccttattcccacctaatttgacaaacatatatatggcaatctgtctttcctgaatctttccaaaacacctgacttaggtcacagaaaagcatccctcttccttcacatttcattggtgtatgtcctattttaattaacatacataattataataacaagtccagtggcctaaagttcgagaacaaacacaactgattcttggtaagtatactattcaaatggtggaggcagacgtgctacagcaaagagcccactcatgcagcaggcattcaccttccaaagatgtggggaaaagatgtcgtgaaatctctggagtcagttaagaaagtttctaaagtttcatgtaactgttgttagtttgctctcttgatttttttaatttttttttttttttacaaacttcaatacaaatggctgggaggggatcttaatttttgttggtgtttttaagacacagggtcccaccatgttgtccaggctaacctcaaactcctggattcgagtgatcctcccgtctcagcctcccgagtagctgggattacaggcgtgtgccaccatacctgactcatcttattgtttgtaatggtgaaactgagatggaactataattatgaagaatgagtctgattcttttgtggaataaggattgcttttatttatagatacgtatcaatgacttcttactaaattataaaaagatatttatataattcattcagtttagtttcagcatgctgtataaaacatacacaactgaatatttactctgccctataattaaacatcataatctttaagcttctagagagcagtcaccatatgctgttaaatatttagctcaactttgtgctaagtctgcaaatacacactttctactgattagataatccttcttcactggccttcaaagatccttccaacaccttggcctcacagttctttgaactcctcatcttggcctctcactctcatgagatctagcctggtctctgtcattaccaattaccacaaaccctccataatcttgatttcatgcacccttccactttccagctcactcaagatctcttatactacactacacccagaatctgtaaacccctgcaggaggacctacagtctgatgatctactaattttctctgtccttcatccccatgatgtctgtctgccttccttgcccaatgtaaattctataatcagttattacaatcactcctttccttttaccccaacttcctctgccctcatcaattgttcgtactcacttggcaagattacaaccctagttaagtctaattctccacctagtcagcactgcccatgccactgaacatggccagagaaaaacactccacaatgctacctgatctaactttcaattcatactcctcagcaatctctgtatttccccagtccattcactttttctctttcccatatgccattctgtttccctttttcttcaaactccctatatgtccccactcatcttcactcacagctgaagaatgaccttgcttcctactacaatggaaaaactgaaacagtcagaggcaaattttgatagacttccatcaccacatttacccatctctcagcaaatgcgcccagatataatgccttcccacctgctgttttgggcgaactgtccatactcgtaaggccaatccctccgcttgctaaataaatccatcccctcttgctcaagaacatagctttgtgattctcctttctcctacatcaattttccactgtacaggatcattcttcctacctgcaatcaaacaaaccattatttctcccaccttaaaaatatctcctctcagcttcgcgtctccctccagccattaccccatatctttgaaattccttgaaagaaccccttctacttgatatctccagctccactcctcctgttatctcctgaacccactccattcaggctttcacccccaacactctaccaaaactgctcaatgatcaccagcgatagtcatgttgctaaatccaatgaccaattctcagtcttcatctttcttgacctaaagtactacttggcacactcgactgctccttcctcctggaaaacacgttgtttatttgcctccctgattacttgatttccttccttcctcaatatttacttctcaatattctttgttgggtcattctcaactccccagactttcagggtgggagtgctcacggctcaatccttttctcatctatattttgcctcttagtaattatctgatcatctcttatgacatcaagtactgtctgtatgttaatgactcccacctttatacctcctccttcagggatccccctgccccattcatacatccatctgtctactcaacatctccacttggaagtataacaggcatttcgaactcagcgtgtccagaactgactcctgcccttcctacagactccatctcagttaatggcaactgcatctccgagtctccttgacacctctctttttcacacacccctaccatccaatcctattggctataccttcaatatagagcccaaatctcaccattactgccaccttgacttcaacacattaccatggagcctcctaaccggccttcctgcttccatccagtaggaaattcaggctattttcaacacagaagctaaagtgatcctaacaatgtaagtcagattatgttgctcctctgcttggaaccttccaatgactccctctgaactctttttctcagagtaaaagctcccgtctttccaagtcctatgcagaaatcttgtattgtctggatctgctcctgttacctctctgacgacactctcccatgctcactctgctccagccacactggcctcgctcttcctttagcataccacatgtgctttgccttggtggcttcttctgcctgtactgctcttcctccagatattcaaatggcttactctttgacctcctttgagtgtttgttcaaatgcctctatctcaattaggccactttgatcacccatttaattacaacccacacctcacaggtaatccccagccctcttaccctgttttcttcatagcactcatactgtactatactatgtaatttacctatttattatgcttcctatcaagtttctttctcctaggatgtaagctaatgaaagcagagattattgtctcatttcctggtgtacccccagcacctagaacactgtttggcacatggtagaggctcaataaacatttgttgggcgaatacatgaacgaacccttatccctgaagctgactaaaatcagtatctagtaactggtttattagcatcttctaatgagaaaccttcatatatgttccttgcacattttcattttacaagtcactgtaaaatatcattaacttacattcatttcataatttaaaaaagactgtttttcctgggttgaaaattttagattctcaaattcattaacagaaggttttctgagtaaattaacagaaggtgtgtttacttaatgtttaaggacatgtacatttcatacaagttgcatgggttacaaattaggatataactatttattttgaaaaataatcaccaagggcttactatgcatcaaggtattctggggcataaaaaagcaagtgttctcactgagggatgaatagtctactagcaactgtaagacagttgcacgaataatgatgatacaaagaggtatccgatgaatataatgtagcaggataaacaaaatggcagtggaaaacaggagtaaaaccaaagggaaggattctgagaagactatttataatgggaactaaaattgtcagctgaagctcagatggcggtagaggcattccagatggagtatagaaaatgaatgaagaccaaggacaggacagaaatatctggggtgcactcactaggtgagtgtgtccagacattgaaagaggatgagcagaggaagagaacaggagaggtaagaactaaaaaggtggtattaggtcctggaaggtcttaaatatcaagctaaagagttttactgccaagctacagaactttatcaaatgccatactgagaagactgatcgatttattaaagcaaactcctaaaggatctcttcttggaaacaattcattagtggttagtgtggaatctcagtgtggcacggaataaagtaaagtacatgggtaacggccccagaaaaaccagagcacagcccagcgcattaccactcatcgcctgggtgatcttgggaaggttacctaacctccggtagctttaatttcctcacctgtaaaataaggctaatgatgtgtattttgtaaagccagtatgaggataataaagtgcctgacacataatatagggtcccctgaaatgttagttctcttattttatcttgttgtaaaaattgcttgtaaattgtatggtatatgaattatatctcagtaaagccattacaaaaaaaaaaaaaaaaaaaagcccatgatgtatatttttcactaatccaaactgtcttttctcctaattggtgttaagtagggaaattacattgaatacagcaggcgaggttcatctgcaaagtgaagacatactccccctaaggatttaaatagtgattctagtttcaacacacagttgagtaaactttcaaaaatgattatctgtaaaccaagacaaatttcattttattattatgatttccattcacaacttttctcccttgaaaactttctctctcctaaccctgaaataagctttctcctgcagtcagactaatttctaaatatgagttctatgatcctttgatgcagactgtgaagtagtacagagagaacagattaatatatggccttaatgaaactgctctgtttggtcaaattctctctgttcagtgaggctgaggacagagatctcattaaataaccacaggcatttcaattctagataaaagaattgtaatttttctttctgaagtcaattccatgactaattttgcatttgcccatccatttgccttcaaaactggcctcaagtcctacttaactccatcaagccttcctcaaacgacaaaacacactgtatctactactcaccctagtaggctgcatagtctaccctaagatgacaatgacaagtgtccctataaaccaggaactgtgcttggcatatgccatttcatttgaatgttacatgaacaccaggaggccggagttattgtggcgtgtaggtaaagagactgagatgcagtaacagctgaagtgatatggctggtaaggtggagaactgggatgcaaaactgtccacccctaaagctggctctcaaccatcatgccgtgctgcttccacactgggagggacactgtagtcaccttgtcatgtcaattgttgtttaatgaataggtcttgtctaaccaacttgaacactgtatggtgttctacatagagtgacatcatagacattgaagaaatattttattgataattttgacacgcttttgtgttcctagatcatatatttccactggaaactctgaaagcattcttagcctatattgtgtttaggctatttgttgcctaactcttctaagaaaacaacagagaatgtagcagtcagtcttcctactgtgtaccaggcagaacaataagaaagcctaggaaaaccaattttgcatgttaagaggctgaaataagaagctatacaaaaaatgttgacagcagattatttaaatggagaaggagcaggcagcagagctcctttagaaaagaagctgcagtggttcacctcagatacagttctgcttaataactactcccaataggtaagtcagtcatatgctgcatatatttaaatgtgaacaaaagtctgcatttgaaattgtaactgataagagagaaaagcaatcaagaacttttgtctttcacagagtaaccagagattctttctcaaatcccactcatttcaaatatgaactaggcatcagcagatgacttttatttagtacaataagctgctcccatttcagctctagtacaaagactagaggatgaaagaacacactctgagaaacaaagtacagttgtgagggaaaaggaaaataaaagtatgtttttggtaccgatgacctcttatggtcttctacaaaagaaccatgtctttaaaacatcagtaaaaattaatacatgctgagacctagactgtccaataaggtagcagccacaagccacacatggctactgagcacctaaaatgtgactactccaaattgagatgtgctgtaagtataaaatacacaccagattttaaagactcagtacaaaaagagactgtaaaatatctcagtaattttgtatactgattgcatgttgaaatactattttagatatactaggttaaatatgttatttttaaacattaaaattagttttgcccatttctttacttttaaaggccactggaaaaatttaaattatgtatgtgacttgcattatatttctgttggacggtactggtatagatgatgttgcagaaaaaacagggaaagaaattctccattgtgactcaatagacttaagatttcagtccttcgtaacagcctgctatagagaattcctttttccagaagatgggcatttttggtgtaatataagcatgggacttaaaattacagcagcctcggtttacatttgatctgtgccactgactagctctgaagtccatgacataatctcgggtaagtgacttagctcagggcaaatgtatctcctaatcctattatgagggttaaatgcaataatataaaaagcccagcattttaaatgggaaacattatgattctcccaagaaaatttctgtgacatgcttctaacatattttggtggcacttcatttaaaaaaaaaaaaaagactaataggccaggcacggtggctcacgcctgtaatcccagcactttgggaggctgaggcgggcggatcacgaggtcaggagatcgagaccatcctggcaaacatggtgaaaccccgtctatattaaaaatacaaaaattagtcaggcatggtggtgcgtgcctgtagtctcagctactcgggaggctgaggcaggagaattgcttgaacacgggagggggaggttgcagtgagccgagatcatgccactgcactccagcctggtgacagggcaagactccatctcaaagaaacaaaacaaaacaaaacaaaacaaaacactaataatattagtggtctcatggttactgtttgtaaagacttcaacttctgaattttaataaaaagaactgtactgttagggaagattataaaattttcatttttggagatctttaggaaaaaaagaagcatattatttctcttggaaagtataaatcacgaagttcagcaggatgataggttagttaatactatttgtaaaaaagaggcaaatctagttctaaaactcaactggataatgttggggaattcatgtaacatttttggaatactgatttcctcacttatcaaatgctggtggctgactaaatgatctctgaaatctccttcaacgctaaggtttttgtcaacaacgaacctagaggtcaaacatgcatttctttattttattttttattatttatttatttatttatttatttattttttgagatagggctttgctctgtcacccaggctagagtacactggcacaatctgggctcagtgcagcctctgcctcccaagctcaagcaatcctcccacctcagcctcccaagtagctggaactacaggctagggccacaaagcccggctaatttttgtaatttttgtagagacggggttttgccacgttgtcctggctgttctcaaactcctgagctcaaatgatctgcccacctgacccttccaaggtgctaggattccaaagtgtgtgagccacaaatataaatttatattcactgctttcaaagctatccagcttaatagtttattcttatttctcaccatccttgcagaataaaaataaaagtctatacatctattttaggggtgcttcctgacaagccttctataataactccttgcccaaggtgttgtcctataaacttccacaaacccattctccccactgcaaatatttcctctcgatacatctacctatgtatcctgcttagtgctgtatatgtttagaagccagagttaaaaaaagaaaactactatttttcccatcctcaactccaaattctggtttaactgctgtcaccttttttaaccaacatatttattaaatctgaaaaaggtatacagcaaaatgaatgtgtcatttaactgagtgtcaaaagtaacaaaaactatctgtaacacaattacttgtggaatgacctgctgatggctggttaaggtttaccaggattaaacaggattcttaactaggaattttattttattttctgatctgaagattaaataaaccagctccagctttgccctaggaatgcatgggactttaagaaattaattttgctttctgtaacatagcctgcttatctctaaaaagaattaataataactgcacactcaaaggcattgtgaccccaccagaaaggctcggtacaagcataagctattaaatctcaaatcggcagatctcacagtaaaagcagacatattaacaacacagtgttgaggcaaaattttgaaaaggcaggagttttaaacatacacacactcacaaaagaatgccttattgctacccaatgacccgatgatcgggtatttttcttcctcctagaaagccttgccttccaggtgctaaagaaagccagtctggaagcttatttttacaatcagcccaattcttctagttactcaaggagaacgtgttaaggggttcttccctttgcataggaaaatagcacttgtaaatcaccaatagttgaattaagatctctgactgctttttcaatttgtggtgatgtaaattaagagattttagagaaaaatcacttttccacgcagtaagagcactattttgcagcattactaattaagagcatacaagctgtggagtcagattatagttctattgctgttctgcttgtaccatcatatacaaaggcctcactcaatccaatgtgttcctccattagggcacgctttgtccagtagggcccgtgtctttttcatcaataatccatgctcttccctcttccttctcaaccaaactcctccaaagagctttaacccagggaggctggcagtgcatagtttcagcctttgtcctcaccatctttttaacacctttccccacccccagccagcagtcatcatgaggaccttcctcaatccaagcccaacctgcatccctttctagtatgttgcaataaataaatatatttctaaatgtgtgataatccaggaactaacagcctgagagtgcccaattataatagatcaattaataccctaagaatataaggctaaacttctgaaaaatcctgtcctatttcagttctcttggacctattaagaacaagtagacatgacaataatttaggtttcctgcagtaaaaagtaacatcaaacaaattaacactccaagagatgacgcaactgttacctggggagcacactgagaatggcatagcagctcctgagattggggtgtgtttcaaatgacataatgggtaactgctgtttctccagctaacaatataaacccagcaatgaaggatattttcaaagcacccaccttgttgaggacatctcgctggcagccaagataaagattgggaagaattcgggttggcccaatgttggcaacaggtaagcaaggctgagaaatgcaggtagggactagagtggattttccttcacagaggccagggaaacaacgagagaactcagcaaacccacctaagaataaacattataaaattataaaaaattatgccacgcacaaaataaaaaccagctttctgtgaactgctcaaacagtttaaacccacgaatccaagtggatatcactgcacacctattcctggctacagctgctgatgctaagactgaagcataatccagcactaggcctggcctataacgctaccatggggataggcaagtcctgaaggcacttataatgaatgactcctctctctcagatattctcttcatcttcacataccctacaacatttgctccccactccccatgcaaatgtttttttttgtaaaacataaagaggatttaaagttagtagcaagtaaccaagccaataattcacagaagcagaatggggatgtaagaaatgaaaactgaggctgaatgcaacttcttcaaaataaaattgatcgagtcaaaaattctttctacaactaactttaaatcttcttaccatacaaattttttactgcaaaggtatcacaaacatactcccacctacgaatattctatcaagttctggggattccctgggcagttagtcaaggtctccataattaccactgatgtctggagagctcccgttcatctcagcaagcactataaagaagtgctgacagactaattgcttagggtgcaggaaggctttgtggcaagattactgaactcagaattagaagaattcagttttttctagtcctgtccttacaatgatctgctctatgaccttcactaagtcacagtcttgccaccactcaatggagtgaaatctatgtagccaaaggaggtgctttcactccctccgggaaaagaaaaaatgagtaaggttatttgctttccaatctaaatattccttgctgtccaaacccaaacaccaaacagattctgataaattttcagatatacgccttgctattcaaaccctcgctattcactaagtccgaatcaaggagatttggatgacgggatcctcgtatatttttaacattaaatttaaaaacaaggcagggctcggtggctcacgcctgtaatccccgcactttgggaggccgaggcaggcggattgcctgaggtcaggggttcgagaccagcctggctaacatggtgaaaccgtctctactaaaaatacaaaaattagccaggcatggtggtgggtgcctgtaatcccagctactcaggaggctgaggcaggagaatcgcttgaacctagaaggcggaggttgcagtgagccgagattgcgccactgcactccagcctgggcaacagagcaacactccgtctcaaaaacaaaaataaaaataaaaaaacaacaaataacatgttaagtcttattagaagatagtacctttttaactgagccttgaacaagatcctgaaatctgactcaagtatttatcttcatctctttgagttatattgtattagactttctcccacttcaagaaacacacaaaatatgcccttgaaaactgctagaagtgcaggaagttgagagggaatcatctttcattatgccctgtattatgtttaattcaagcataattcagccagacgcctgtctctactgtctaggctcagtgcagggtcctcaatgcaacaagttagaatggtaggcagttgacaactatgccacctgcagaatgtaaaaagagtggcctggcctccaacctgaccaagtgtctttctatatattttttaacacagaagcagttaaagctcttccacttactgaagttcttaaggtaatctgataggcagaatacatggatccattatagaaatcacaaattcctttgtgtcacaggccctcaggatacctgcaccttacagtttcatggtttcattttttttttttttttttgagacgaagttttgctcttgttgcccaggctagagtgcgatggcatgatctcagctcactgcaatctccgcctcccgagttcaagagattctcctgcctcagcttcctgagtagctgggactacaggtatgcaccaccaccctcggctaattttgtatttttagtagagacggggtttctccatgttggtcaggctgatctggaactcctgacctcaggtgatccacctgccttggcctccagtttcatttcttaccgtttccaatgatgacctccagccacataaaactcattgttatttcacatttccatgccgttctcttgtccaagaataccaccctcacaccgccccatgcatgcacacgtagaagccacggtacatacagcatacacatgtgggcaagccccatgatcatacagcagaggaagtaagaacacaagcccttgtacctgagttcctgtcctggctttaccactttctagttgtctgatttgtcaagttacttaagcccctcctactctaatttcctcatctataaaatgaggataatgatcacacctatctcacagagttgttgagataattagttagtatatcaaaagtattttgtgcctggcgtatagtaaagcactcaggaggtatcactggttattgctttttttttttttttttttgagacagagtctcactctgtcgcccaggctagagtgcagtggcgcgatcttggctcactgcaacctccgcttcccgggttcaagcgattctcctgcctcagcctcccgagtagctgggactacaggcgcatgccaccacatttggctaattttttatttttagtagagacagggtttcatcaagttggccaggctggtcatgaactcctgacctcaggtgatctgcccacctcggcctccccgtttttttgttacggtgatcaaacattcagtatctagcgccatctgtggggccttcctccacctttgagctgcggctgtttagctacacctccttagtattcatctgagacaaaaagtggaaaaaggaatgcctgtaaggttaacttcccaaagtgtgccccagagcactggcgtcctgcaagaagctgacagacaggatagcggtctaaaaagtgagagaaatattgtatatcctagctccctggcagagtcagagcacatgttaacttactaaaggttctaaaaagtattttcaaagaaactggtttcatttattgaagtctagtaagtttccccaaacttatctgaccatggaattccccctaaaatatattaatagctagtagaattcacacttacaaaatgctacgctagggtcaaagcaactactgaaatggagtcaatcagaactcctgtacttacaagtacaacccacagacaatctcaaaaaaagggggtcagccaatattggtatataagtgcccactgtttagaatttatgcttttgtttctattcgtgttttgttccttttcagtctctctaattgaataacacagtcattatttaagtgagttttttccccaaggtagttcttgtaacaataaatgttaaagattctcatcattctttgcttttcttacacctacccaacctaacaactgtcaggcactattttaattacaattaaattgtatgatgttaaattttaatgtggtgtctattaacatgtagttttggtgtttctcttttttttcttaaagacagggtctcactctgttgcctaggctggagtggcatgatctcagctcactgcaacctctgcctcccaggctcaagtgatcctcccacctcagcttcccgagtagccagggctacaggggaacaccaccacgcccagctaatttttgtatttttgtagagacagggtccttcctatgttgcccaggctggtctcaaactcctaggcacaagtgatctacccaccttggcctcccacagtgctgggtttacaggcatgagccactgcgccctgccagttctggtgtttctctaaagaactgtcttcatatatttttcaattctggctctaaaacagttcctggaatggttgtcatttaaattcaacaaaacagcttgggcaacatggataaacccaatctctgttaaaaaaaaaaaaaaaaaaaaagaaagaaagaaaaaattagccaggcatggtggagtattcctgtagttccagctacttgagaggctgaggtgggaggactgtttgagcccaggaggttgatgatgcagtgagctgtgatcgcaccactgcactccagcctgggtgacaaagtgagaccctgtctcaaaaaaatacatacatacatccaacaaaacaatattccaataaatgttctcaaagagaaaacagagaatccaaggaaacaccacttgaatttcatttgaaccttataaatgattatttttataaataatgtatgtaatcctagaatgtactgaacacttactgcgtgacaaacattgctctaagcactctataggtatttacacactcttacagctgccctatgagataggtgttactactaatcccatttatagataaggctcagaatcacataatataggctcagaatcacgtaatataataaccggaagagccaggttataagtctacttttctaaatcctatggaattactttcaactctcccttggatgcagggacagccttgctgatgatattcatggggtcctggcctccccagctgtgaccaggctaaaaaggccatggtcctctcccaaactgatggaagagccttgtttccccaaagctatatcgctcaaaggcttcaatgagggagaaggaagaagatccgacaagaacagagaaaggagaatctctttaaaggcaatttcacatgacaccaataacaaagtttacagatgaactggttgaaatgtaaatatggtcactggtttgttcatgaccaccatttacaagttggtagtagaccttggctgtcaggtcaccccccacagaacaactttcagaggagatgcaattctgcaataatcataaactgagccatcagccaggctgttcgaggtccagttctatcgttaattggtacagtgatcctagatcactttgatttcagtggacctcaaaagtaagtgtggctctagaaagttctaagacagagaacagaaaggagagaaagaaaccattgttcagcttcaaaacaaaagagccaaacaaaacaacactacactgtaaaacacattataaaacaaaaagaagcctctttttcacaaatctttctcaactgatatctagaacaaactcaaacaaatatttaaaaatatttaacagatttagctgcaatcagaacattcatttagtgctcagtttggcttgaaatgtcccagactggctcccagtcacttccagaaaaccctacctcagccagagcacattttcactgatctttatctatgacaatgttccactctgctgacatcctccttcattgacagttttttccattcactgacctttcattcactgctgcactctagtgactccagtttcgtttcattaattaacaacagatgagacactgcctgatttcccttggacctctaaaaactaactgtggcctcaccagcaactcagttttgaaacatgcttaaaatgtccctcttcctttcgtaagttctcttacaaacaagatccacttcagaagaaaagttcatttatgcaaacgttctgctccaaatggctaacggagacaaagaatcaagcgtcctcttatctgcccttatcataactttgttgtcccagggactccaagctagattccattacaagacataacatcagtccgttatccgctatttactgtgaaaagcagtaccgaaaaactgataagcttcttgaaaaaatttgcgcctattttttaaagttgtctgaagacttggctcactgtccaatcttgccaagtttctcctattcctaattttatgctgtttatcatctgggaatgcagaaaacaaagtcatagtaacccacatgtgtttccctaacatggacctgaacctaagaatgactgtgccccctactctggaagtatctgtgctaagaggaaggaagacaaatacacagctatttccagcctgctgagaaacagggatgggcagtccctgcaggcagagaagcgtcttggcctctacagctgtggatgcacaggcagccagaccgcaatgctaaaacccatgtttctgttagtcttccataaatccaaccaaaagaatgcatgtttacaaataaaaacatagatactacttccgacacagaaaacatctggtacagcttctaaggcattcctcatttagataacaccttctcctaattcagccatgaaaacgtcttcccttaagatcacctccttcacaattccaattataaatatgattttctgtaaaagcaaacgtgaaccaccattccattttgggggggaaaaatctgccaagtaaaataaaatacatataacaactctactaaacaattccaattagtcactcttttctcttccctctcacccatgcaatcagttatatatcacagtattttctttaaatgaaagtatatttacataataaacaaaagtagcactttactgtggcttactgatattcttaaaatgtttttaaggccaaagttctaaaaatagatccctctccttttagcagttccatgactttaaagatggtttcctgcagggagagacagagggcctttccactcatgccttcatttaaatagggagcaagtcactagggatttatcaactggcagagccgccttcaaggaaggcagaatcaaagagaactgccctcccaccctatattgtgaatggattccatggttatacaaagaaataatattgatataaagctctactttatggaagacattttcctaaaaagtcatatgcaaatttaacttttgtattttaaatcatctgcatatagttcatatggtttcacagtttttgaactatgcggttaaattcttgttgttgttgttttttggagatggagtttcactcttgttgcccaggctggagtgcaatggtgcgatctccgctcaccgcaacctccacctcccgggttcaagcaattctcctgcctcagcctcccgagtagctgggatcacaggcatgcgccatcatgcccggctaattttgtattgttagtaaacacggggtttctccatgttggtcaggctggtctcgaactcccaacctcaggtgatcagcccgccttggcctcccaaagcgctgggattacaggcgtgagccaccgtgcccagccattaaattcttttgtagttctcaagtagtttaattcttttgtaaaacaaaactccctttttgtaacataaacacaatcctttcatttgcttattttagaatatatgtgaaaaactagagtacaccttcacctgtagaggacagttctctcttctctccatactggaaagaaaatctgttgctttaccatcacacaaaggagacaactctaacattaaaaatggaaaatactgaaaatgtttattttgcagtaaagtactttaattgctcttaagagtaattctgttatgcctcagtctgacatgtctgatttaggcaactttattctctagacactcaaaaacagactaaagtatggtcacaattctttcgggatcagcagacagtaaacatggagagttgaaactagttgaagaaaagaaaagaaaaaaaaaagcaacataatttcatacccctaaagaaagcaaacaaaatatgtaactaatgtttcaatgtagatactttggtctggataagccaagccacacaggtttggtaaattactcctaggaaggtagagagcatagcattttttccacagcattagcagcattccaccttttcccatatagccaactctccaattgagccatactaaagagaaaaatcccaaatgatctaaagcattaatttaaagctcttattccatccacccccatctactggagcacagaccaagaggagagtggatagatacgcatttctctttcaggaaggctgacaagtagcctacatctcacaaaacttatcccataaatgacacctccaaaagagcttgccctatattaaacaaccctatcacgtgacacagttgggaaatgggaaattctatctaattttggtattaggacatatgcaacagttatgacatacacaacagttatgacatacacaacaaatgaatgaaaaattttcaaagcaccagcagacaaatcactaaacactaaaattatgcaacttataatttcttatgactcagaatgtccagatcttataactcaggataatatttaaatcaactccatcagcaacatccagatgtgttattcaagaaggaagagttctcagaagatgtagactggtaactattctgctgatcttttaaattggcaatacataactatgcccagaaaaactcctcttaaacgtcctgaaacaaagattgttctaaagactgcaaccagaataacccatcaaaaggaatacagccagaatctaccacttggctgaacagaattaacaagctctgtaggtaggagagccagagtcacagagtctccctactattttcctaacacatctgtgctttcccgcctttaggcttttgaaaagtcaacctttccaatccattttgtatttccttctaaaccacaggcaagcacaagttacacctcttctatagcagtatggtcccaaaatttttttaccaggatcaacaaaatacattttacactcaaaccctctgaacacctacacatactcaccactaagacaaaagtttcatgatactatcttccctaattctgttgcgtttaaagaaaaaaaaaaaacaaacttccttgagcagcgtatctagacatggtccagcttagaggctctataaaatttataccaatcatttggcagtacctaccactgacctagtaactgtgaaataactgtgtatgtgttgtgacccgtcttacttctccagctattgtgagctgcttatggataagaattatccataattctttgtaattacctcagcatttagcatagtgcctggcacataattagaattcaataaatgtttattgaatccttccttgttacaatgaatagctgttgatggacataagtcttgtatatttttggtgttccgaaggatttcctgattccattcaaagccaaaagctagttggtgtgggtgggggcacaaaatctgcttcctattcctagaccacaatgccccagaagactctcagggtgagtgaggaggcacagggcaagaaaaaaacattttttcttctactacaggaaaaaagataaaattggcgagtgtcactttggttatccaaaagcgacactgaatccttactatgattctgctgtatccacaggactttacataaaagggaaagaaaattttttctgatgcccctaaatggcgcaggactccacaccggtgtggagagtcccgtaatatatctccatggctcagggaatcagggcacatcccataggaaaccaatgagacaccaactatgattataccccagatgaggatggtgtggctgctggacatgtctataatcatcatcaaaatggataatgaaatgagattatccataggggaaacttgatgagtcaagaggaaaaaggaatacaagtctagtgtctggagaattattcaagaataaaatctgactaacttgtaaactgtccatgaatcacactatacagctcacttctcaggctatccatgtgaagcgcaaagctttctaagccatctagccacaggctctcccctaagaccacttctgtatattccactctgtgtacagtcctcctctttggccaactacacattttgacaagagacgtcatagagcagtgagggagaaagggataactgcgtttcacatataagttcaaaaaacacttaatagcacctactatgagtttgacatagcgctaggtaatggaacagtggtgaccaagacagagagccttctctggagttgacagttttatgggataaactttaaccaaataattagatgaataattaactaattatggtaagtggccaaaggcatatggaaaccaactttgcctggtagctagggaaggcttgacaaccacattgaatctagcaggaaaacaactaggtaaatagcagagagaagagcccagggcagaggacagagcctctgtgaaggcccagggtgcatgatgtcttaggtttagagcaacagggaggaggcctaaggagctgaggcaaaacaacaactgaggacttaaagtggcactggatgaagttagcaaggtaggcagaagccagccactgcagggccttgtgaatcagttaaaaattttgtaacttatcttaagagcactgcatattattgatgcatattaaactgggaagtgatgtaatctgaattagttaaaaacacaaaataaaaatgtaactttggctgcagtgtgagcaatggattggaaggtggcaagacagagcatgtgaacagatcagttaagaggctcctggagcaacctgggggaggaataacattcaactgacttcatggtagcagaagaccagaaaaccagacagaccgaagaggttggaagaaagatctggtgactaagagatgacaggtattgcagccatatctccaatagctcacaatacccatcaccttaaagtacaaattcttccttctgatttaaagagcttacataatttgatctcatgtcctctcaattcccatttctctccttcacaaaaaatccactctggtctgctcactgcccctccaaatctatgttcattcctgacatttttaatcatgttctttccccctcagaatgcgcagaaccctccctacccaaatcttactcctcatctttcaaggtttgattaaaattccactgccctaatcaagtcttccctgacttctgcagactactctgaatcatcccttatcactgtatcatacattttagcaaatgatcatatacttctctttctttcatccactttaggtgcatttccccaaattaaccactacattctcaaaggcaggggcaagccttttgcttttccaatatcttcacccccgagagcccagtccaaggcacagccatggaggcacccatcaaatattgagaggctgagtgagtgaaagggctgaagaatatgctggacctggtgtttctctagactacacagctgccccacctggggcaagggaagattgatgtcactgttgtcatctgggatgcttttgtttggtttgtgcacaatatcaggatggggaaccaaaggactatctttaagctttagttggctctctagtctgtttgtttcaaaagacaatctcaagcatgtgtcttagccactggtagctgggaagagacatgactgactctccacactggcagatagcaatcggagaaaagatgatccaatttagacgaattcatgccaactgagactcagaaacagagccagaaatacacagcagccagtgagcaaacagcacctttttccccagctttattgaagtatgattaacaaacaaaaattttatctgtttaaggtgtacagcatgatgatgtgatatacatatacacttggaatgactaccttacctcacatagccatgctctttttgttgtggtgagaacacttaagatctactctttcagcaaatttgaagtatatggtacgtttattgtcaaccgtagtcaccatgctgtacaataggtctctagaacttactcatcatatcactgaaagtctgtactctttaagcagcatctccccattaccccagccctccagcccctggtaaccaccgttctactgttttcatgagtttgactcttttagatccacatgtgataccatgcagtatttgtctttctgtgtctggcttatttcaattagcataatgtcctccaggttcacccatattgttgcaaaatggtaggatttccttcttttttaaggctgaatattccattgtgtgtgtatgtgtgcatacagcatctatttttagtctgttttcagtgactctcagtcactgtagttttttagacccaagagcagccagttccttaataattggcatacttttactgaaatccattaatttcaatctcatttaccaagttctacaggattcgaaatggaattactgaagatttcccttctccagacaaaggagaagaaacaccaaactagataacagaatttatggtaatagcacaaagagcaaaatccataaccaggaagatcaggttctatcatacctccatgaggaaggacagtaatcaattctattaaaccaaaagtatacatttattacacagaactgtcatcagaatctagatccttattaaattgaaaatgtgtagagtctaatacatttttgttcactcgtaggtctaactacaatagttaagttcaactcaaaacgaagaaatgagtatttggcctttaaccatagcaaacattaatcgaagacctttgctgtgttcttaataaatggtatcttctatccttattcacagctatacaccagcataaaacagagtagacttttacttgatgatctcttctggctaacatagtttaatgctttaaaacaatttatatacagtgtatttttatagattgctatattctataaagtatgaagaatatgactgaaattctcaaaaagactgagaaagagctattacaaaaagagcctttcagaataagcctgatctgaaatgggcacccttgattcccaatctagcctcctgacaaaattccagaagactctggaattacttgtggatgtgggccttgggcagcaagagcttgggagagtcactcagcagctctgttattttcctcatttgtaaatgaaagggctgaagtctgtggttcatttatggttttctcccgcaatcgctgtagggttattctgtgctgcatcacaggacagaagggagtgctgtggaattaataagcctggcagagcccttttgcttttactcaggctgtactggggaaagagaaggacatagtagaacagcatttttcacatgcaggttgatctttatttctactaaattaacccatttactctcttttccatatgtcagcataaaataaaagcccaaattcaatagttttcctttttttcacatatatttacttctaatctggcgctcttagaaatagacaagtagaataaactgatacatagtgaataagtaaaagccaagaaacaagtttatttttcagagaactagttttctgcaggttgttgaaaacaccaaaaaagttgctcaataaatcaatgttggcaactgattttttgggttttcaaactcatactgataagtttcttatttttttttgaaggatagtcttttagactattgatacagaaatttcacatccattgtctaatacaatcctcataataaggcaagcgttattatctctttttaggagctgaaaaaatacaagataattcaggttaaatgacttatccaaagttgccataaggagcagagacacacacagaaaacacaggctacagctttgacccctagtccattgttctttccagcttaaagggatttcctcaatgcagatgttagatcacctagggaatgggtgtgggcatggcactgagttgatcagaagaccctgaaaccttctgcagatgcagatacagagcctgtgctcaggtaatacctttaccactaggacctagtttttcttcctcctgctcttttctgatcctttttctttagtcaatatctaaagtttagcagtaacacgaaagatattaccaacccttgaaaatggttccttttttggattctccaatccccatctctccccttcccctcaatcttaaatcttacatctgcaggagaaaaaacaagaacaggcccggcacatggcatagagcatggcactacctctctctagctctaccttgtgtaatttcttttttcttcttttggagacagggtcttgctctgtcgcccaggctggagttcagtggcacaatcacggctcgctgcaacctcaaaactcctgggatcaagtgagccttccaagtagctgggactataggtatgataccaccgcacccggctaattttttaaatttctagtacagacgaggtctctctctgttggccaggcaggtctcaaactcctgagctcaagtgatcctcctgcctcagcctcctgaagtgttgggaatacaggcataagccaccatgcctggcaccttgtacaatttctatacccagattacctattgctcccaggaagttggtcttctctacgtttatgacttctcattacaagttcaaaatatagtttatcagacacaaaggactttattaaaaagaaaaaatatatagtttattctgccaatattttcctataattctaattatttaatatacttaattatataagctttcctgaaatattctcaatagaattagattcttttcaaattatgagaaacccagttaatttttttagccaaataggaattacagcatttttcccttccaaaagcccatcctagattataaaatcattattatgatacatttatgttacacccatttttttactctattaatatgcttttttttttttttgagatggagtttcattcttgttgcccaggctgaagtgcaatggtgcgatcttggctcaccgcaacctctacctcctggattcaagcaattctcctgcctcagcttcctgagcagctaggattacaggcatgcgccaccacacctggttaattttgtattttttagtagagacggggtttctccacattggtcaggctggttacgaactcccaacctcaggtgatccgcccgcctcggcctcccaaagtgctgggattacaggtgtgagccaccgcacctggccaatatgaattcttaagtctaaatttcaaggggggttgtggggaagatatgcaggtctttaaattgtacttattcaataacctgacttcaaaattgaaaaaaaaaggaaacaatggtttgccattacctacccattaatggtaatagagaactttttttttctttttgagacagagtctcactctgttgcctacaccagggtgcagtgatgcgatcttggctcactgcaacctctgcctcccgggttcaagcaattctcctgcctcagcctcctgagtagctgagactacaggcagatgccaccatgcccggctaatttttatatttttagtagagatggggttttgccatgttggccaggctggtctcgaactcctgacctcaggtgatccacccacctcggcctcccaaagttctgggattacaggtgtaagtcaccatggccgggcagtaatggagaactttctaaagcatccaaatttgttttttttttaagatgagattgctactgataattttgtgttttgtttttttagagacaggctctctgtcacccagactgtagtgcagtgttgcaatcacagctcactgtaacctcgaactcctgggctcaagcaatcctcccccatcagcttcccgagtagctggaaatagaggggtgcaccaccacacccagctgctactgatattaaaccctttaatccactgggagtgaaacaatgctatggcttagtttgacttggttagtaggttatttactaatgactagagcaatcaatttacatttacatttttaaaaatacaataattattctgactgttctcaattaacatgaattcaaggacttgcgtattcctatgagtggagctagatttctagggttgttagctctttatcaaatatcagtatttaaggaccacagaaaattagcactgtttcactacagcagcattttcatcagattttaataccatcttcacatctgcttatatggatgaagaaagtttcatattagatattttcccatcgcagctatatatttgctttatcagaataaatacaccttccaaatcacctattttgaaacaatctgaagttttctctactttcagacttcatcactgcttaatatgcttatattctagactgataaatcataggaaatataaacaatataaaaccttcaggtaagctaatatcaaaatatttactgaaaacttaagaagggctaggccttgcgggaacacaaaggtaaacaagacctggtccatattaaaaaactaagcccactgcattcctgtagaggttccccaaatcccacttccttctccttcagtaatccttcatttttcatgaccatgtaagtaggtcctccaggtaagtgtcagtctcctcttgtttgaaggaaaagagctcgttaagatactgctatcaatttcttgggagtcctcttgttctccttattcacagtcattcttccgtgggtaaggtagccctgagagtgtgagtagatgtggggccacaattcctcactgccatagctaatgaccataaaaaccatctcacatatctgatgctttcttttctcaaggtggctgaaagttctaaaccgatggaaaaattattccaagaaaccactttgtctttctattaccatgtccaaacgagactgacaacaatctccaactgttgaaagtcacaggggcagtttgtagtgaaaattgtctccagtgaccttgtaacttacagtagcccctgtgagaaactagggtgcttttcagttatttctccccaaccaaaatatttaagaaacttttgtcaatatgtccttctgtcccacatccctggcttgtcctctgagcagctggacctttgcaataaaacagtttcccaagaattgatggccaaaccttctccaatactgttatccacttaccccaattatctacctaccctgacgaaaaaattcactaaccaagagaatccccaattgcttttggatgattgggaaggcttctaatcatctagaaccctctcttaggtgtcacaagaaatccagctgctcagaaattcccaaacaagcaattcagactctgaagtcacctcctaagctaatagaaacacaggattctggaggtatggatgaagatatggtgctactaatacatttaatgtggctcctggtgctgcctccatggacttgccgttaggcctaagaaacacttcctgtttgaaacagggatgtcagggtgttctgactcagtgtgtcacaccacgtgtccctagagttgacatagctaatcaggcagtcctgtttcttccttattgcccagtgaatgcccctcccaaggctacacaggatagattaagaaccttcccaggtaacaaaggaatgctctttggtaaaggagtaaagggtacaagtagctaaagcacctgtgctagaaactcaatgtgagctcactcctctggggggctgtctacttgaccgagatgttgagtaaggtctccccatagggtaaaagtaactcaaacaagaacatggtgggataaccactctgtcacgaagcacatcttggcatattgcttctttaagaaagactctggctgggtgtggtggctcatgcctgtaatcccagcactttgggaggccgaggcaggcagatcacctgaggtcaaagttcgagaccagactggccaacatggtgaaacccggtctctactaaaatacaaaaattagccaggcgtggtggcaggtgctcagaatcccagctacttgggaggctgaggcaggagaatcgcttgaacctgggaagcagaggttgcagcaagccaaggtcacaccaccgcactctagcctgggcgacagggcaaaattctgtctcaaaaaaaaaaaaagaaaagaaaaaccctgatcccattaacaggattccaaggtaaagtccctcacacagtggccacctgaaacatgaaatgagttcctaaactcacccaattagtttagtgaaatgctaataatagctgttacatttaacacactcatactcccagtaaaagaatgtgtctatcaacagagacagaatctaatattataattctcagttacagacttctgaaaactacattctaagacaagctggcttcacttaagaacactaattgaaagatcagacggaatcacagcataaatgaaaggtgtacagatagacaatctgaaaaagatgaactatccttgttcttagagaactgaggaaaagcttgtgagagagaactggagacatggaaatcttatctaaacctgcccagagtttaaaattattaacacaccaacaactaattaatcttaatgttttgtttttcttagaccaaatgtttaaaagcactcttgcctatcactgaagctgaatccgcccaacacagcagctttatgttaaggttactgtgtgttgtcaaactatattcccagctctatgagcccacagggcaagggaaaggattttcatttgcaaaacgagaagcaaaggatgaatagccttctttggaatttgatgggattaactcctacaatgccgtcctccaggagagatatagaatatttggtccttcccacacactttataagatcatctggttgcttagcatttctacgttgagacttttttttaattataaaacaaataaaaatatacaagtaacttttaaaacaattcccctaattaccagaagaaacattctgcacacattctccccctatttcattgtttataatgcccagaaaggtgaccataaggcttatctctggagtccgctccaactataaatgttaagtaagagtttgacactgtaatattggtctggttcttgccacaggggtgggaactagcaggagctgagatgttcatcatttggtgttcttacatcacaggtgaatggaaaaaggcagacagaagcagctggctttgagctatccatatgggtgtgcaaatctatgtggcactaccagttaatagcaagcaaagaggcacttgagccaagtcaaaaatacactgacctatgtggaagaatgatatagtattcaagttaaatagaacggtgacatcaatcaaaagctataaataaatcattttacacagcaaagttgggatgatctattgtactgagttcacagtgaaatatgcttactcatacagctcagcaagattctgagtccttttaattccatcacgagccttacctgcaagcaggtgaacagagttgaagctcttctccagtttacccagaagtacagtgagaaaacagtctgaagagagagaggcaacatcttgggagctttgatcgtaaactacaaccttctgactgcaatcaatgtcaacctgaaatgcaaacatgaggcttgttaggaagaaggtgagaaaagtaatctcaaactactgcttaagatctcacatttaccagtgctggggcgaataattgcttcctgttttcaattaataatttgaataaaaatgagatgtagtcaatttacgagacagacacatacaaaactcttaaaaaccaaaatgatgctatttctgtgtaggtgatctcacgattccctggttttaaatcctttatactataaaatggtaaagttcataataaaccaaacaatatgcaaaataaacataaccctggacctaaacaaactttttttaaaatgacttttacaccttaacaaagaaatcagttgtttatttaaattaaaacatgagctcatttgtatttgtgaagaaaaaaaccaacttcctcaccacacagacaacattttagtatcccaggaataacttcccttgaagatatcattaagtcttgaccaatgttaccacatgtgttatgacacataaaaagcacccctaataattagttcctactttctttccaaagaacttgaaaagaatgactttcctttcagtaaatttgcagataatatagaatagtgtttaataaaatcattttagcaagccacaagaaaatatagcacttgtccaaactaaagcaagttaatccttcatagtttagaaatattattaaatgtggcaatatggacaataaattattttgaggtaccacaaggcaccaaaatttaaaaagcaaccaaaacttcctcaaattactttctctacttaaagaggaggcttcaattaaaattattcctcattcagtgtgtccatttattttgaaaaggcaaaaaggaaagcgtttaccttatgtttcgctgaatgctggatgagctctgtaattaacactttgtcctgttgcaaccttcgcttcataagcttggagcagttgatattaatggcttccaaaatgtgggatgtattgtattccacaaatggccggctatcaattagcagcactttttccgttccactttccagcagagccaccaacctctcagtaacaatttgagttccaatcatctcatgggccatgacaacaataagtcctcttttcccacctccttctttaatttgccacgatgatgtaatggtggtgtgctcaaaggctcagccactccattgtactaaaagtgtatgaggtcaggctggtggtgactggcaaaaggagagttaaacccattttcagcaagagccctccaagtgaatgtctctttctctttcccgttgatgtgctcttgcaaaggactccgtccacaaagcagcccctcacatttgattcataaagagatgactggaataaccattccacaacaaaagatgctttggagcagccagcgcattacatcattctttacctttgctcccgcgctccaacagctttacactggactgaaagcctacgcggagagagaaagacagaaaacaaaacgtgaggtcaaaaaaagaagaaagagtgtcagattagagagagtgtatgattcataatatttactccattaatctaattccatacttgatgcactgcttcatttgaacaaacaaataaaaaggacaaattggtatggcttcagaaaaatgtgctagtgataattccattttacctcaaaatgtaaaaactcaaagaaaacaaaacaagacatatcatgaattataatcacctagggctcagaactaaatgacctgtagtattgaattaaaagggctacaaaaagctgcttgaagtattattattccaaatagttttcctatattttatttgcttatttattgaaatcccacaaagaatggcagctgaggacaaagttagcaatcctgtgttaccaggacaaaaaaaaaaatattttctgaaatggcttgagaattcctgcgatgaatgggtaggtgtatatgtgtgtatgtgtgtgcacatgtgagctcacgcgagtaccagggcgcaaacagcagccttttaaaattgccctcacggaggagagaagatgcaggaaaactggagtttctataaatttcagctatcttttaaggaagaggaaggacaaaaacaactgatatgtttgtcacagcagctgctgagctaggcctgtgaagtgctgaagctcacagccatggccctgtcatgtctccttccggaggccatctccctaccaccaagttgcttaaggccctgtaagcttatccttcactttttcctgcttcattcttcagagaatcactaactcctagtcttaaaaaaatctcaccccttaacctggaactctaagttggcaacccagacatagagagcccttaaagctgaacccagtgcttccctttcttgccaaactcctttaatcaatcactttctaattaacactagttgaagttttgcgcttattgcttggacttcaccttgaccttcaatactctcggattcctatctcccctggtccatctctgcttatatgaaatcctctactacataaaactacatgtctacttctggcactgaacttctagagggtaaattttttttttttttgagacagggtcttgctctgtcacccaggctgcagtgcagtagcacaatctcagctcactgcaacccctgcctctcaggctcaagtgattctcctgcctcagcctcccaagttgctgggactacaggcgcgcaccaccacacccagctaatttttgtactttttgtagagacagggtttcgccatgttgcccaggctggtctcaaactcctgggctcaagcaatccacctgtctcagcctcccaaagtgctgggactacaggtatgagccaccgcacccagcctagagggtaaatatttgattgcaaaagtttattatatttcttacttctacagtactttggacataacatactcaatatattattatagtaggtaaattcttccttgttccaaaaacagtttaagattctaaataaatatttgattagctgatttcaggtcaggatgtcagagcctttaaaaacctttagatcatgtttcctaattttgtacttacaaattagaagctaaagcatggagacagaaggtggagcatgatataaagagatgtagctttgccatttacttatgcaaccttggacaaatcacataacctctctaaaccacagtttcttcacctacaaaatggagacattatagtggcctcatctcttcaaatttggtctgagaacaaaattatctaatttattgaaagctggtaaataaaaaagcaactatgcatcatagacaggaggaaaaataccctacagatgccaatggcaaacaaagctggcttgcatctggcatctgaaagacatcactcacagataaaaacagatgtaattccatcctcctatagtacagctgcaaccaaactgtgccctttctcacagaggctgacacacagggagttagaaggcacctgagatactgtctcaaccacaccatattttacaaaccagctccatttaatacattatatttccatttcttattttccaagaaacaactttcattaatgtattatttttagcatagctttatggtaatgaagtacaaaagtcatctctattttcaactgaaggaactataagagagaatttgtcctagtcaatccactaataaacttctgcaaagcgcctaccaaagccataccactcaatcaggttctgcctgctcagtgacagagttcacggcaatgtaaggtcctgtattcagattgtctgattcccaaaccagggcttctactactgggttgccctgttttccctaagtacttgttcccataatggaactggactgggaaagaatgatgccaattgtccatgagggtacccaggtggcacagaaagtggaaatccgagaacaagagcaagttgattccaacaatggcactgggtctctgagtctgattggctcctctcaaagagataaaatccggatgggacaaagcagttatctgggttagcagatcaagggacaaaaggagggagaagtcagcaaacatgcaaaagttgaattagaaagttctcatctttgcttcccctcagccaattctcataaacccaaagacaggttacaacaaacagttctacagagcagagaatgtcattcttgcccagagaatcagagcttagttacagatataaaaagaccctttccctgaccaagaaaggctctggtcaaagtgactctaagctgaggatgtaagtgaagcataggggtaaaagtgaagtgagggtgaagttccattctttcagtgctgtactgaggccagctggagtcctcctggtaggacttcatgcccaaggtctaattctctgtagtgctaaatgggtgaggtgagaggcagagccctgccaagggatcatggagggtaaagtaacaatggccttaatctctttcatttacagttagagaattttggttaaatctccatcactggctatgagtctaattttaaaaatttctctgtagttactgttttgttttcaaaatcctttgcattaggtaagatttgaaagatgacaagagaatattttgcttgcaacatcaccaagctaatcttacccagaatttctataagtcaaggggaataaaaatttttacaatgaaccacaaaggctcaagtccatagaacaaaatccagagcagaccagctttgctatttatctatttatttagccagctgctaaagttgaaatactttctttagatttttaaataggtaatatattcatatggttcaaaaaaagtctaaaaatgtatacatagtatgaacgtgtacagtttattgtgtcacttatacatcaataaaggtgtttaaaattgccacgatattgaaacttcagcaaatacatttaaataaaaaaaaactaaatatattcataatccttcttctaccattatcctccatctgcctgggtcccaaccctgccctctaactggtaacaacttttagtagtctcatctaatttattccaaagatttttttaaattaatatagaatgaagcacaaatatacacacttttccttctctttgttcaaatggttacaaagtatagacactgtcttgcatcttgctttttctttcacttacagtacttgaatctcatttttttcaacatttaattagaaaatgaatccatctatatttccatgggccttgcatatatgcatgtctggaaatctaaataaaacatgtagaaattcttttttttttttgagacagagtttcactcttattgcccaggctggagtgcaatggcgcatctcggctcaccgcaacctccacctcccaggttcaagcgattctcctgcctcagcctctccagtagctgggattacaggcatgcgccaccacacccggctaattttgtatttctagtagagatggggtttctccatgtcaggctggtctcgaactcccgacctcaggtaatccacctgccttggcctcccaaagtgctgggattacaggtgtgagccactgcatccggcgaaattcttaaacttaaaagataactccagctgggcatagtagctcatgactgtaatccaagcactttggaaggccaaggcaggaggatcacttgagtccaagagttcaagaccagcctgagcaacacagtgagaccctatctctacaaaaaattaaaaatatatgtatacacacacacacacacacacacacacacacaattttcccccctagaattacatactagagtacctaagaagctgacaagtaactcataatagtgtgctcaaaaggttagcaaattaaatgctgggggtcaccacagctggcctgttttatgacatactagttagagagtaccctctataactactctggcttaaaagaaagttaaaatgtgatggtgaacattcatgaagttatggaaattatcttttaaaggataacctaaagtcagcaaggcagtatttatcaaactgaagactggtaaccttaatcagggctactacacaaaaaactgcaaagtatcccaagttcaaaataaaggttttaaaagactatctaggaataaagataaactgagtcaacatcttagtataacaaaatgactacagatcatggaagaaaatcagcaaatctcctaaagaaataccatttctggtatatttttacctttcagcaaatgatttatgttttatattttataatatttaacacaagttgtataacaactttccccctttaatatacaattttgtctgtttttatatgtaatttatttttatttagattccatttggttacttatggaaatgtatttatgactataacagaaatcactggagttttatttcttgaaattcactctatatccaactctgcacaaatacggtgtatcaatgaagtatgctactgaataagttatgtttaagaactgtaagtctatttttatgttaaagtgaacaggtagggcctgtttcaactaagagaacaacataaagtctgtataaaaccagtatttgccattaattacttaaaaggaaaatgttttgtttcgatttttattacttgtacacttcaaaatttgtgcctagccagagaatcctttttttaagattatttttacgtgattatattaaggatcttcttctgcttcccagatgatttttctcttcaacttcccaaacatgatcctgggttctaggtcagtcatactgacactgactatatcccactcagaaaaaaagtgataatcgctcacacacacaatttttttctttctacccatgggttattttctgctggcagcaatagtttcatctgctactgctactgctgccctaaaacacccactcccaaggcctgcatcaaggcccacagcaggggatggggctccaggaggaagcggggggtcccactcagagaggcacaactccattttaaacattttcttttacaaagagaaattatcagggaaaggaaaaggatcccatagctatggggtgcttaacaggcctgttgagtgaggagagggatttagttttatttggttgggctagagctcaagttcaaattctcagtttatggaaaggatataatcaggtgagaagtttacttttattaaactacaagcctgacttaaattttttccctccaacaaaactgaagaaacaggcaacaagatataccgaaatgcctttcaatagagccctaaacacaggctttcaataacaggaaaaaaaccaatcaaaagggaaaaaaggagactatcatatctgcaagcaaacaagaactccttagactttgactgcctcaatgctacacagattaaagcaactttatctcataagctgtgggttaagataaacttgatagaaattctgagctctggtatttggcaaatatattcaattaaaaaaataaaaacaaacacaaaaaaccaccctcaccaaaatcaagaaagctaagaacttggtgcggcaaaccaccatggcatgtgtatacctatgaaacaaacctgcatgttctgcacatgtaccccagaacttaaaagtataatatatactttataatatgtacttttatttataaaagtataaaacaaagtaaaactacaaacttaatgtgctttttagctgcctattaatgtctgatcatatttccttacccaaaaattgaggacacatattctgacaagtgatggcaataatgagactgcttgaagcaaaactatttagatgatactagacctggagacagcagttatccgcaccgtagaacccagttgcctcgcactgacataccacactgttgaaagccgcccctccaatcagaggttcaggttgtttacatacatctcaaggacccacagataaaggctggaatagcagtcagccttcaaagactacctataatgcctgcgcttttaggcacaggccagcccaggcagaggccaaatctgtgagaagccttcaccaaagtttctgttcagggcaaggagcactcccctcctggtattggctcaatcagagctcttgtctttttcttagtactgcttcctgtttatgatcacctgtttcacccgcttccccttccctgacccacctgagctctcctcctccttccccctcccaaccttcctctttccctctgccacccatgtatgtatcctagacacactcctcctggcccacaggctccttcacctacccctctacacttaatgcttcctccagacacgctgcctgaaaactcaggaccctacctactgggagaggggccggtgtatggaggtggtcttgggagggtagaaatggaaggatccctggatgaagttactgggcaagaggaaatacggccagggattggcttaatctgagaattgaggagaaaatgttttagaagggtattttcagtaaaggtaggctggaggcaggagaagaaagatttagaacaagccaaacagaggtcagatggggattaattcgtgcatcctggttttcttgaacatctgccaaatcactataattcatcaggcctactgtaactaattcagtcaactaacaagtacttatttggcacctaatatgtgccaggcactgtgaaaatgtagcaataaatgaaaaaagtattcattataatttataagttattaatgtactgcctggttataaattaacaaggcaaaaattactgcctttctggagcttctaatttagtgatgggggacacgatcaacaacaaaaacaaaacatttcctatgatagacgccgataagaactagggagaaaaaatagagcaagagcaaagggtgtgcgggggtggctgttaaattgtaaacagagtagtcacagaaggccttaccttgagaacatgagagaggagagtggtaagagactgagctatgtggatacctggaagattgtagctttctggggccaatgaatatactagccaagataatgctgaattgggcaaataccaataaaagatgtggcaggtgttcatgctttgttcagaactatggttatatctattggaaatgatgcatttccaggaaactgaacttttgtttttgttgttttttgagacagggtcttgctctgtcacccaaggctggaatgcagtgctatgatctcagtttactgcaaccttcaactcctgggctcaagtgatcctcccacttcagtctcccaagtaactgggaccacaggcatgtgccaccacacctggctaatttttatttcttgtagagacggggtctcactgtgttgcttagtctggtctcaaactcctgggctcaaacaattctcatacattggcctccaaaagtgctgggattacaggcgtgagccactgtgcccggccaaactttttaaattaatggataaaactgtatgtatttatcatgtacaacacgatattctgaagtagatatacactgtggaatggttaattctactaacaagtgcattaccacacatagccatcattgttgtgatgagaacacttaacatccactccttgaatttttcaggaatactatatatcctcgttaactgtggtcaccatgctgtacaatagatccttgaacgtatttctcctaaataattatttactttcaccaacatctccccaggcttcccctccccattaaacatcccagcctttggtaaccattctactctctacttccatgagatcaactttttcagctcccatatatgagtgaaattacacagtatttgtcttcctgtgtcttgtttatttcacttaacacaatgtcctccaggttcatccatgttgtagaaaatgacaggatttccttattttttaaggctgaatagaatttcattgtgtacatatataccacgttttctttattcattcatattttgatagacgcttaggttgattccttatcttggctattgtaaatagcactgcaataaacatgggtatgcaaacatctcattttctttactcagtaatgggattgctggattatatggtggttctatttttaattttttttgaggaacctccatagtgttttccataatggctataaatagttcatatttccactaacagtgtataagggttttcctttctccacatccttaccaacactgatcttctgtcttttgaaaacagccatactaccaggagtgggatactatcttactgtggttttaatttgcatttctctgatgatgagtgatgctgagcattttttcatagacctgttggccatttgcatgttttctttgaaaaatgtcaggtctttcacccatttttcaaccaagttacttgctttcttgccattgagttgttggagttcctgatgtttttgaggtattaactatttatcagatgtatagtttacaaatattttctcccattctgtaggttgtctcttcactctgttgactgtttcccttgcagtgcagaagctttttagcttgacataatcccatttgtctatttttgcttttgttgtccatgcttttgaggcaggcaattgaacttttagcttcagtgtgaaaaaacatatatataagaaaatttagtacaatttcttccttaaaactacaaagagagaaactgtggttcctatacagtgcatttcttggcaaagaaatgaaaagaaatcctgtaacaagaaagattactattaatgttaatattatacattttttccaaccccacaagtgtgttgtatctactaagagaatcttagttttacaacatggaatgtagtaaaatatcaaagacacattaagcaagatatatgtgtgaaaaaagtctatacaaggaggtagtttaaaggatctttacattaaaaattttttaaatgctttcaaggttctctccttgtcagaaggatcaaatacttaacacaaggcctttacaagttagattactatattgaaggggttgataacactaaaataagtttataatctttatctattaatatatgcaccccctcctttagtccacaccagccccagaacaacaaaattccaatacatgaaagatatagtatactttgttgacaaagaactaattgactaaaggtattaagaccagagtaaacatctgaacaatttggaacacagtctaaggggagaggggttataatttaatttttccaaacaggactggaaggctctaggagcaagcaatggaatgcaacaccgacaccaaacttctcacccacctgcactcaagctcaagctcacaatagtaatattccataatttaatctattttaaatctcttagtactaaaataaataaaattagaatgctgaactacattctcctgaagataatttcaaaatggctcacagaataaattcaaagtgacttatggctgggcatggtgactcatgcctgtaatcccagcactttttcccagaatttttccaatgccaaaagtgtgttgtatctactaagagaatcttagttttacaatatggaacgtagtaaaatatcaaatacatgttaagcaagacatatgcatgaaaaaagtctacacaacaaggaggtagtttcaagaatctcctttaaactacttttgggaggccgaggtgggtggatcacttgaggtcaggagttcaagaccagtctggccaacagggcgaaaccccgtctctactaaaaatacaaaaattcaccagatgtggtggcatgggcctgtaatcccggctactcgggaggctgaggcaggagaatcgcttgaacttgggaggtggacactgcagtgagccgagatcacaccactgcactccaacctggatgacagcgtgagactcatcttaaaacaaggccgggcgcggtggctcacgcctgtaatcccagcactttgggaggccgaggcgggtggatcatgaggtcaggagatcgagaccatcctggctaacaaggtgaaaccccgtctctactaaaaatacagaaaattagccgggcgcggtggcgggcgcctgtggtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaacaaaacaaagtgacttacaagaaagtgctttatctttcagttaaaatacacatgaaaaaatactggaaaaggcctacatgtataagaaagggacagactggcttaagtaacttataaattatgataaatcctgcaacatggtatgcaacatttaaaaacgatggtgtaaaaatatacttattgacagccaaggatggtcatgatatattgagaataaagtcaagtctcagaacagctaggtaaaatagaacctcaaacacccacaggcatacaaacacatacgatggatatgtataaaacatagtaatagttttacttaggtaattaaacgtaattgtcatactcttttccataaccttggaaattatgaaaaatattaatataaggtcatgacatacattcagacccaggaactattaccaggtcctactgtactccttcttctcaggaccattataaaagtttgggtgggcaaaggttaagaagatgagaactgggcacagtggctcatgcctgttatcctagcactttgggaggccaaggcgggcagatcacctgaggtcaagaattcgagaactacttggccaacatggtgaaaccccatctctactaaaaatacaaaacttagctgggcgtggtggtgcatgcctgtaatcccagctattcgggaggctgaggcagcagaatcgcttgaacctgggaggcggaggttgcagtgagccgggatcgctccattgcactccagcctgggggacgagagcgaaactctgtctcaaaaaaaaaaaaaaacaaagaagatgaacaaatgtaatgtatggaaattaatgtttaccctcaaggtaaaagctgaaatggatttataaagaattattttaaacagcaataatgtttgaggggtgggggaagtgagaaaaatgaaattttaaatcacatgtttatgactatgaagctagactttaaaaataggtcagttagggtatgactcttataatacaaaagtttatttggtatacaaaggatttatagctaatgtattttttaattatattcactaatacttgtaaaagatcattcaatttataaagtttccaaaataaacctgtttaaagtgtcacaaatgcaacgcaagatgactttcattgctctcacttggaaaagtgcaaattcctctaacaaagtatatgcaatggcttcgtcactattctcagctcctaagcagacatgcacaacaaggtttgaacacattccaggcgtggccttcaagcccggaccacacctgcttccaaggccctgcggctaaaaataactctggggcctcaaaaatgggacaccagccaggcccaggggtagctgcaggccccttgctcagcttcaacagcaaaagcaggagctacaaaaactctaaaatcacagaacactccaccacaggcttccttctctcagtctctttgtgccagtcacctacaacctaggcctgctcagtttctttgctccatgagggcaaaactaaccctaggaatttagagacaagtgaggttattgtttttaaaagatactgtggactaggactcaggagaccttgttcctaatttcaactcatctactaaaatgctaaaatggcgtatacagtgtcacttgacattccccaagcctgtgtttttcctacttgtataatgaggaattcagtgatcactaatatctaaagattatttcacttagaacaaaaagatattgctgtaagtgtgcctcagttctcagcaaagtctcctaacagggacagggctgacttatcattaagcagtcatattatggtgtgagagtttataccctacaacacacaaactaaaacgggtaactctggggtaactgttccaggtaattcctttgtgacaggggattttcaaggcttgctctgagcaactatttccacttctcttccaatcccacagtatgcaggagacccctttggggattttgttactctaccaggtaaggaaaaaagaaagggcggccaggtagcagagaaagatgcagcaacagcatcgctgttcattcactgcaggatcctagtctgtgctaatttaagtcattgcatctgtccgcacacttccccctgctggggccctggaagttaatgatatcaggaagctgtatcaggagcaaagtaccacaaagtgacaggccaagacctaggctgaagaatcacagcaccacaggaaagcaaggacactaaaggctagcggagtagccccagacgggagtcggaacattctctgtcctcatcccttggttattttttccactttgtcctttccactgtctttttctataattcggctccatcacatcatctaactgtagtttctggacccttcttttgtccttagaggctttgctgtttcttcatcctcatattcatcttaatttctctcttcatgagtataaccaagcctcttcctgtctgatgttaagctcttatcatacattcattttctattttttgaggaggaactgccaagtcccttgatgtactgctattataacaagtaatattttccagactggtttgagacagtcacccgtgaattcaggtattttatcatctatcagcctttaaaatctttgatttgttactctaaaaaaaagttttattttggaggagaaaggtaaaatttttccagtttggtgtttcacacatggttggttatactaagtaaagatcatcaattcaatattttacatttatattagcccttaaatacctcatgttccagatactaagtcagacttccacctaagcctcacaggaagacacaaattctcaggattttcacactagattatttagaaaacaaacaagatctgaattattttataatctagtgctcagattctaaaagcagaaataacctctgcacatgcagaaaaagctggcttcatcaagagtctgcctggcacattaggacggacacctgtgccagtgctcagccgctcagccctgcccatcctcctccaccagcctcggtgagctgttagttctccttacctcagctcccagtaacgctgttgtctgattctttagaagggtttcccaaacaatcttaatagcaaaacaaatagtaatgggctatatcccatagaagaagataaatatcaatgagtctaaggggaaaaaaatttttttttacaaaacatctgcttctacaaatcaaagtttgagagaatggtgtttctatttgctattcttttttattttttcttttttaagaggttattctgtcatttttacacagtactatacttggccctctataattctgggtgtaatgtcagttgggttcaggcacattacctgcagcagcaacaaacaccttcctatcaaagtctcaatttcccactctaaaataccaatatgtcagtgttgaagttaaattaggtttctaacccaatgcagggaaaaagagaattgatggcaagtccttgatattaattagttgagtaaatgttgaaaatgacattttgaacaaatatgaaaagataacatgccggtcagatgtccagcaagccaaagagaaaggcttcctgaaaaatgtaaatttcaaagagagttttgaaagaaaatagggacatgaaccagcagagagaagagaggaagatgattccagatgcagaaaacgcatgagcaaagacagagggataacaaactgtatgcaggctttcctggctacagattatgtcaacaagtaacaaaataagttggtagagtaaaaggggctagatggtaaagaatcctgaagtctaaagccatctaggccactgtacgctttatgaaaataacataagaacactactaagagaatttcactctggtaactctattcagaatggactgaggtgagaatagatttaaggagactgactgactagtctccttacagtaccatacagttttagttgcctatggatgcgctcagtctagaatggtaactataaaacctgagagccaagagactgttaatagtctaaatccaaggcaatgtgcctggcacaagatatacccttattatatgtcatgggcactgaaagtacccatgaaaatggctatctagactacatgattgaattattgcaccagaataatatctgaaaatatctcaatgtcttattctgtcccagcttcacataagctaatgtaaagcaaaatgagcactatgtacaggctcaagttttactaattaggtcattgtttataaaccagaataattagacataataaaaggctgaaataggccgggcacagtggctcatgcatgtaatcccagcactttgggaggccgaggctgatggatcacctgaagttaggagttcaagaccagcctggccaacatggtgagaccctgtctctactaaaaatacaaaaattagccggacatggtggcacatgcctgtaatcttagctactcaggaagctgaggcaagagaattacttaaacctgggaggcagaggtcgcagtgagccaagatcgctgccattgcaatccagcctgggcaacaagaacgaaactccatctcaaaaaaaaaacgccgatgcggtggctcacacctgtaatcccaacactttgggaggccgaggtgggcggatcgcctgaggtcgggagttcgagaccagcctgacaaacatggagaaacccccatctctactaaaaacacaaaaattagccaggcatggtggcgcattcctgtaagcccagctactcgggaggctgaggcaggagaattgcttgaacccaggaagtggaggttgcggtgggccaagatcacgccactgcactctatctagcctgggcaacaagagcaaaactccatctcaaaaaaacaggctgaaataaaaggctgaaaaataggtagactctgaaggttgacatttcttcaaggatgactttcttcaatatatttttctgtaatttctaagtttcctattttatagataactttcataacagaaaactatatatatttttaataagacgtaactcatgtcatgtcatgaaaaaaagatgtggaagtcaaagtgaaacctaaatgaattttaatacactatcatgacattcatccaacagtgactatagtgtgagcaaatttttaaaaagtttttaaatgtaattacatagccctatgacagcaatgctacaaggtaaaagacattcatatgtattctacacaaagcaatataactatatatgattcagtaccaggcaatgttcctttgccaaatgtaaccttcagtatcaaagaacacatattcaaaattaaaattataagcaaaatcattacaaatacagtaagcttgctattgatgaaacttaatataaaccagaccatagaactgtctattaagaaactcaatggctaaatgccaaaatatctaatttcaccatctcatctaaaacatagtccacggcatagaccctaaaaatatgctcacaaagctccacagtctaattctctactggacagattatgaaatacattcaaaagaaacctatcaccatttgctatcaacatatttaagtgtcacataagcatcactaagtatcagagactgaaagcccctctaagtagaacacgataataaatgttcagttttttctcttgcaaatagtgttcattcttctaattctggggtgtggatcttagctaatctataaaactccaggaaaaaaattaaatgagttagtagaatatatatatatatgttcatttatcgagcaccaactagattcaatttcctatagcacaatttcccacttttgcctgatcacaagaatcacttagaaacttgataaaaatgcccaaccaggcccacctctggagattgattcgtgggtctagagtggaacctgtgaatttgcatatttaacaaatgtcccaggaggttcagagaatcaggcaggtttgaaaacatgcatccccgtgcgccaccacgcctggctaaagacatctatcctaaagacatctttggtctttctctcaatgttcacatttaatcagttgtcaagacctactgattttcagtctctcttacctggaggacatagaggcataaaagctggatttgagttgaaaataatggtaagaggagaaatgggaagtcagtcatgtcacgtcattaaagaaagtcagagactactgaaatttcatagccaaagaaggacttccacttagtctagtgcatgtcttctggcaagttaataatgtcccttttacaaaatgttacatatttattcaaagtcacactattcatcagtggtaaaagacagaaaatagcttctagggagtgtgctttccacaaccctagagagcttaccaaacattctgcaaattttaataggctcctgaaaaacacagaacgcaaaatatttcaaaagatgagaaataatgcacccttttaaacacttaatgggtgtggctgtggagagttgccctcaccaaaatgccagcctgccatgaagttacagatgaaatgccaggcatgaaatagagaaccaaatggtgaggcaacagcctcggcaggactctagtgaagggggaggaaccctcgaagcaaatgcttgtcaacttcctgggtcaccatgaaaatacagtaagacagttaaagtatgtaataaaatataaagcatgtaataaatgctcaggtaatcctcccacctattgtaaattctaacatttgctaaaaagggaacaactcagtacatgattaaatggaggagcattttggctaacagagtagctctgaaccttagttacacattaaaatcatctgggagctcttaaatatccagatgtacctcagaatgataaatcagaatctctgaggaatgggcccaggcatcagtatttttcacacgaacaagcagaggtggatcctttaccttctcctaaaaaactgtcacaagggacaggtcacttggaaggcagtttaagagagagcagaggagaaatctggtgacacatgtaacactgtgattaatctattgcttacgatgttttatatgttgaaagtctggaattctgaatattttattatgtaagagatccagttctccaatgtcacagcctctataatttgaataataataaaggagcacaacaattcacttatgatacccaacagaagactgcaaggatatgctggggcacagagcccaattagggtttaataagacagggtttatgggtgaagcaatctagtttccaatctttcttcttaaaaatctacaaatgtttaggtgtagatgtgtcaaggaaagattgttaaagcttgggagagatagagttcagtgttcaccggcttatgaatgcacgttaaataaatatctccacccaggaatttcccattactaacggctaatcaccatcacaagggcatacagccctttagaattcctctctaatccaatcctgtaaaacttcacttaggatgatgatggaaaccaagattcgggcctccagccaatctatattacattaaataaaggacgtcaccacccttctcaaggttgggccagcagttatttaaaaaaaaaaaaaaaaaggctgggcacagtggttcacacctgcaatcccagcactttgggaggccgaggcaggtggaccatttgaggtcaggagttcaagaccagcctgaccaacatggtgaaaccccgtctctactaaaaaatacgaaaaaattagccgggcgtggtagcatagtcccagctactcgggaggctggggaggctgaagcaggagaatcacttgaacttgggatgtggaggttgcagtgagccaagatcgcaccactgcaccctggcctgggcgacagactgagactctgtctcataaaaagaaaaaagaaaatgagaccaggagtttgagactagcctaggcaacatactgagaccccgactctactttaaaaaaaaaaaaaactaaaaaaaaacatcagccaggtgtgctgacaggggcccgtagtcccagctactagtgaggctaagcctgggagatggaggttgctgcaaggctactggggagcttgagcccgggagatagaggttgcagtgagctatgattgccactgcactccagcctgggccacagagtgagaccctgtcttaaaatatataaaaatataaattaaaaaaatttttaaagatggtatttaaccagagtcaggagttttcgtaacatattaacatccaatacaaggaacactaggttagaaaatgctcattcagctatttcccttgtacagtgggtctaacttgtgcttccttcacttacacaacagtttttgaacatctatactgtgcaaggctttttgctcaaggaatctttggaggatacaattttaaagcaatttcataagatatctataaggctccgtgagatcacatagcaagagtgggagagaaaaatttcaagtggtgacatctagaagtcaacaggaggaggtgaggaggtggtcaatcccacctatgtatttattctggacgctctcctaccccaactccttagggtgctacacaatctctttgtattcacaaataacccctggtcaagaggtttggagggagcggcgacaccaccagccagcaaacttctactaattctggaggcaacttcctgtcagctggtccctaaaggctggttgcttcctgccaggaggccacttagcacagattcatctttcttcaggaggcagacagttgcttttttttcttttcttttcttttcttttttttttttttttttttttttgagccaggagtctcactctgattgcccaggctggagtgcagtggtgctgatcatggctcactgcagcctcaacctcccaggctcaggtgatccccccagctcagcctcccgagtaactgggactacatgtgcacaccatcacgcctggctaatttctctatttttagtagagctggagtttcaccatgttgcccagactggtctcaaactcctggactcaagcaattgactcacctcagtctcccaaagtcctgggattatgggcgtgagccaccgcacctggccacttgctgattctcactgtggcactgattttagagggaaaggcagaggggaagacaattcatcttcccttcaaccccaggtacacacagtcccctgccccacacaaatacaaacatgaagaataaaagaggtacaggccttgacaaggttacactgacattatttccacccaacagtatctcccacaaagcgttaaggagggaaaataagaaactcttattaaaattagtctatcttattggaaggcccagtaaggtaggtaaatggcataaattctcaggagttggtcaatctatgatagttgtagttggaatgagctgtctgtctagacccatggtcttcaagcttttcagctgacagcccacttcagagtgacaaactaccaggtctatgtcttcctaacaactatttctctgtctacatgtgttccaccacaaaccctagagagaaataactgtgaaaaaaattctgtaaagtgagatataacatccagattaaaatgtaaatacaagagcactgaaaatgtatgcacatgtaacaaacctgcacatataccccaaatctaaaataatttaagaaaggaaatggacccacaaaaacttgtataaaaatgttcacagcagatttataaacagccaaaaaaattaatcaactgatgaatagataaacaaaatgcagtatatccctactatggaatattatttagccatgaaaaggaattaatactgataccagctacaatatgggagaaccccaaaaacgttatgctaagggaaagaaactagataccaaagaccacatattatatgaatccatttatatgaaatacccagaaaggctgggtgccgtggctcacacctgtaatcccagcactttcagaggccgaggtgggcggatcacctcaggttgggagttaggtactagcctgaccatggagaaatcccgtctctactacaaatacaaaattacccgggcgtggtggcacatgcctgtaatcccagctactcaggaggctgaggcaggagaatcccttgaacctgggaggtggaggttgtggtgagccgagatcacgccattgcactccagcctgggcaacaagagcgaaacttcatctcaaaaaaagaaaagagaaaaaaaaaaaaaaaaaaaaagaaatacccagaaagggcaaatgcatagggacaggaagtaaatcagcagttgccaggggctgggaggagtgggaaatggtgtatgacctaatgtgcagagtttgttttgggggtgatgaaaatgtcctagaattagatagtagtgattactacacaactgtgaatataccaaaaaccactgcattgcacaccttcaaagacgaattttacgactgaaattatatctcaactttttttaaatggtaaatttggtggtatattaattgtatctcaataaactgtcatttttaaaaagggcaggcaggccaaggcatgactccagatgtaaagaaactaaagacacaagtaaatgtagaacacgatcctcaattggaccctgtatgcaagaccaaatatttgtgtccccactaaattcttaaattaaaaccctaagtccattgtgatagtatctgaaactggggcctttagagggtaattaggtcatgaggtggagccctcatgaatgggattcatgctatataaaaaggacccccagagagctctctttcttgggtatacgatgagaaattggtactctgcaacccagaagagggccctcaccagaaccagatcatgctggcactctgatctcagacttttagccttcagaactataagaagtcaatttgttatttataagctacccagtctaaggttgttatagcaacccaagcaaactaagactgtactagacagtacaatgctatgaagaatgtcgttgtgtcaacttacaggactgaaatacacgtgtgggctagttagaagtattaaatcaatgtcaggtttactggggttgacaactgtactgtgggtaggaaactgtccttgttcttcggagacctgctgatgtgcttgaggatagtgggccatgtgtacaacttatggttcagaaaaatgtatcatatataaatatgaagagagagcaagtaataaagcaaagggggcaaactggtaatagtagatgctgttcttttatttttttctgtaaatttaaaattattttcaaacaaaaagataaaaaagtaaatagaatacacataatctgagatctagaaattctacttccaataatttgtcttatataaatacctgcccaagtatattatgtgaaatacttttccctgtaacatgtttataactgtaaaaagaaacaacttcaaagttaatgagtgataaattggctaaatatattattatatcaatgtagtataccatatggacatgtaaaaagaaagatgtctatctgatatagaatgacttccagaaatatattcttttgtgaagagaaaaaaagaattggtttatccctagaaacaaaaccaataaaaaactcaagaagcctaggaatgtttggatttggttaagaaagaagctaagcctgttctatttatttatgaggccagttatttgtatttgtaatacaaataattttctcccttacagcattgataatacaagctttactaatgaaaaaggaaactaatacaatcttgtatgccacttactcctgtggttaactcaaagcatttaaaaataaatttcgtaaaaactcaagtataacatatatgccaataagcatacacaaatcatgaatgtacagctcaaagaatttttataaggttaacacactcatgtaatcaccatcctgatcaagaaatagaaacccacctgtactccagaagttggcttcatatgtcttcctactactaatctctctccccaaaggtaaccacgaacctgacttcttataccatggctgagttttgcctgtttttgagctcttttgtgtctgaactgttttgtacaaaattatgttcatatctatgttgttgtaagtagcaagagttttttcatgttcacttctacctagtatctcattgaatatacaacaatgtatttatctattcttccactgatggacatgtgggttgtttccagcttggagttattatgaattgtgctgctatgaacattcttgtacatgtcttttggtgagcataagtacacatttctgttgggtatacacctaggagtgggtttgctaggttaaacgcataagtatgtaacactttagtataatagatacaaccagttttccacagttattccaatttacaattccagaatccatacatgagggttctagttgctctacacccatgctgatactggtattttcaagtttttgtttgtttctcaattttagctactctgatcagtgtgtagtggtaattcactgtggtttcattcagcattttttgatgacgaatatggctgaacactgctagaagctttagttttttttaacctttcgcattgagatctacaattagcctataatttatttttgtaagtgatggcaagcaaggaccaaaattagttttctttttcttttcatacagataggcaattgacgtaggatcatttatcgaaagatctttctttccacattgctgtaaagtgccattttaatcataaattagtatctacatatatgggtctgattcagggctctattctgttccattatccattcatttattccacactgtatattcaatagtgtgaatcctacaactttgttcttccttaatattaccttgactattcttgccatttgcactgccatatgaattttagaatcaacttatataaacttctgtaaaagtttcaggtatctttcttagatttattaccagcatttgatattttttgatgctattataaacagcatctaaacatttcattttctgattactgttatatagaaatataggttttgtataataacctcacatccagtaatcttactaaatttatgtttactttgagatggattctcgctctgtcacccaggctggagtgcagtggcatgatctcagctcactgaaaacctctgcctcccaggttcaagcgattctcagcttgatgcctcagcctcctgagtagctggggctacaggtgtgcaccaccaagcccagctaatttgtgtacttttttttttttttttttccgtaaagacaaggtttcaccatgtttaccaggctagtctcaaactcctgacctcaggtgatccgcccgcctcagcctcccaaagtgctgggattacaggcatgagccaacacgcctggccactacatttatttttaaagcattattttttaacttacataaagtaaaattaatgctttttggtgtacagttctatgagttttgaccaaatgtacactgtaatgtaaccatcaccacaatcaagatgcagaacgtttccatcgctccaaaaaattcaaaaacaaatcctggtcaaatcttaagttaccctaataacagataagagagtacatggataaataaagtctaacgatatcctataaactacaatctagccaaaactatatgacagcttcagtctcatttcctggcaaatctttccccaccaaattcaaagccggtaagagaaatggtaaccaaatcacagttctagagccataatgtaccaatctaatatttaatatgtggattctgaatatctgaatggaaaagaacttgttataaatgatattgatgtaataacagtaacatcatgtacttttagaaacccaaatgaaattacactataaaaataagttatatttcccatgcaaaataaatggataatgaaaacatctgagagttatttatacaatattataaatttatgaaatgctatcatttgggggggaaattctgcaccctctggataatgattatgttaatgaattctggtctactaatgatcacccatggtttagttttatcttttttactttacctgtgtttcgtggttgtgttttttcacaattaaatgtccagcctatgctcagagggatggatggtgataagtagccccaaagggcctagataatattttgcaatgaaactgtcagtgctaccaaatatatttcaatccttgagttactgtataaccaaagttaagaatgaatgaacaagggtggctctgaccattatggcaactttccacaatgtagttctttgaagctgcctcagtccttccattacctccgctatttacacacccaggtgtttttagtattttgtaagaagggactggtaatggtcaatcaagacctggcaataggccagaaagcaatatagatgtcacagatggtcaagcacaaagacaacactagatagacatgctgtgttctagtgtaagcactaccaacatctcatgcattctgagtcaccctacatattgcttacccattcctatttggtttactggattttgcttgtttactttattcctcctatagtattgtcagcatgagaacattttaagtcatggcaccatatggcaataatatataactccataactaaaataagctccctaaagactggctatctgtcagatactatctataagacacaaaaaattaaaaacatcaagtgcttgaaacctaaaaataattttatcttagcagtacccttaagcctcaaccacaatcacattatttcttacctttaattaacatcatgatatcattgtccatatgagagccatggacaacaaataaatcagtttagaaatacttctttatacctggcatgaaaatatagctgttcttaacagaaataaaaattcactgaatttggactggtgttttgtttgctctatgtatttaaaacaataacaggccagtgcagtggctcatgcctgtaatcccagcaccttaggaggccgaggcaggtggatcacctgaggtcaggagtttgagaccagcctggccaacatggcaaaaccccgtctctaccaaaaatacaaaaattagccgggcgtggtggtgcccacctgtaatcccagctacttgggaggctgaggcaggagaatcgcttgaacccgggtggaggttgcagtgagccgagatagcgccactgcactctagcctgggcgacagagcgagacttggtctcaaaacaaacaaaacaaacaaacaaaaaaaagcaaaaaaaaaaaaaagaaaatacattgtccaatgaacttttcaccttctacttccttatgactgtgagtaggcttaaaaaaaaaaaaaaaaaaaaaaaaaagcaaaacatactactgtgtatctccagggtaagtacaagctctactactccaggccatatccaccataggacttgtgtacagcagcattaaaaaaacaaatatttaagcccaggattctgaggtgataccatgctataagcaggaaaataagtaagatcaaaagttagaaaatcaaagatccaacaaagctttggtggagtgctaccttctagctattggctggcaacaaagatttctcagtgtagaagttagataatactgagattccaaggaaatcttagacacaagaggttagctggtaaaaggcaatgcttgcaaaatttacaattttagagctggaaaaaccttagatatcacctagtccatccctctggtttacatataatgaggagagggaagaagaagagaatcaacccgagccctccaaatcctctttggagtatgaaaccctgactaagcagtaccagtaatagcagaagaagcagagatgacagttactgtactccactcactccatttttgtatccctgaactatatcacatctaatctgtgagttctaagtagctgattcacattaaagaaaaaggcatcctacaactcaacaacaaaaaactcaaataatccaatttttaaatgggcaaaggactggaataaacatttctcccaagatgatatataaatggccaactatttgaaaagatgctgaacatcaccaatcaccagagaaatgtgaatcaaaaccacaatgaggtatcacgtcacacccattaggacagctaaaaacaacaagtgttggctgggcacagtggctcatgcctgtaatcccagcactttgggaggccgaggcaggcggcctgaggtcaggagtttgagacaagcctggccaacacggtgaaaccccatctctactaaatatacaaaaattagctgggcctggtggcacgtgcctgtaatcccagctactcgggaagctgaggaaagagaatcacttgaacccaggaggcagaggttgcagtgagccgagatcgcaccactgcactccaacctggtgacagagtgagactctgtctcaaaaaaaaaaaaaaaaagaaaaagaaaaagaaaaagaaaaaaaagaaatattttgcaatagatctcttcctttttcttgctgtgttcctcccaacctttaataatctaaaggtgtcaagaactgctccaggatactatcttccttctcccaaaccatcctacagaagcggccagctaacatactgctcttagagtaagcagggcaggtctgcaatcgtggagaaaaggggaaatcatcaggaggggatttcaagtgggttgtcctccacttctaatcatgatcatgactttatccctcagcctatgaaaagcagagactagggtgacagaccccaagctgaaaaacccctagggcaaaaaaatgagaacactgtactgagtgtactttaattacagacaatacacacatatgtatatctttctctattaaaataaaaatacaattagtctttcattttcaatgaaatatgagtaactgcccaaaacccaaaacctaattttagctttagcctctttaccatcgacatcattattagggatacaacccagtcatcaagatgactgaaaaagtggcactgctgctttcccctgtgtaactgaatacacaattcctactaacagaaatggaatactggtaagttgctaaaaggcagactatctagtatagttattttaaccgtgttttgatggaaatccttcaattatatgtgcatctccatgactcctgttgcacccacccccgcacttccctagtcccattcttccaggcccagcacatgggggagcccagctgatcctggagtcttcctccgtgccctccatgcttagctccactctctgtccacagcctcattttgcctatagctatttccataatcactaatgcctactccattcactcttaccattcttctttcatttatcttctgccatcccttagctctcccaaaagaaaaaaataacagtctccccacctggatgaaacaaatgactgccaagagcagtccgttctcctctcacatatgttaccatctctcccattctgtcattcaagaaaaaaaataactcagtaccctggattttgaatacaataagtaagtatgaacagatatgtgtgtatatatgtggccacagtgcttttttattaaaaaaaaaaaatagggagagcaaattttcacttttttatgttataaagtgctctcactgactcttcccttctgtctaccctttatccaacacgctctgatgttatatgaccttccacccataatagtatctggccacatggctcatcctacacactaacatagtcccttctccctgacaaattcatcaactaagatggacatgttactttattgatttagatgcgtgtatcagaccaggcgcagtggcactctgggaggctgaggcaggtggatcacctgaggttaggagttgaagaccagcctggccaacatggtgaaaccctgtctctactaaaaatataaaaattagctaggcatgatggagggtgcctgtaatcccagctgcttgggaggctgaggtgggagaatcgcttgaacccgggaggcggaggctgcagtgagccaagacggcgccattgccctccagcctgggtgacagagtgagactccgtctcaaaaaaaaaaaaaaaaatgtgtatcagactgctctaaaaagatgtcagcacatggtactagtttacaccagcagttttcaaagtgtgatccagagatgaggaaggaaccccttcaagggatctataaaactatttttgataatatgaagatgttatctgtctttttcactttcattccctcatgagtgtacaacagtgggtcgaggatgcacggtatgtggtgatgatgtatctatcactctgacagctaagaaaacatatacttgtatattctttactgcctatcattttttaaaaacccagtttcacccatcattctcagcaaagtaacacaggaacagaaaaccaaatagcacatgttctcactcataagtgagagttgaacaatgagaacacatggacactgggaggggaacatcacacgctggggtctgttgggagggaaacatcacacgctggggtctgttggggattgggaggatagaggagggatagcattaggagaaatacctaatgtagatgacgggctgatgggtgcagcaaaccaccatggcatgtgtatacctgtgtaacaaacctgcacgtgctgcacatgtaccccaaaacttaaagtataattaaaaaaaaaagccagtctcacttaacaacatccttgataaaataataaaaggtattaatttttaaaacgtcaactcttgagaacttggcctttttcatattctgtatgatgaaataggaagcacacataaagcatttctgctgcatacctaagtataatgattatcttggggaaaagcatttatacaatttttttttttcataggacaccatttttgcttttttgactagcagacaatttacacttattcagactttggtatctggcagacattttctctaaaatgaataaagtgaacctgtcactttaagaaaaaccggcaatattgggctgctggccgtggctcacacctgtaaccccagcacctcgggaagcctaggcaggcagatcacttgaggccaggagttcaagaccagcctaaccaacatggcgaaacccccatctctactaaaaatacaaaaaaaatcagccaggcgtggtggtgcgtgtaatctgagctaggcagaggttgcagtgagccaagatcacaccactgtactctagcctgggcgacagagggagactgtattaaaaaaaaaaaaaaaaaaatgggcactatctgttgccaatgatataaattaagctttcaagagaaaactggtattttggaaaacttgaattcgccaccaagatcttgaccacttcccaattcttaaagattttttggatgagactgatggtgatattaatgactgtgatttgcttaatattgtataatcaaatgtgccaacatttcaaagatgtgcagaacttagtaaacctttttttttttttttttccgagatggaatatcgctctgttacccatgctggagtgcagtggcacgatctcagctcactgaaacctccacctcccaggttcaagcaattctcctgtctcagcctcccgagtagctaggactacaggcgtgcactgccatgcctggctaatttttgttatttttagtagagacggggtttcaccatgttggccaggctggtcttgatctcctgacctcgtgatccacctgcctcggcctcccaaagtgctgggattacaggcgtaagccactgtgcccagtcagcttagtaaaccattattttttgaatgatcaatgtatgcagttacaaaatcacacacaggtcaaagatccattcaaagtgcaagatggaccagtggattttaatgttacagagtacacaaaattcactgacatggcttcagattcagcagtgcaactaatatttaagaatctggctgggagcggtggctgcgcctgtaatcccagaaatttgggaggccgaggcaagcggatcacttggggtcgggagtttgagaccagcctggtcaatatgctgaaaccccatctctactaaaaatataaaaattagctgggcatggtggtgcgtgcctgtaatcccagttacttgagaggctgaggcaggagaatcacttgaacccgggaggcagaggttgcagtgagctgagatcacaccactgcactccagcctgggcgacagagcgagactatctcaaaaaaataaataaataaataaaaagcatttaccaattgttgaattttggtgtaacaaaaatattcacaattatatgaaaagactatgaaaataccccacccttcttcaactatgtatccgtgtgcagccaggttttcttcacgtatttcaaccaaaacaacatatcacaacagattgaatacaggagcaattatgcaaacccagctatcttctataaagaaatatactaaagagaatggcaaaacgtaaaacaatgccatgtttctcaccagatttttttgtgtgtgttggaatacctttttcataaaagcatattatttatatcaaccctctttgttttttcttcttttttttgagacacagtctcgctctgtcgcccaggctggagtgcaatggcaggatctcggctcactgcaacctctgcctcccgggttcaagcgattctcgtgcctcagcctcccaagtagctgggattacaggcgcccaccaccacacctggctaatttttgtatttttagtagagacggggttttaccatgttggtcaagctggtctcgaactcctgacttcatgagatccactgacctcagcctcccaaagtgttgggattacaggcatgagccaccatgcctggcctaatgtttgttattttttaaataaataaatattttaaacatttttcagttttaatttctaatgttaagtatggacagacatagtctatataaacaaaagatttttggggtcctcagaaatttttaagagtataaatgtgtcctgagaccaaaatgtttgaaaaccattagtttatagtaccacaaaaaaatagcacttttaagtatatgtatacaagagaatggacacctgaatatgaatcagaagatcttggctccaattctagcaccacttcttacttgctttaggatttcaataaattacttcatctctctaaggccttagtttcctcatctgtaaaatgggtaactcatgtcttccaaggataaaagagacaaaatatgtaaaagcaatttataaactacaaggtacactattattacaagatctcaaagttaagcattttaaacacttcttatgatgttttgtttctttgtttttgaaacagggtctcactctgttgcccaggctggagtgcactggcactaacatggcttactgcagccttgacctgccaggctcaggtgatcctcctacctgagccccacgagtggctgggactacaggtgtgcaccatcacacccagccaattttttgtattttttgtggcgacaaggtttcaccatgttgcccaggctggtctactcctgacctcaagtgatccgcccacctccccaagtgctgggattacaggcatgagccaccatgcctggcctcttacgatgtgtctatgaaattttccttattcttaaaattttattactaaaaacagaacttatagaaaatgtcaagtgcaggccaggagcagtggattacacctataatcctagcactttgagaggccaagacaagcagatcacttgaagtcaggagtttgagaccagcctggccaccctggtgaaaccacatctctactaaaaatacaaaaattagctggtgtggtggtgcacgcctgtaatcccagctacttgggaggctgaggcaggagaattgcttgaacccaggaggcagagattgcagtgagctgagactgcgccactgcactccaacctgggtgacagagtgaaactgggtctcaaaaaaaaaaaaaaaaaaaaaaagccaagtgcagacttttgattagctaattagctcaaatgtccaagcatataattttactttattttattttgcagagacagagtctcaccatgctacctaagctggtctcaaactcctgacctcaagcgatcctcccacctcagcctcccaaagtactggatcataagaatgaaccctcatacccaacccaacaacacaattttattgcatttaatttcttaccctacagttataattggttatatattttaaatcattattagggacatttccaaatatacacaaatgtaaaaaaaataacaaactccaacttacccattactcagcttcaacaattttcaaaaatttatcaatactcttttattcatttcccacttctgtgtgtttgtgcccatcctgaagttttttaaaatgaacatttcgcatcattttattctgcctgtaagtacatccatatgtatttttaacacatgaaaatattttaacataaccacaatatgactattatagctgaaaacattatggttgtaactattaaatatcacctaatatatattccattttcaagtttcccaactgtctcaattaaaaaaaaaaagtctttgttagtttttggttggtgggtattatcaaaatatcattcttaccaattctttctcaagtcaacccaagatgtttaactaaagctacgaaggaagaggaaataatactatgcttcatataccatgtacagtttacaaaacaagtcaagaactatcttctcgaggaattttcttttccaccaaccaaacaataacaacaaaaaccaagcaacaacaacaaataaacccactacaaaataagccagcatggcaatacatataccttagtattctgagaagtgatccaaagagcacacagctcagctgctcgggaagagaaggagctgttacactgtgagccgaaaaaggtgactggaaacaaccacccatcattttggaaaagaagaagtcaggtcagccacagggtcaaagctggaggtgaggtcagagaccccgttctagagtgagcacatggctcaaataagagtccatgcccaagactataagtcaaccccttgcaaactgcaactcaaagctcaaaacacagtgctctaagctagagatataatggaacggctataaaaagcaacaggtgtaagaactgactgaaattatttgacaaacatttgtcaaaagcctactctactatcctgggatataaactgtgtatttaaaaactagtacaacgcacactgtaagtagcatatacttctctacacatctttccccatttattttaagagaaataatggatatattaaatattaattatcttgccataccattacatcttttttctataaacgcaatttgccccaccccaacatacatagacattaaaacaaacctgaattcttctgtctttcccaaatatttttgaggagtacaagtcagattaacttttattacacataccacagacccacagcatttatagctgtaattcttttctaaattaaggccaagcatggtggctcacacctgtaatcccaatgctttgggacgccgaggtgggaggattgattgagcccaggagttcaagactagctgggcaacatagcaagaccctgtctctacacaaaataaaaaattagctaggtatagttgcacatgcctatagtcctagctatttgggaggctgaggtgggagaatcccttgaaccgaggaagtcaaggatgtagtgagctgtgatgacaccactgcactccagcttgggcgacagagtaagaccatgtctcaaaaaaataaaaattaaataaattaagcatttagtttaggaggaaatcaagagagcactaaagaatttcctaccttgtattaaaattgtttcccataggtttatctcaagtattttgtagatgaaaattggttaggtgcatacagaataattcttgagggatttggttctatagacacacttaatatcaacactttttaaaatcctttacctcaatttcacctataaaaaagttttgctggtcacagtggcttgtgcctgtaatcctagcactttgggagactaaggcaggaagactgcttgaagccaggagtttaagaccagcctgggcaacaaagtgagacccccatctctataaaaataataaaaataaataataataattagccgggtgtggtggcatgcaccacctgtggtctcagctacttgggaggctgaggcaggaggactgcttgagcccaggagtttgagactacagtgagctatgattgctctattgcacttcagcctgtgtgacagagacagaccccatctttaattaaaaaaaaaaaaattaaaaactgcaaaaagagtgaagggcacatatttcttaaagaatgcttcagaagaacaaaatgtgccccaaaacatgaaatagctcctgataatatcagtttttagttgaccactatgaaggacatcttctaaacaataacaaaacaaacctggcagtccaataactacaggaaagatcaagacttccccattttggaacatctttgcttcaggtttttactttttgtagtaatacaggaacaatatgccatagggacaagagttgaacaggtgtcatcccttaccctattttacctattggtaattaagcctaacagtttattgtctgtacatcttttcttttgtatgttcccatacaaaacaatctttggaatttagcttcactttatgacactatggtgattattgttcctaacagagagtctaacctaagaatatagcccaatacgtgaaaaagctaactgaacagtaaacaatgacattaatctcattgtaaaaaaacatgagattcttagcaaatggcagcaaaagaactgtggatacattaacaaggcattaaaaaaaaaatttaaagtttctggccgggtgtggtggctcacacctgtaatcccagcactttgggaggccaaggcgggtggaacacgaggtcaggagatcgagaccatcctggccaacgtggtgaaaccccgtctctactaaaatacaaaaaaaaattagctgggtgcggtggcacacgcctgtagtcccagctactcgggaggctgaggaaggggaatcgcttgaacccgggaggcggaggctgcagaaagccgagatggcgccactgcactccagcctggcgacagagcaagactccgtctcaaaaaaaaaaaaaaaaaaatctaagtttccatgctttgacctaaaaaaaagtcacataggtttctttttctttaattcccatttctttttttaaaaactggttaatgtgtagatttttattcaaattcatttggactgcacatgaatattaaaaagttataacatgaagactgttcattagactatcataggcaaagcaagtgattcacagaataagtgcaatttatcgaccctgatcattacctttactaccgaccactatttaacatcacttttttaatgtactgtttacttgtttactgtctttgtttattgtcctgtcttctcccactagaatataagttacgtaagggcaaaaactttctcttattttccactgtatggccagggtctagcacttggtagaggatcagcataaatttgctgaatgagatgggtgaataccttccgcctttcgcctcccccacttccctctctccatacacatgttaaccaatctttaaggccagggtcaaattctattatctctatgaagattacctccctgagccctctttctcttttgtacctgaatttggcacttgccagctgtctggtaattatctttgcatatgtatgtatctcccttaaaattcttataatcctgttctccataacatgggccagtgtccccaacttttggaatccatctcagcacatgtaaacagcatactgctaacaaatgttttgcttgattcctatcagtagttaatccagaaattcagttaataatttcagtttataatgtatccctccctttcaaataactcaaaataggccatgatattacagcgaatccctctttttatttctgacaattttaaattttacattctcatataagtaatgctcataatttaccctatcaatcactatccctcaagattatatgtttttttttttttgatacactgtcttgctctgttgcccaagctggagcgcagcagtgccatcatagctcactgcagccttgacctcccaggctcaagagatcctcccacttcagcctccaaagtagccggcaccacagctgcgtactactaccatacctagctaattttttgattttctgtggaaacaaggtctttgttgccagggctgttctcaacacctgagctcaagtgatcctcctgccttagcctcttaaagtgctgggattataggaatgagccaccacgcctggcctacattttttaatgtaataaaaaaatcttgtgactttgtggcaatacctataatgatgtttctaaccccagtcaagaagggcgtgaagtttcattcctctctcttgttgctgaggtatcagagggcatttttccacttattcctctttcctttcatggcaagatgtattctgttcccttccttactgatcatactcctggcaagcttttattatttctttgtacctgtccaaggtaatctgtcttacatccttcttttgagccactgtttcctccagttatttatttgattaaaattctaactccctgtctcaatccatttgtgtagaagaaccagctcttcttaaagcctgagcctgcttctttaaattcggccaacctttatgaacctctcttcacacagccaacccttgatcatcaaggataatgaaatgcatacaaataacagattgtctacaacacaagaaaatcagaaaaaaaaaattgacatctggctttggaatttatcatatgtagctttgggcaagacttattttcctaattatgtttttgtttaagccaacattcggattttcttttatgatggtgaatatctccgttttaaatgatcagtaaatttcttttaaagccaatcaagcaccaactatggtttttcctgtgaaatctttttaactagtttctttcatctgttgaaatctgtcataaaatctgttttatttcctctaagttatctccttattttcttgggattctgatccaaatcagttcaccctatattaatttacttcttcaaattaaagtaccttttgcttgagaacttaatgcattttaaaaacactgaatgtccagtgaaatttttagttcaggtaacacgaagtagaaaattatttttgtctaggaaaacttgggagttctaggataaattattacactggtaattctagcaaattatatttagtaggatttttaggattagctgaaaattgaaaaaatttaatactggacagctatataagtctgcttcatcaatatattaatcccatatgctaaacactgtatgaaattaaattcccagtccagggatttacagaaaatagcatcaaaacacactaacacataaatcctgcctcttattctgatccctacctaaactctgcaaccttctcacacctactcttcccccctcccatctcagcctcacttccactctcaactgtcccacaaataatttttaaacgtgtaggaaaaaggaaaagaaccggggtaacagtgtctcctcttttactgccttctcagttactgccattaagcttttggcccaaagactccaatccccaattttacatgtctatttttattttataggtacacacttacaatcaccaaactgaacgaaaggatagggcattctaaattgaaaaaggagcaaaactggataattctgcagttctgttcctagccccctccataatcatgcactatgatcatttggcactataatcaagccaaatgagatattgtactttgagttgctgatatagcagaggttaatactaaaaaagaaaaaaaaaattaattaccacagtttacattttttatctgaatgtacatttatagtacttgaaccgagttattttcaaaacactattcacactaacaaaattcaaaataaattcatttctaatttttcccccatgtagaattttgataagtgcaaaaattattttacctaaaatccaactcttgggctggtgttatttagcctatatttttacataagactgtaaatgttagccaaattaaaaaaaattttaatgcaactttccacattgtcttcaaactcagtaaattccacaattttaaaaaacaaaaacctttcaccgtgcctactcacatttttactaaaatccctacacagagccatacattctgcttttcattttacttctccaagctgctgccttcaccaaatagactccacgagcctcccaagtggtatccaccaatatatgtgatactcaaggaaaagtaggtattaaagagtaattaattcaattggtacgaaatcttttcttttaaaattttaccttaactttaaaaagcccttttcttgatggaggtgaaacagcataaatcctttgaggaaacggttatcctttacgtggactctccatcagccccataaggtgagtggcataaagaggcatttttctgacagtctcagttccccaaacactagtcctaaacttttgcatggatggtaaatttcacacacacacacacacacagaggcggaaaagaaagaagagaaagaaacatacctggtttattttctaaacaggtttgataggtttggttcacttgaaagagcagagtatttacttataatcttttaaaacagaagtgggagccagagcgctgggtaaataaaaacttcagagagttttaaaaccctgcatcttaactcacttccctttggttcaaggggatggcacagcaaaccccacggcaaatgagattatgcaacaggtttttttcctccccagcttattcatcacaggctggttagaggtgtgctttctccaatctgagacacccacgacttcaaaacgccaagaatccttgcagttgatgtttcctaaacttctttaggattttgcagtatccattcattttcagatctacttgccttttctctggttcattattggtattctttaggaaataaacccagcatctgaaaatatttccctctgtggtgtttcattacatgaaactacacgtgatacacagaccctgggcttttttatttctcacgttttgcagctagtgtaaataaagaagtcactaggcgtcgggccccccaacgccaagacccgagcccctgtccgaaaattgagggctttttcggttggttggttgaagaaagcagcaccgtcaccacccaggtggcctcgctgcttacaccaaaggcgaactggggataatgggaacagtcaggccagggccccacttggcaggcgtgttgtgtaacagtcgcgcctggaagtgagcagcttcgcccgcaaaggtgccgcgtcccgcggcggccgctcctctcggcggggcccggtccaagcgccgcgcagcggccgggagcgcacccactgcgaccccgcgcccggccgcacgcccccttcccgctccggccagcctccggccaggcctacacccccgcttcaaacgctcctgcggcccccggccgcggtcgcccccacgccgcctcccgaaagggtggccggtacgcccgggaaggcagagacggcggggctggagcgcggcgcccggcaccgggagtcggggcgcgctgcggagcgtccatgcggccgggcgggagggcgccccgggccccgcaccctcccgcccgcacaccccgcgcggcccgccaaggccacttacttttggggccgccgacctcccaattccctcagagggaaacgaaagttgtcacggcgtctcccctcgggcccccctcgcctcccggacttgcgaggcgccgccgcggagccgagagggcggctgcgctcccgctcgcgtcccgtcccgtcgctctcctcctcctcttcttttcagtatattatcttctccttctctgaggggtgggttggggcgggaggcttaggaagagaggagacgctcgcaacttttcttcactctttctcttccaccctcccccccatcagccttcaaaaaaaatgtcgaaagagatgaagaacttagggaggtaaaggtggggggccgcgttgtgaaagtgggggttgggggggagagagaggtggtaataatcgtttaaaaac

SEQ ID NO: 297 - DNA, 33211 bp, Homo sapiens
  source 1..33211: mol_type = genomic DNA
cgtctgtaaacacccagagactgtcatggagggggaggaggaggcggcggcggcgaagggaggcgtttggggccgcctccagggtccgctctgccattcctgaactggtccctcgtccccgtgactctggcatcagggaagcgaactgttaggcgagaggaggaggcagccagaaccatatccccttcttcctcggggcgggggccgggccaggccggctgagccgggggagggctccgggagggagtgcctggccaggccggcctgtctgccgcgatggatgacagtaaggtaagtcttgtggtttgcacgcgccgccgccttcttgtcgctcaatgctagtcccgcggctgaacctccgctatgtagtccacgccaacacccaagagacacctgcctaaaacatccctgcgcctctccagtccactgcccgatggtacccagccaggaaatcagggaacaccggggctgcgtttttccaggaagggccctctctggaaatttttcactcccagggcgtttgctagctttccaggtagtgcaacccctagtccttaacttgcctgtcgagataagaaactactgtactttttcttcttgcacttttttgctgcctcctctctccagtttggagactttagtgcacgctgaaccagccttattccccttgacgattccccttctctcaggctcccttactcaatgccccattcatataatcagttcactccccctctgagctatttcctgtggttggttggaacaccgctaagctcctgttgctatttggccagtgtggagtttaacctccactagaaagccttctctaaaaaaatactgattttcctcttgttaactttaatagcccatcaccatccaatttccctgtccaaatcacttactttatgattataaaataatagataatgttcattattggttaatccaaatagtttatctatgtatagcctttttgtctttatttattaattgagacggagtttcgctcttgtcgcccaggctggagtgcaatggcgcgatctcggctcaccacaacctccgcctcccgggttcaagcgattctcctgcctcagcctcccgagcagctgggattacaggcatgcaccaccatgcccggctaattttgtatttttggtagagatggggtttctccatgttggtcaggctggtctcgaactcccaatcttaggtgtccgctcgcctcggcctcccaaagtgctgggattacaggcgtgagccaccgcgcctggccgcctttctctctttacatctacccacattagtgttgtttagttttatttcctgaagatagggatggtcaaagatttgtttattgatgtttcaggttgttttggatttggacttttttattttaaggaatcagacttctaaaatttgccagtttttaaagtaaaaaccgtccttctttgtgcttctcagcgtcttctgtttcacagtctttggcatactctttacgatagctttgtcctttgtttgggtgtctttttttgctgctgctgcagtttttgtttcacatatcctcagagagattcaaaaaatttccaacttctctgtgttccttgttttattctttccttcttgttttctcttcctcttcatgtagaaggctgtgaggaagtgacagatggaagggaaagcccagtgcagtactctggaattgttactcacctagaggaacggattgcttgtgaagtagtaaacccctcttaataggaagtggtatttccaagacagaaggggggcgagtttcaggaagctatcagctcataagagtgcttaatatgctcagtacacacattaattcccttgacaagaatcttgcccttgtttgtttacaacaatgcaacagaatgcgggataacattgtagactcttcagttttactatagtaacattcgtggggtatgatattggggaagtggtatttccaagacagaagggtagcgttctaaaagttttccagaaaaatcagcaagtaatttttttttttttttgctttgaatatttctttggggaggggacatcacacttctttcttttttcttttttttcttttttttttttttttttttgagacggagtctccgctgtatcgcccaggctggagtacagtggcacgatctcggctcactgccgagaattgctcttgggttcaagcaattctcctgcctcagcctcctgagtagctgggactacaggcgtgtgccaccacatccagctaaatttttatttttcgtagagacagggtttcaccatgttgatcaggctggtctcaaactcgagtgacctcaggtgatccgcccacctcagcctcccaaagtgctaggaatacaggtgtgagccactgcgcccggccaggacatcacacttctactcaatgaagataaacgtttttacaccttttgtcttttttacccctattatgccacgaattcatagggaataagttctagtagctcaggctgttttccactggtggagtaggctggtgcttcaattgaacccaggtacctttcttatttagtttccttttttttttttttttttgaaatagggtcttgcactgttgcccaggctggggtgcgttggtgtgatcacaactcactgcagcctcgaactcctgggctcaaagcaatcctccacctcagcctcccaagtggctgggactacaggaatgcacatccattcctagctaattttttgcagagatgagggtctcactggcttttttttctgatcattttccttcacacgtttctggaagctgtcagctcttaagagtacttaatatgctcaatatacacattaattctcttggcaagaatctttcccttttttgtttacaacaatgccaacagaatgctgggtaacattgtagactcttccagttttgccatagtaagatttgtagggcattagttttttttttttttttttgagatggagtctctctctgtcccccaggctggagtgcagtggcacgatctcagctcactgcaatctctacctcctggatttaagcgattctccagccccagtctcccgagtaggtgtgattacaggcatgggccaccatgtccggctaatttttttttgagacagggtcttgctcagtcgcccaggcttgatgcagtggtgcagtcttggctcactataaactccgcctcccgggttcaagtgattctcctgcgtcagcctcctgagtagctgggattacaggtgcatgccaccacaaccgattaatttttgtatttttcttagagatagggtttattagagcctgccatgttggccaggctgacagggttttgccatgttggccaggctggtctcgaactcctggcctcaagtgatccgcccacctcggcctcccagagtgctgagattacaggcatgagcactgcacctggccaactttttgcatttttttttttttttaacagagacagggtttcatcatgttggccaggctggtctggaactcctgacctcaggtgatctgtgtaaggtattcccttttaaacagtccccattccattgatgtctaaaatatcaaccttctttttttttttttctttgagacggagtcttgctctgtcaccaggttgtagtgcaatggtgcgatcttggctcactgcaacctctgactccctggttcaagcaattctcctgtctcagcctctgagtggggattacaggtgtgtgccaccatgcccagctaatttttgtatttttagtagagctggggcttcactaggttggccaggatggtctcagtctcctgacctcctgatccgcccacctcggcctcccaaagtgctgggattacaggcatgagccaccgcacctggctacaatatcacctttcttgtaggtttccatgtatgtggccgaaggaacaactccatgtgttctaaaaggcctggagaacatctgttggtgccttttctctttgcctttgtgttaatcattttggtgaattactggaagatggcagttccagccaaaaggcagaaataatatttcataaaagtctttggtagcttgatctttcagtgttaattttgaaattaaatattaacactgtatctattatcttgatgagaaaataatactaatgttatgggtatttaaggatggtagaagaacatactgttctttatttttcctaacttgagattcagaatatattctttctgattttcagttttttccttttcagacctttgaaacatttaacaactttctgaaagtcttcaataatttcaaataagtcgaagaaaaatacataggattttgggctacttagctgtaagatcatataaaagttatttctaaaactagcaatctggtggggtgaaggaaggttcaaaatgtcattgtttagcctgaaagagtgaagttaaaatttgagggcaagctatccgtgaattacttcctaaaggatacacaggtaagcacagtgaatttgattctcactctttattaattcattgtttttataagtacttagaaaccagcagctttgaaaaccttagtgagcatcaaaaagaaaattcatttaaatgtctctggatggagagtgcctctggaatactctacttgcactttgaatgcatgttgtagttgtagataagtaatatttacatgtcatgtataatactggactctccttcaacagtcaggcagtgtgaaactgtccttatataaggctttggcagctcccagccctgcgttttctgtgccctagttataatcccacaaaattgtactgtcctcctagtatatacagacatacacacaaaacacacttttccctcacattctgtatgagtcacactctctcgtcccattttcttcagtgtaagggaagatgaggattggggtttggaagtatggtggctgtgcccttgagagcataaaggatgataaactggctgacagcaagaccagggcaacaggaagaagacagagtaggcaggaacagcagttatagagaggtagtatttgagtgagtaggtcaggaaacatgatgatgataatgtgagggcctccctttataaagattttgtattctgagttgtttttaccagtggtgataaatgagtttgctgcgagttctccacactctgccatctagctggctggagtgagagcaggacagatttgaatggggaatagctttgcctcccaagtttctagcagtgtgcctaatacagcataaagtactcatttatagagattgaattgaattgaatcagggtgacattaaggagattgccctgatgtactcgggctttattaatcagtgtgctccagctgagcaaaccagccagcacatacttacaatggcaaatgagagaaataaagcaagagacagatttggcatctctaaagtgggggtttaggaaagtgttaagtagcagagctcaaatactgagtagatctcctactaggctagttgggaaggaaaaaatcttggctaatttatttaacttttttgagcttccatttccttatctgttaaatgtggccaataggtgaggccttggtgaagattagggttgatacatttaaagctctagtacagactctaacacatagtaggctctcaaaacacgttatcattattatattacctaacagtgattccttgtgctttactacggtgcagtaggtccctgagatgctcattttagtaattcttttttttttttttttttttttttttttttttttttttagtatttattgatcattcttgggtgtttctcagagagggggatttggcagggtcacaggacaatagtggagggaaggtcagcagataaacatgtgaacaagggtctctggtttttctaggcagaggaccctgcggccttccgctgtgtttgtgtccctgggtacttgagattagggaatggtgatgactcttaacgagcatgctgccttcaagcatctgtttaacaaagcacatcttgcactgcccttaatccatttaaccctgagtggacacagcacatgtttcagagagcacggggttgggggtaaggttacagattaacagcatcccaaggcagaagaattcttcttagtacagaacaaaatggagtctcctatgtctacttcgttctacacagacacagtaacaatctgatctctttcttttccccacatttcccccttttctattcgacaaaactgccatcgtcatcatggcccattctcaatgagctgttgggtacacctcccagacggggcggctgccgggcggagacgctcctcacttcccagacggggcggctgccgggcggagacgctcctcacttcccagacggggcggctgccgggcggaggggctcctcacttctcagacggggcagccgggcagagatgctccttacctcctagacggggtggcggtggggcagagacactcctcagatcccagatggggtcatggtggggcagaggtgctcctcacatcccagatggggtggcggggcagaggcgctccccacatctcagacgttgggcggccgggcagagacgctcctcacttcctagacgggatggcggccgggaagaggcgctcctcacttcccagactgggcggccgggcagaggggctcctcacatcccagacgatgggcagccaggcagagacgctcctcacttcccaggcggggtggcggccgggcagaggctgcagtctcggcactttgggaggccaaggcaggcggctgggaggtggaggttgtagcgagccgagatcgcgccactgcactccagcctgggcaacattgagcactgagtgagcgagactccacctgcaatcccggcacctcgggaggcccaggcgggcagatcactcgcggtcaggagctggagaccagcccggccagcccggccaacacagcgaaaccccgtctccaccaaaaaatacaaaaaccagtcaggcgtggcggcgcacacctgcaatcccaggcactcggcaggttgaggcaggagaatcaggcagggaggttgcagtgagccgagatggcggcagtacagtccagcctcagctgggcatcagagggagaccgtggaaagtgggagacgggagagggagagggagaggagggagagggagaggagggagaggagggagagggagagggatcattttagtaattcttaagtatatgctgttgtataagatttgtaacacctacactaccctttgctccagactatgctccagatgggacaggggcagtggggtgggacataaaatgaacttaagctctgtcattaagttagatagtgtgagaaaggtagtctcctgaggccacctccatgtttaccactaggaaaaagtgcttgtttttatgaaaatttcttcttggccaggtgtggtgtctcatgcctgtaatcccagcactttgagaggccaaggtgggtggattgagttcaggagttcaagatcagcatgcgcaacatggcgaaaccccatctcttcaaaaaatataaaaaattatccaggtgtggtggtatgcagctataatcccagctactcagaagggaggctgaggcacaagaattgcataagcccaggaggtggaggttgctgtgagccgagatcacgccactgcactccagcctgggcagtggagccagactctgtctcaaaggaaaaaggaaagtttcttctcccttgacctgctgcattcaattagaaaatagaaatgtgttattttcagaggctttgatcatagatagaaggttcttattttttattttatgttggactttattgaatgaacacatgaatgaattgaaatatcctaaggcgtcaagatccagttgagggactgatgcaggagtgggccaactactggctgcagcatgccaatgtgagctgccatttccctccacacttcttttctaccttgtgttctacgtgattatctggaaatgaggtttcttacactttccttacccttttaaccctctccctctgccaaagtcttctgattctttccagttctgagtagttctggttctcaaaaaaattttaatttggcaaaaaaatctctttgacattccctcatttatcttttggctccttaaccatcctctgctgcagttggagctaccttccttgggccgtgccttatagcccagacattttctgcttttcctgtcctcttactcacatcaacactttctagaagaccaagacaaaagagccatgttgtctattaaacaaatctctgacagtagacattaatgtgcttgctttcttttcttttctttttctttttttttttgagacggtctcactctgtcacccaggctgggcacaagtggtgcaatcatggttcactgcagcctccacctccctggctcaagcgatcctcccacttcagcctctggaatagctgggatcacaggcacctgccaccatgcctgactaatttaaaaatattttttgtagagacagcctgtgttgtccaggctggtttcagactcccaagctcaagcaatctgcccgcctctgcctcccaaagtgctgagattacggacatgagccaccatgcccggccgccttcctttcttgtctaggttacatgcacatttcaacttgagtacctctacagataattcagaaaccaaggagtaatttaaataccacagaaaccagttgaaatctaagtttaaataaccttaatctaagtttaatctaagtttaaataaccttattcagaatgttttgtcctcttaagattttcagaaaagtttatttattaattcattcaacatttgttggacacctgatatgtacgaggcattgtgctaggcattggagttgcaaagatgattaagagtttgtaactgttctcagggaacattttattgggtgaggcagacaaatagaaaagtaattacaatacagtgaggtagaaaatgagggcaatagaggcaaagttcttttggggcagtaagagtgggtgcttaactgtcgaggaacgtcagacatgggtttacagagtaggaatgaatctttaaagaactggagtcccctccaaaacaggaaagatggaatatcctgttgtaaagcatcttgcacagtaaagtaagtattttggtacagctagagaaggatcgacagactttctgtaaagggccatgcacaccatatggtctctgttggaattattccactctgccattgtatcatgaaagcaaccataagcagaatataatgaatgggcatggctgtgttccagtaaaactgtattttcaaaaactgggccaggcacagtggctcacgcctgtaatcccagaactttgggaagccaaggcgggcagatcacctgaggtcaggagttcgagaccagcctgactaacatagagaaaccccatctctactaaaaatacaaaattagctgggcatggtggtgcatgcctgtaatcccagctactcgggaggctgaggcaggagaattgcttgaacctgggaggcagaggctgtggtgagctgagatcacaccattgcactccagcctgggcaacaagagcaaaactccgtctcaaaccaaaaaaaaaaaaaaaaaaaaactggcagcaggctatatttgagttgccagcagggcggtgatatattaaccctgagctacagcgtaaagcagaagtagaggtgtggtcagagatgaggatgaaagataagcagggaccaaattacaatatacctggtaaacaaggctgacaaatttgggtcagtatctttcagagtggaagagacctggtgaatcagattctttcgggatagggtctgggaatttaaattttaataggcttcccagttgagtggctcttatgtgtaatgaggtttgaaaaccaaggccataaatgttggggagccattgaagggttttaaagcagaagtgacaaaatctgatttgtgtttttgaagaaaaatgccaatggctatatggagaacagattagggtgaaaatgtaggaactgggacaagaccagaggcagacggtccgattatgaaagaacatgggttttagcatatgactggagttcaaatctcattttcaccctttcaaactgttgtgattttggacagattatttaatctcttcagatattactttcttcagatacggattgggtgtgttaataaggaccttattgagttattgtgagaattaaatgtaatatatgtgtgatcccataccaaaataacttaatacatactgagttcaataaatcctggtcttttttgaattctcactggcatggttagattgcacagaagaaaggcctggactgaagaccatattagagactttacaatgtaagttgcagttgatgcggcgtgcataaaattctgaaaagataaagagtgaagagaatagagagctaaagagaaccctggaaaactctaaagtgatcagaagattcttgaagaataggactcagcaaaataaactgaaaagagaggtcagtgacgtaagagaaccagaagacagggctgttatgccatctaagagtggagagacttttaaaaagaggacttaccagttgtgggggatgagggaggggataggggttgagagaggagaggcagaagttaactctcaggctagagatgcctacttgatctttctcctgtcgactagaaaaactggcagaaaggttagcagcaggaagatgtgagtagactttgctgctttctgtagatctggcaaatataaaaagagaagaagcctaacccacagctgtgaaggaagttatgggagccttaacatcaaatgaaaacgccactgcttgttttttttctttaaagtggtaaagagcagtggctagccacattcatatttatcttaatttttctttaatccgtgggagataacttttctctttatgtttttaagagaaagacaaaacaagccctcctgttttcctttttggctgaggctgctggtacttcttcatctaaatacagtagttctcttaactttaacaacttgaaacttttattagttgccttaattagagcatcaggatgtaaataagtgtaaaaagggtgataaaagaagagttcttaattgcttttcagattttacatccctgagagggagcatttctttgtaacaacttcttttttttttttttttttgtaacaacttctttaaagttgttggtgatagtagtatcagtttaaatcactttcaaaatattgctgatttttctttttcatttcattaaattatcaatcttttaataaatatctcttaaatgcctggctctgtgctggatactatggggttgcaaaagaagtagaaaacacagcttctgtgcttgaggagctcagactacttggggagatagaaaaatgtgtgagtccactaaaaaaaaaataaagcatataaattcagtgggatattaactctgtgttccagaactttgaagaaaaatgacttatggactgagggtggtggtcagtgagagcttcagagaaagagggctagagctgatcttaacaaaataaaacaagatttgcccttctggatggtgggaggatagagggaaaatagaaatgtaggtatagttagaaatgcaggggatggggttcaggctggtggtctctagggagactggcttgagttgatagagagggtgcctgctggggataatgaaagagagaactggctttttgtgggaatcctggatgcagtgggctgaatggtggcccctaaaaagatatgtccatgtctgaatccctggaacctgtggttatcaccttatatggtaaaacaatgaatattaccttgtatggcaaaagatgtgattaaggattttgagaagaggagcttatcctccattatgtggatgggccgtaaatccagtgacaagtgtccttataagactaaggtagagggagctttgatggacagatgaggaagcagcgtgaccactgaggcagattgcagtgatgtggctacaagtcaaggaatgctggcagccaccagaagctggagaggcaaagaatggattcttccccatgacctccagagggaatgcagctccaccagactgccccagtctggacttccagagccagagaataaatttttgttggtttaagccaccacatttgtggtaatttgttacagcagccccaagaaatgagtatactggatatggtgacttagtaagtagtgctgagccagaggtcttttcttgaactcgagggtgacatggccaggggccattagagaaaatttattatttctataatgatcaggtattacttttttacagggaagaaaaacaccctaaagttattaaaagaaaggttaatctggcagctctttgcaaaatgaattgactagggaagtggggtggaaacggagagatggtggggagatgcactgggaacctattgtaacaacctgtgagtagtgccctgactggtattagggagtcagtgaagcaggatatttccctgaccctttcacgggactcacaacgggtgcctcatatactcagcccaccactctcaactccttgcaggagggagcatgtgagcaaatgagtgagggaactggagtgaatgagcacgggaatcggccagctgctttggtgctagcaggagtgaactttatgcaggcccaatggcagcatccaggtaggggtgcctgagacttccgaagccccagagggagtgttacagtgctctttgagctctgccatccgtggatagctcaactgttaatagctcagtggactctttgccttttcttgtgaggcaactgccttccaccagcaaggacaaagggccagtgtgacagccttttgtatctgcacttgtggctcccaagctcttatccagcgtccaggtaaaatgaggtcacacaaatgaattgaaggatggtgaatgcaggggattttattgctgatgaaagtagttctcagcaggagggggaactgaaaaggggatgggactggtaggtaatcttcccttgaagtccagctgtctccagccagactcttctctgaagttatgccgtcaagccattcctctgaagtcaagccacttctctctgacatctagccgtagtctcgtctaccagtctcgtctgggggttttataggcacaggatggggtggggcagggccatgggtgatttaggaaaaggcaacattcgagtgggaaaacagggatgtaagttctcattttgggccgtcatttcaggcttttcggcttgaggatggggttttgtcggggacccacccttttctgtctagaattttctgtcccctgtccctctcagtaggaatggagaagaagagagaaatcagaggtttataaaggaatacattggcatcactttagtgggtgagcatggagaatcacaatagcagagggaaacttcaatgaggtgtaacatgaaaaagtttgttagttaacctcctcagcacaccccttaactgagtgcctaatatcaaagtgagttacattaaatgaatgactgtatagcataaatacagcagtgcatttaatgcacctgtcagtgttagagctttttcaggaaattatatgatcagattaatgtgtcctgtctgagatgtggatggtaataggcatgcttgattaccttctgacaggttgccatgatacaaatctagggacttgggttctagtccttgctctgatggaagtctctggactaaaatcttgtcatctatgaaatgaagagatcacatatccttatctgtgtctatgtatacacatccctccaccaccagcattcttgtctatattgatattctgctatctgcaatgttattgtttatttcatatctgcttcttttcactagtctaaatacattaagattaagtgtcctattgttttgtatttatccctagagttttacagtgtttgggacaaagtgggtatttaataaagggtcattgaataaaggaattaatgtgctcctctttacctgaaaaagatgaggataatagtgcttacctcatctgaggtaatgtgaaataacatgagatagcgtgtagagtgcctcactcaaggccttgttcataatgagcgctttctgaccacacaccctggtttagccccgaatttatgtttttattctgtttgtcctgaaaaatgggaggtaaatggtccaagaatctttggaataggattaaatgtgggtgctggaggcttcctcattttaagaagccccagttaactcctaaagagcatgcaactataattatatgttctctttctgtggaagttaaacttgttgactgtgaagcctaggccatccataatttcctcaggcctttgcagactgatttctgttttgtctttcgctgtaatggttaattatagaattatcagcaatccctcccttgattaaatccagttttatcttaattctcaaccttaaaactcatgagttagaaccttatgcttgacccctcccctccagaatactcattcttctcataagcttctgtatctgtgctaccttgattctttcctttcagctatttttgctttttcaggctcactaggcaaccatgtctttttaaaaaataatagctttattgaaaggtaattcacaaaccataaaattcacccttttaatttgttcatcctgtgattcttagtatattcacagaattgtgcaatgatcatcactatctaattccagaacagttctatcactccaagaagagactcttacaaacaaactgtggtacatccctctggcagaatactatttagcagtaaaaagaaacgagttgctaggtgtacctgtagttccagctacttgggagggtgaggcaggaggatagcttgagcccaagagtctgagaccagcctgggcaacatagcgaggccctgtttcttaaaaaaaaaaagaaaagaaaagaaagaaagaaaaataaataaacaagctatcaagccacgaaaagtcatggaggagccttaaatgcatattgctaagtgaaaggagccattttggagaaggcaaaactgtagagatagtaaaaagttcagtgattgtcagggtttcaggagagggaggaagagagggaggaatagatggagcacagggggtttttagggcagtgagacgattctgtatgatactgcttatcaaaattcatagaatataccacaccaagagtgaactctaatgtaaactgtggacttcagttactaataataaatcaatgttagttcatcaattataataaatgtaccacactaatgaaagatgttaataataagggaaactgtgagagtggagaggggatagtataggaactccctgtactttcttcttaattttcccgtaaacctaaacagctgtaaaaaaataaagtctattgatttaaaaaagaaaaaaagaaactctgaggccattaacaggcactccccattttttcttcccttctcagccctaagcaaccattaatctactttaagtctctatagatttggaataatacaatatgtggccttttgtatttgtctttcacttagcataatgctttcaaggctatcagtgttgtaccgtgtgtcagcacttcattccattttatagctgaataatgttccattgtatggatatactactttttgttatctattcatcagttgatggacatttgggttgtttctgctttttaggtatcatgagtaatggtgctgtgaacattgatatacaagttctaatgtggacctatgttttcctttctttttggaatatacctagggctggaattgctaggttataaactttatgtttaactttttgaggaactgccaaaatgttttccaaagtggctgcaccattttacattcccacagcaatgtatgaggatttcactttctccacatctgcaccagtacttgttactggttgtctttttttttgagacggagtctcactttgttgccaggatggagtggtgcaatctcggctcactgcaacctccaactcccgggttcaagcgattctcctgcctcagcctcccgagtagctgggcctacaggcgcgcgccaccatgcccagctaattgttttttatttttagtagagatggggtttcactatgttggccaggatggtcttgatctcttgacattatgatccgcccacctcagcctcccaaagtgctgggattacaggctaagccaccatgcctggcattggctatctttttgattatgtaaacatcctagtgggtgtaaagtgatatattttgtggttttcattcacatttccctgatgactaatgatgttgagtattttttcatttgcttattggcatttgtatatcttctttggaggaatgtctatccaaatccttgcccctttttaaaattgggttgtctttttattattgagttgtaagagttctttatgtattctagatacaagtcccttatcatatttgtgatttacaaatattttctcccattctgtgggttgtctttttaccttgattatccttgaaatacagtttggtagcttgtgcttatcatatctaagaaaccattgcctaatccaaggtcataaggagtaaatcctctgttttcctctaagttttatagttttatctctgacatttaggcctttgttctattttttttaaatttgagacagggtctcactctgtcatctaggccggactgcagtggcacaaacccagcttcactgcagtcttgacctcctgggctcaagagatcctctcgccccagcctcccaaagtgctgggattacagtgtgaaccactgcacccggcttgttcaatttttaatttttgtatatggtacgaggtagtgatccaacttaattattttgcaagtggctatccacctgtcccagcaccctttattgaagagactattctttccccatttaattgctttggcaccttgtcaaaaatcaattgaccataaacgtaaggatttatttctggattctctatgcttttccattggtctgtatgtctgtccttgtgccagtattacactgtcttgattactgtagctttctaataaattctgaaatcagaaagtgtgagccctccaatttgcgtctttttcaagattgttttggttattctgggtccctcgtatttccatgtgaactttaggattagcctgccaatttcagcaaaaaggtagctgagattttgataggaattttgttgaaactgtagatcaatttgaggagtattcctttcttaataataataaatcttccagcccactaacatgggctgcctttccatttatcagatcttctttaatttcttttaatgatattttgtggtttttagtgcacagatttgacactccttatgctaaatttattcctgagtattgtattcttttttaggctactgtaagtggagtcattttcttaatttcattttcagattgttcattgatagtgtgtagaaacacaactgatttttgtatattgatcttgtatcctggacccttgctctactcatttagtagctctaataggttttttcaggggggcaagaattcttttggattggattttctatatataaaatcatgtcaccttcaaggagatagctttactttttcctttcctttccctgaatgcttcctattttttcttggtagttcagtgttaaatagaagtgatgagagaagacaagattgttgccttattcatgatctttgggggaaagcattcagtattctaccattagtaagatgttagctgtgggttttttgtagatgtccattatcagattggggaagtttcctcctatttctaggttattgagtgtttttatcatgtgaagatgttgaatttctgtcaagtcctttttttgtgtgtgtgtgagatgaacatgcaagttttgtcctttttttcctgttgatacagtgtattatagtaattgatttctcagttgtcaaaccaacatttattcttgagataaatcccttttagtcatggtgtataatcttctttgttgctagattcagccttctagtattttattgaggattttttgcatataaattcacaagaccatattggtctgtagttttcttctgatatctttggttttggtttcaagtacatattggcctcgtggagtaagttgaaataagctttctcctattccactttttggaagagtttgtgaggttaattatttaaatatttggtagaattcattagtgaagtcatgtaaacctaggcttttctttgattactaatcgaataaaattttttattactgattgtgtcttgttattgctatagatctaattcagattttctatttcttcttgagtctgttttgctactttgtgtctttctaggaatttgtccatttcatctaggttatctagtttttttggcatgcaatttttcctagtattcctttgcatcccttttatttctgtagtgttagtaatggtgtctctttcggtcatgattttagtatttttgagttttttctttctctaatggtccgtctagctaaaggttggtgaattttgttgatccttttgaggaacaatcttttggtttcattgatttttctctgttgtatttccattctttattttattcatctctgcctactatttatcattacattctatctgtctgctttatgtttaatttgctcttcttttgctagtttcttaaggtggaagattagattactgatttgaaaccacctttcttctttaaaacaaacaaaaaggtgtgttccgctccctctgaggaatgctccagttgtaccccatgagttgtggtatgttgtattttctttttctttcatctcaaagtatttttctaatttcccttgtaatcacaattgccatctattttcctcaaagtatttttctaatttctctcataatcacaattttctttgacacattggttatttaagaatgtcttttgttttttaactgtcatttattaaatactgattaccaggtactaagaattatatgacacagttccaggtgcttactttgaaaaagtcatgacctttagtttagcttgtcttaaaagagaaagtgtttaaaacagggagttggaaaattgggacctttagtcttgcttgtaatcagtagactttaacacttttgacatataatgaagacagacttagtatttcagaaaccttactgatgtctaacatctttaatagcccacctttgtgaaagaagctctctgtgaagggtaagaaaaatcactggctagcgggtttcttttctaagtgattggaggtagggagacaggtctttattgtttcccttgggctcactgtccgcatctcacaaatgtgctctagggcagaaaaagacataaaatggatagtgggtaaagaggtatactgttttaaagccagctgtttaaattttcacatgactctatgtcagtagaaataaaattagaacaggaaaaaaagctagatgtgtggggttattttcatagttttctttggagtttatgtcggtacatgaaagtcagtaattttgtttacccatattaatatgcttcctcacagaagttatcaggaaagagcaagggaacaatgtggttatcattgagtttgtgaaaactatgaattgtgaagaatggtcttttggcccaggaattagtgggcttgatttcagttttagctgctggttcttggttcctaattaacgccccctatctgttcctcagtctttatggcttatgaaatatataaagtttagtagttaaggcaactggtactaacctacatttgtgtaatacttttttctcttttatttttttaatctcctcaaattccttttaccaaatactttttttctttataaagtagtctcatatacattgttatagctaagatttacaataatcctgtgttatacttactctcttagaactttaggcattagctgttacaaaaagccaaaacatttggtttattactgagaaaaagttaagctagagaagtggtgattatgtagttttaaatgtaactttataggaaatgacataaaatacagaaaccttggattcatatactatgcctttctttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagtcaggatggtctcgatctcctgacctcgtgatccgcccgcctcggcctcccaaagtgctgggattacaggcgtgagccaccgcgcccggccagcctttctaatttaaaaaaaaggaataacacagttccaattaaaatattttgctgccataaaaactaaacaaagggttatagcttttattttatatttttatgattgctaggtttgtttcaaaaatcagtgaagtccatgaagtacactgtgttctctttctggcgtctcaaaagcagctactcctgaattaattaaaaagagcaatatatgaggtattggattatagtgttgtatgattaatgactcattttactacatgaagaatagatgtcattatccatttatttcactacagacatgagttcttgatgtaatatataagcttttcaaaaagtgtattcaatagtaaatacactttgttttaactcaggttgatttcaaaatattttattaaaattatgtgattgatgagatataagcataattttaaatttaacccattttaatatctggatgaactaggtcatcctgcaattgctttcaaatatttggctctgaagaaagtttcattatttttatatatatatataaatttttttaatttttattttttattttttactttttgtttgagctggggtcttgctcttgtcatctagcctggagtgcagtggcccgatctggacccactgcaacctccacctcccacgttcaagcgattctcctgccttggcctcctcccaagtagctgggattacaggtgcccaccaccgtgcccggctaagttttgtatttttagtagagaaggggtttcaccatattggccaggctggtctcgaattcctgacctcaggtgatccacctgcctcagcctcccaaagtgttgggattacaggtgtgagccaccacacccagctagatgtatattgttataatgtaataaaaacatgacgattgggccaggcccggtggatcacctcaggtgggcacctgtaatcccagctacttgggaggctgaggcaggagaatcggttgaacctaggagcaggaggttgcagtgagctgagatcgcgccattgcattccagcctgggcgacaagagtaagactccatctcaaaacaaacaaacaaacaaaaaacatgacgatgatgcagaagagaaaagctttaaaagaccaggttttgaaaacttgaaactaacttggaagcagtactgaagaacctggctttaagacggtgatggaaaggacagattttttttccccagagccttggagtaatctgtgtcatttcagagccaccccacaaaaatgctagatacaatggttggccatcatgatgtgacagaagtttggtaaatgtggctgattcacatttaaagcttggttttcttgacctaactattagacttagtaatgatctcatctttttagggtacttagcattgtgaatgtgatactaatagtgatttcaaacaaatcagagtttttgtttccaaacagatattgaccctttgagttttgctatctgggaaggcacctacatttattctaatgatttgccagtgtttgaattttgcatcttctcttttagaattgcctttaaagccttagcaatattcctgtcaggacactaaagatataaaatgtttattcttcgagggcgattttcagaaagagctagacatcagtcattcagaaccatgtcagaaaaataaagtggataatcagattgggaatttaaagaatagtgtatagttctaacatattgtgttatgccttataaaacttataaaaacaggctccaatactacttttcagaaaatctttgaactgtggcattattggaataaatgtaccccctttcaaggtgactgcattaaagaacacttacttgatgtgtaagttcaggttcaagtgtttagtaattcatcatctttaccatatagttacatcttgcataaaaacttgggaaggtttcaaagctaaacaatgaagaagattaaattactttggcagtcacctaataattgtgcctaggcaggtaattgagtaacaggaatattgagaggttgctttatgacatcagtgggagcagggagaaatctactgagacagttgaggctttctgtttgttcctttgggctcaacaaatttgagggaatttatagccaaattccttaggatacatatttatgtgtgtatatatatacgattttatacacatattttatattttattatctaatttgaaaatcataaaaatataggtgaggaaaagctatttataattacacctatcagagaagtcttcactgaccttgttaacttcctttcttctatgtattgtcttataatgttgagatcataatgaacttacagttttgaatgttgagttctttaaatgtattttgttgcaattatttttctcaaggcaataaaaacttcttcatgagtccaggcacaatggctcacacctgtaatcccagcactttgagaggcggaggcaggaggatcgcttgaggccgggagtttgagaccagcctggtcaacatagcaagacaccatctctacaaagcgattttttttttttaattagccaggcatggtgatgctcacctgtagacccagctactagggaggctgaggcagaagatcacttgaactcaggaattcaagaccgcagtgagctatgatggtgccactgtgctccagcctgggtaacagagtaagcgagaacctgtctcaaaaaaagaaaaaaaagtggggcctggcaccatggcttactcctagcaccttgggaggccaaggcaaatggatcagttaagcctaggagttggagaccagcctgggcaacatggtgaaaccccatctctaaaaacaacaacaaaaatagaaaaattagccaggcatggtggctcatgcctatagttacagcgacacgggaggctgaagtggaaggatcacctgagccctggaggtcaaggctgcagttaaccatgattgtactactgaactctagcctgagtgacagagtgagaccctgtctggaaaaaaaaaaaaaaaaaattgtcatgaacaaaatatttagtagacatttttcttatctatctccatatggtttgtaaagtttactggtgagctaaataaataaataaataaagtttttattatctccatatggtttgtaaagtttactggtgagctatttaaactttattatcaaataaataataaaaatgtatattatttcttctttcacattcatggtttcaaaagtgtcagaaaataaattagggaaagacccagaaggcatttgatgggattatgctttcttagttccgtagggcttcactcacgttttgtttataaatgttctctttgctaatatgcagccatattcacttttctgtacacagaactaaggaaaaaattatttcttctctcgcttgctgaaggtggttggaggcaaagtaaagaagcccggtaaacgtggtcggaagccagccaaaattgacttgaaagcaaaacttgagaggagccggcagagtgcaagagaatgccgagcccgaaaaaagctgagatatcagtatttggaagagttggtatccagtcgagaaagagctatatgtgccctcagagaggaactggaaatggtaagaaatcgtcagtaaacacatgaaaaaatcaccttaacagtcaaataaataatacattaaaatacgaaaataccagttatcacctgtccagttggcaaacattggagagaatattaatctgttagccaggatgggggcaaataggcatcttcatacactgctggtgggagcagagtgtacgtgactgttaacactaagggattgtttatgagagaagaaaatggaaaataacccagatggacaataataaaggactggttaaataaatgttactacatccatgtattagactacttcgtagccagtaaaaatcacaatgcacatatatttactgatgtagaaagatacaatatattgctaagtagacaaagcaatataacaatatgtaactatgcatagcataccatttgtgtttaagtgactttatttatttatttttattttttattttttatttttttgagatagagtcttgctctgtcgcccaggctggagtgcagggcgcgatctcagctcattgcaagctctacctcccaggttcacgccattctcctgcctcagcctcctgagtagctgggactacaggtgcccatcaccatgcccggctaattttttttgtatttttagtagagatggggtttcactgcattagtcaggatggtctcaatctcctgacctcatggtccactcgccttggcctcccaaagtgctgggattacaggcatcagccactgcacccagccaagtgattttgtttattttacatgttttattcactcatccattcagcctttgggcagtggctgtaaaaatgtgaaagagagtagataaaacagaattgaaactccattattgtgagctgagggaggaagtgacagaagagagagatgatattactgtgatcattacacaactgggacaggcttctacaggtttttagaaagtaagacaacaaggttggaacatgaagaggagggacatgaacagtgttgtatatattgtccagatatatgctattcagtagatttttttgatatgttgaatgtgacatgctatcaattatttcttactttctgcagtgtaagccacttgagggcagaatctttggtcagctttgtctttgtatacccccaaagtccctagcatgcactctggtagatagtagatgtttaatgatcacttgttaaagagagaaaggaaattactaacatttatttctttattttgggagtagaaataatactgtgacaattattaaaaaaaaaaagattaattctaactagtggcacactgtggggagatgtccttttaaccacaggggccttttaaatctgagcaacactccagtacatcaaagacaattcagcagcagtttttccgcctcttctgaaagatggcagatctcgtacatgtcctcagttataaataggtaataccatggagggtgggattcccagcagcgaacgtgacctctagccatgggagttcctatgtctaggatttctaccagtggttcctgaactctgacaagtaaaagttaatttaaatatgttttaaatttatatttatatttaaaattaaatatgtttcagtacaagcagtggtgcatggcaatggaccaaggaaaaatcccttctgaaataaaggccctactcactggagaagagcagaacaaatctcagcagaactcaagcaggcataccaaggctgggaagacagatgctaatagcaattcctgtaagtgccatcaatgggagaatttatatttaagagagtgtctcggttgggcgcagtggctcatgactgtaatcctagcactttgggaggccgaggtgggcagatcgcttgagcccaggagttcaagaccagacagggcaacatggcaaaaccccatctctacaaaaaaatacaaaaattcgctgggcatgggggtgcatgcctgtaatcccagctatttgggagactgaggtgggaggatcacctgagcccagggatgttgaggctgcggtgagccatgatcatgaaaccctgtctcaaaaggggggaacaaaaagagggtatctcaaggtagggtatctcagggtagggtttctgttgaccacttttcttagtatgtctttaaataaaatgttgatgccatttttaatacactaataagcaaatgaaatggcattagattctggccaggtgtggtggcttatgcctgtagtcccagcactttgggaggctgaggtgggcagatcacttgaggccaggagtttgagatcaccctggccaacatggtgaaaccccatttctattaaaaatacaaaaattaggcgcagtggtgtgcgcctgtaatcccagctactcaggagtctgaagcacaagaattgctttaacctgggaaatggaggttgcagtgagctaagatcatgccattgcactccagcctgggcgacagagtgagacctcgtctcaaaaaaaaagaaaaagagaaatggcttagattctaaatattaaaatgcattttacatggagtctataaagagcaactgataaatttatcgaaattttattattaatagacttagtccataaatgggagtggcacgaatctagctttttgttaataataataccttttatttgtattttgatttacagtttacagagtactttcatttatatttatcttaaatattccctccattgattgtgttaaggaattatacttattttatagatgaaaaaatagcagaaaggctggctaaggtgcccaaggtcacacagctttaatggtagaacctgtcctcacctaatccaggctgtctagtgcagtagcccatcatcgtaaggattgtttttaattgaggtaaaattcacataacataaaaattgagagccatttagtacattcacaatgttgtgcaaccattatgtctacctagttatgaaacttttaatcacctcaaaagaaaatcctgaacccattaagcagttattccccattacccacttcccccaacccctggcaaccatgaatctactttctgtctctatggatttacctattctgtatattaatattttatatacctggagtctatacagtatgtgactttttgggtctggcttctgtcacctagtataatgttttcgaggttcatccacattgtagcatgtatcatcagtatttaattcctctttatggtcaaataatatttatatatatacagttgtttatcctttgatggacatatgtttttacctcttagatattgtgagtagtactgctgtgaacatgtgcatataggtatttgttttcatacctgttttgaattcatttgtatgtatacctaggagtcaaattgctgggtcatatgacaattctgtgtttaatttttgaggaatagtcaaactgttttccacagtacctgaaacattttacattcccaccagcaatgtatgtctgctccaatttgtccacatctcatcaacttattttccattttttaaaactatagccatcctaatgggtatggagtggtatctcattgtgtttggtttgcatttccctaatgcctaatgatgctgaacatattttctatgcttgttggccattcgtatgtattctttggggaaatgtctaggtcccctgctcatgttttaattaggttgtttttgttgttgagtggtaacagttctattgggggaacctgcccccaatatttcaatgtaggttctttctattttccataaatgtcggccaactgagaaataaagagagacagtacaaagagaggaattttacagctgggccgccaggggtgacatcacatatcggtaggaccgtgatgcccgcctgagtctcagaccagcaagtttttattaagggtttcaaaaggggaggtggtgtaagaacagggagtaggcacaaagatcacatgcttcaaagggcaaaaagcagagccactaataagggtctaacaaagatcacgtgcttttgagggaacaggacaagggcaaaagcagaaccactgataagggtccaacaaagatcacagggcaaagggcaaaagcagaaccactgataagggtctatgttcagcagtgcacatattgtcttgataaacatcttaaacaacagaaaacggggtttgagagcagagaagcggtctgaccacaaatttaccagggcagagtttttccccaccctagtaagcctgagggttctgcaggagaccagggcgtatctcagtccttatctcaactgcacaagacagacatttcccagagtggctgtttatagacctccccccaggaacacattcctttcccagggtattaatattaatattccttgctaggaaaagaatttagcaatatctttcctacttgcatgtccgtttataggctctctgcaagaagagaaatatggctctttttgtctgacccagcaggcagtcagatcttatggttttcttcccttgttccataaaaatcactgttattctgttctttttcaaggtgcactgatttcatattgttccaacacacattttacaatcaatttgtacagttaacacaattatcacagtggtcctgaggtgacatacatcctcagcttacgaagataataggattaagagtaaagtaaagacaggcataagaaattataaaagtattatttgggagcagataaatgtccatattaatatgaaatcttcacaatttatgttcctctgccgcggctccagccggtccctctgttcagggtccctgagtttccgcaacagagttctttattgtggttataaaacctttatcagatacatgatttgcagatattttctccccttctctaggcttcttttcactttgttgatagtgttctttgatacacaaaatattttaattttggtgaagtccaatttatctatttttgtttttttgttactcatgcttttggtgtcatatctaagactccattgccaaatgcacagttatgaagatttacctgcctcatgttttctaagaattttatggttttaactcttttatttgggtgattgatccattttgaattaatttttctatatggtataaagtgggagtccatatgttgcatgtgagtatctagttgtccaagcaacatttgttgaagaaactggaaagactttaaaatgaatatgtcctatgttgatttcttcattattgtgattgctctgggagcactttaaatagctataaagaaatgtcacaaacctttattattattattattattattattatttttttttattttttttttttttaggtcaacctctgggagcacagaacaatgtttcaatatttttttttttgagaagaagtctcgctctgtcacccaggctggagtgcagtggcacgatcttggctcactgcaacctctgcctcccaggttcaagcgattctcctgcctcagcctcccaagtagctggggttacaagtgtatggcactgcacccggctaattttttgtatttttagtagagacagggtttcaccatgttggccaggctggtcttgaactcctgacttcaggtaattcacccgccttggcctcccaaagtgctaggattacaggtgtgagctaccacgcccatctagaacaaacttcttatgttttcagtattttttacaaaattgaagaaatcggctttttgataacttttattagataacatttgtcttcatctaggttgacaagtgcactaaaatatcagactccaccactatacaattcacccacgtaaccaaaaaccacttctaccccaaaagctactgaaatgtttaaaaattaaaacatttggcttcatctaaattaaattaatggaaaaaagccaaatcagcttttttttagtctgtatttttaaaaattagccttactgaagatactaaactgaaaaaaaaaatttatgcatcttaaaacagattaatcaaactttattgactctaaaaacattcttacattggtaacttttatttttcagggtgaagattatataaagatgagtcagtgattgaagccaatattctgattcccatggaagatggatgggcaagagtgtacttcttggctccatttactacctactgctcagtagtcatctctgtaaatctgcaatttctaccaaaatgtgtgatcgtagatctcaaaggatcttgctttaactttcaacacttagaaaatctacaaacattcagacctgtctgggttggtattgccacccatgacatttaacatgttgtgatgcttgaaaacacaggagtagagaaaatcgatgaagattgtatttttgcaccttaactccacattgctttattggttaatttatattctttccatgtaattcatgtaattgtatgtctgtgtgtgttttatgtgtcaccacctttcatgtttttgattgccctacaaagagaaaccaaatgagctgattactgactataagttctcagcctttatggacctaatcttatttttatttacttgagtaatgtttattctctgcatgaaccatgatttctcctgtgagccattccagcataagctgtgaatatgtattaacaaatatatacatttctatttttataatccataaggatatgcctgttttaaataacatacatattaacaatatctatcaggaaaaccctcaagacagcttctagttaaaacctttgttgctgtcctctcaaactatatttataaaaatttgctagggccaaatccatacttgcagaataattcatcaaattttatttttaagtgaaaagtaacctttcaggcatttcagcagcatacattgacaatctagggtatatatgtatgtatgtttcttattgtatgtctatatatgtatgtggggaggacaggagtgaatgttcacacacttttcttgcgtactcaactaaattggagaatgtttctgaagaaaattggatgaaattagctgctgagattgagtttctgccttaaaatctgaaacaaaaaaagggacaaattgctggtagatctactgactgtagccatcaccagaacacttagtttcttcccagacatgaatttcctgacaggctctgagccagaaacacactgtgggcgtgcatctggttcagccctggatatgcctccactgtggagggaagcattggaactggagttgtgcacagcaccgcagctagtgggcctggctgggggtgcagaagggcagggtagttctttccatttccccttgcagctacacttactttctccctgactaccaaatggagtgacggttgaagaatcaagctcataatatgatacacccagacagacccagaaatcttttgatttccccagcgagatacttaccactctctcttctctttcccatggttaaaacaggagttgtgttctctgtcgctgctaaattattcttcacttgagtgaagcaaatatttagcttccaaataaagtatattttgttctgaactggcagtttaagaggagataccgtagtctagattgtctttgaggtagaatatatgatggaccacatagtttaagattacaaggtactttccctcttctctcaggccatgcatttgaataaagtgcctcccttagcctgagctcctaaagacctcttgtacttggttgcaaactcagatctctagtctagtctagtctagtctagtctagtcatgtgtgactgtgtactgagataccactagcccagtttgctgggtctctatgttttggaagttgggggtttaataatatttaatgtctttttaggatcataaacataaataggtttgttgatattcaggccttcagaatttaagggttttaaatatagcattcagattgtaattggtatgtttttgccatctggtccactcaattgtatatttttattttgcaaaacaacccaaaacttactttatgttgctttgttcagtaccttttgaattcccccagaagagttgttttcaaaacaaacattccagaatgaatgtcgctcttcaatggaacgtctttattgtgcttgaagtatttcttctctggttgtaattctaaattacagagtcatttgagctttctcccctcccgctagtatctttacaggagcagggaagagcagtagaggatgtataattttgggcgaagttaaattacaatttatttgaggttattcctaaacctatttatttggtgttttggaggagatcacacactaagagaacgttgattgcctcggctattgtgctggctggacactttggtcacttttgaagcatgttaataaatgtcactgattaaaacagctggagcatttccttccctttccagtgaaggagcagcatagtgaaatcctggcacccctcacctttttgtgatgacaagatggctgacagtcacggagtccaggagaaggtgctgctctccttgctttctgagtaaacagagtaatgttttttttcttattttcccaaagaaagaaaagggggaaaatatatttgtatgtttagaccagccaaattctgtcattattttagtatcaacctgctgtatattagagcaactgaatataatatggaataagtttgaccaggtcaagttttaggatatagttgaatttctttaaaaagttttctattttatctaaaatctttccattatatctaaattagaatgatcatcctgcgcaaattcagattactgtttgctggctaattgacagtatttctcagcatcactatgtagcattctgttttagcatctttgaattatgatcatttgatttggctaattacaaaaagtacaggtttaaactggacttagcttgagttaaaggcaaagaaaatctaaaaacataaatgttatatttcacaagaaatcagttgcatattatccattacatatttagttttaaaaggaggagtcaccttgaattattttctgagtcaccttgagttatttgatctctcagcctgctttctcatctgtaaaaaaggggggaggataactttcacagggtaattggtaggctaaataggagttacagaaaactgttaaatagggaagaactacattaaatttaaatattcacatt

SEQ ID NO: 298 - DNA, 35127 bp, Homo sapiens
  source 1..35127: mol_type = genomic DNA
tacagtaaacaaatgaatgcattttacaaaataaaacatttcccttggaaagttgagtgaaaacaaatatgtaaatagcttctgtttttatagttaaagctttttaatctctggtgcataacaattgaaagaatgagaacttagacaaaagtatttggtggatttgagttaatgggccaagcaagctttttttccttggcttctctgtcaaatgagtcatagatcgagtctttggtaatagttttggccatggaagggatttctgaaatgccaacgtagttttttttggccatccttgaacttgttgtgatagtataggcattgcttcggtaacatttcatagaggacatgcaaaaagtctctttcatccctctccgaaaattggcattataaattgaatacagagtaggtttagaggctgaagaactaaaggatatccatgtgatagctgtgaaaacaagggaacttttcttatagtcttgttcatgggggtgccatagctgagctacatgaaaaggcagccaggagagcaaaaacaacagatttaaaatgaggaacatcttgatagttttcacttttgtccgagggacaatgttcattgtcctcctcaccgttcggccatctgtgcctattctccaaatatattttatgaccttttggtaaaataaaattatgaggacagatggaatcacaaagcccaccaagaagtggatgacagtgtaggcagtgccttcccaagaggaggggaggaaatagttacaatgactgtcccagttggagccatagaaaaagagcacaggggtcacaaagcctgcatcaaagacccacgatgccgcaatcattttcttggctttttctctggacaccttgaagctcagaggatagacgatggtgtagaaccggtctatgcagatggagaggagaacgtagatctggacacctggagtgagatattgaaaatatcgcacaaccttgcacgttgcactacccagcgtccaccttccagtggtgaactggagcaggacgaaaggcgtgctggcaacgctgatgagaaggtcagcacatgccatggagaccacaaagtagttggtggtagactgagtcctcctactcctatggatgaccaaacaaaccagggaattgccgaagatagaaaacaaccacagaatcccaaagaagatgctggctgtggccacttccccgggtttcagcacatagtgaaggtctgtttggttgctcatccaactgtgctcctcacttaattccatcaggtattggcttggcagaggtgtggctgtttcagtgcagctgcggttttggaggggcaccagaagtgtaggaataatcaaatgtggcttgctgttatccattctgtgagcaaaaaccatattcactttttttctcttaattctggttggggaaaagaagaatgaggcctcctgttaaaaaggtgtcatacagattggttatgattactcaggctaacgatcttatttgacatttacattgattgtcatttgtctttgtgtaggacttgagcgttggcaggaaaacataactactatccagaaaaaattctggccccaactttgttttcattttaggagctgtttcagcagatctcagctcaggctctctctggcctcaccttctcttgacccttagtcataccgagctcccctcctacacatatccttgttcccttcactcatcagggatcacagaatattagggatctcaaatctggctcatggtaacggtgttaccaccaactgaagatctgctggaattctgggcaagtatgtgagaagttcctaattgtcctaaggttgcaaaagaggaaagcttgggcagatgaaaacacacagattttgactatggaagtagctaacagcagtctgtgaatgtagacaggctagctactgggaagggtgctgtccttacttagtgtagattttccatcacagaaggattatggtaacacatggagcagtcaacactgctacatgagccagaaatagctcctaatttaatgacatctgaaaatagcttgctttttctaaaagacgatacagttcatgcactaatagcttgccacctaccagtgacatatattttgatgctattctgttgttattgtttcataaaatactgactgaagaacatacaagatgtcctctaagaaatgtaaccaggttacgggagaccttatggcagtcaggtgattaaaaacaacaaaaaaatgtaactgttagctaagcacagtggggaacacctatagtcccagctactcagaaggctgaagcaggaggatcagttggtccagaagtttgaatccagcctgggcaacatagcaagaccctatctcaaaaaaaaaaaaagtaacttaaaattactaagcactttttaaaagcttataaagcttacaaatcttagatacaaaagaatattttaaagtttagcctttattttgtactttttgtattattcagtgagaaaaaaagtcacactgtttaaataggcaaaaagattaaatagttgtgggtcattcaattaaaattgaggtgattttgctcacagattataaaggcttaatttggtctgaatccaggaaacaaaaagagaaacagtagcaatttaatccataataaccataataattatggttattaaggtaagataaggataaacattaatattttcaaaaatgtgcccactaaaagtaaaagcccatgtggggttacagccaccattttgcagagattccatctggcctgtggcacaaggggatgtggctccagcaacaggcttttctagtagtcactagtttctttcctggtgggctcctgtgtctgcacctcacaaagaaacatttctcaagtgacagtcaggattaaataatagttcataatgaaagaacggttcttaatgactaatattttcttttttttgagacagagtctcgctccgtcccccgggctggtgtgcagtggcgcgatctctgctcaatgcaacctccccctcccaggttcaattcttgtgtctcagcctctcgagtagttgggactagaggcgcgtgccaccatgcctggctaatttttgtatttttagtagagaccgggtttccccacgttggccaggctggtcttgaactcctgacctcaagtgattcgcccgccttggcctcccaaagtgctgggattacgggtgtagcaattgcgcccagccctcattttttctttgagggatttttgtactaatttgtggtagagaaagaagtgttaatatatataatcttcaccaaaaagctatattcaatacaagtctagtgctcaaggcaatatactcaatgcctgttctatattatctttaggcttttttgtccatgaggcaaccttacttaagaaagcttaagtaagataattaaaattttaaaaattaaaaaaaaagtttttgctcaccacacagaaagcaaaaataattaaacattttgactactaaaagatctttaagcatgctgggaaaatgatagccaatggtaagaatagcaaccatacactttccatataagaaatcagggccaggcgcggtggctcatgcctgtaatccgagcactttgggaggtcaaggcgtgcaaatcacgaggtcaggagatcgagactatcctggctaacacagtgaaaccccgtctctactaaaaatacaaaagattagccgggcgtggtggcaggcgcctgtggtcccagctactcgggaggctgaggcaggagaatcgcttgaacccgggaggcgaaggttgcagtgagctgagatcgcgccactgcactccaggctgggcgacggggtgagacgccatctcaaaaaaaaaaaaaaaaaaaaaaaaaaagaaatcaggacataagatctaaaattagcattgtcctagaaaatctggactgcaccctcatacatataagattgaaatcatcttttcgccttcatgtgtgtaaaacctattaaactttttaaaaaacctgttaagatttaaagtttaaaaataaactaaaacagacaatttccccagacagaaaactgttctaacttttctgggatgcctgtggcctgaataaaacaggagtccacacaggcacttttccttaatgcgcatacttgaaaacctgtgaacttccttctgtctctttcttcctctaacaacaaaactctgcaaatgaaactcaagctcaccgctttaactaaagcccggaggcggggggcccttccatcatttcctccagctgctttacacccatgagtctgtctgcccatttccccagcccaaccacttggaagcagaggatcccaatgctcagaaacaggacgagggagcccgaggagttcctgagtctagatttcccctgctggtggcataagttctcactccacctaaaatcgctgcagttctgaatattcattcaataagccgagaaactgggctaggtattaagaaaacaaagatcggccgagcgcggtggctcacgcctgtaatcccagcactttgggaggccgaggcgggcggatcacaaggtcaggagatcgagaccatcctggctaacacagtgaaactccgtccaactaaaaatacaaaaaattagccgggcatggtggtgggcgcctgtagtcccagctatccgggaggctgaggcaggagaacggcgtgaacccgggaggcggagcttgcagtgagccgagcagcctggggcacaaagccagactccgtctcaaaaaaaaaaaaaaaaaaaaaaaaaaaaagaaaacaaagatacgtaagcagtgtgccatattataactcaatttgataataattataattcactgctaagaacagaactttgtacaaggagctaagtaagacaaaaatagggacccagttttgcccgggtaaggggaagaaaaggaaaggcttcacagaagaggtaaagtttgagctgggagcttagaggatgaataggacttcttcaggaagacaagtgaataaaacattccaggggagagagatagcatgtggattgaattttggggtcatttttctgggttgatcttttttggggcccttttcccctcagaaacatagtttccttcagaccatgcctcccagagtatatagtttctaaatgccctacaatcaaactgatctaaatttttcccctggttacaatgagaggttatatttgctgcattcatgggcagaaatgcggtcagacagtggataagaatattagcatatccagaatggttgtggtacccttgctcatacagcatcttgttagtcctttactgcagcattttccaagtttgtttttctctagcttagcaatacagtagattggagtcttccaggcagccttaagaaatattgatgcctgagtcccagcttcagggattttaatttaattgctctggagtgcagcctgggtgtcggatgtttcaaagttcccaggtgatcctgagtgtagccaagattaagatctgtgctttagaaatacctccatgtttctgtcttctccaataaactgtggactccagtagggagatggggatgttattctttttctccatgctctacagcttccactgaagttctttacattaataattgcttattcgatgtttactaaattggatctgtaaggacagagaactgaaataaatgactcttactctatgtgcctctgctaggagaattaaatgcacatagaaaatcactatatattctcagagaggtgaaacattggggattatggtgataggggaaaacatgactcctgataaaagcagggcaggtgaaactgaagctaccaggtcaactgctatatgaaacagatatctcatctaagggaaagccaaggtaatttaggtgtcctcagacaggttcttgcactttcctcccagaaaaaagtctgccatattataactaaattctagggtcccaaagtaaagtttcagaaaggcctcccctgctccattaatttagataaaaatatatcttcaagggggtgtttctgaaatataagatctggttaattagtaattctgttcagagccatccatatgcagtaattttagcagtgacaagaaaggcttcttcacctctttcctgttcgacctatctcttcccagccagttctgagactaccatttgacatactcccttggctgaggtattgaaggtccttatttatctctacctatatatgatctaaaagaggaatcattcatttatcctattatctacttctcacccatccaagctttaagattaatacatgagtggggaaaatggtagatgggttgtcatagcacagaactgggggccaggcatggtggctcatacctgtaaccctagcactttgggaggctgaggcgggcggatcacctgaggtcaggagttcaagaccagcctggccaatacggcaaaaccccgtctctactaaaaatacataaattagccaggcgtggtggcatgtgcctgtagtcccagctacatgggaggctgaggcaggagaatcgcttgaacccgggaggcagaggttgcaatgagctgagatcacgccactgcactccagcctgggtgagagtgagactctgcatctcaattagaaaaaaaaaaaaaaaaagaactggggactggttacccctgtaatgatgggatcctggggcacctgggaggagaatgtaccctatcactttgctttgtaatttttattttgcatgtttgtctcccccattaggttatgagttccttgaggataaggactatgtctttacttctatatccctggggcacatagctattaaaaaaggtttaatgaatatatgaatgggtggatatgttagtaaaaattatccaatacttgaaaataaggcaaaaaaggacatatactcttaagatcttgctgggacattcttaaatgggcctctctctctgggagaatgtacctgtgcttgactttgctatttaatatttgactagagctgagacattgtgaagatatttatatgttaacttgtagatttctttctagcagaaaataataaccccaaaggttatggacttactgccctctaggacattagccagtttagtgtttacctagcaatcttatgctgaaattctttttaaaaaatgcctataaagatgcattcttcaaatgctcttggaaccagctttattatatcattggttccttcggtattatgttaataaatctttaacatatgttcattcaatatttgtaaaagtcatgattctaactttttgaaaatcatactttgttggatgcaatggatggatgaatgactggaagctaataagagggagcggaggaccacagagaggaatggggcatggatgacaaactttgcttcacaattctgcatcaactgttggataggttttttagttagtctattttttaagtctaaaaataccctaacaactaactttttgtcctcttgagattataaagattcacaaacattctcacaaggtataaagaccatttttatttcttgagatttgtttaaaaatttaatgtcaaacaagaatttttataatattgattttttacatgatttggttgaaaaaaaaaaacagaaacattttctgtagaatgggaagtatctgctggacctacatggatacatatgggtatttactaatgagcagtaagattacaatcatgacagtagttatagcattaatactaccaagagttaatacttatttttgtgcttactatgtgccaggcactttatatgtgtaacccctcaaagtaggtaaaattactggccttgttttacaaatgaaaaaaactgaagttcttccccaaagtcataccgttggaaagtggtcactccaaagcccttgctcttaactaccatcagggtttcctgaccagtgagaccacagagggctggatctgaattcagagagtcaaattggctgtacatgggtaagtctttcttgactattcattcaaagagaggaatacaaagttattccctatagcctcttgcctacccacagatacatctgttcaatatgctagctcagaaatatgtgacatagtgaacagttttaaaaaatgatcactcccacaacgcactgcacagaagcttagcatcaaaagtgcgccagacatgctggcctggagaaatagcctttcttcagaataaagagtgtgagagtattggcatttcaacatgctgcataattaactgttgccttttaaacagaatgaaagcagaattctagacttcaatttgaattgaaatgaggaaaaaatttgatcaattgtattatcccaagtaggaaattatcttttaaaattttagttgtttaaattcaagaaataccacggtacggagattttaaggtaaacccttcattgttgtgtaggcttgatttgtttacatgtgaaaatgagaaatgcctgtaacactagtgggctgggactggcttacatagggaaccctgagccaactgtatatacatttcttcccaactccaggctcaaagacatcatgttggcatcatgaagcagccatggtaggagtatggcaaacaccaaaaattgaagttttgtttttttcccccctctgcagagccagttgttaaacatttacccgcacaccacttccagtagggcagggctttcagggcagcctatcctaagtcctgaacttacacacattgctgaacttaaaaatggctcaggaggccacacaagctcttctgaagcttcctaactgactctcttgctgtgtggccttgagataaagactctggtgtatgtgtgcttgtgtgtgttttatagagatgaggtcttgctatgttgtccaggctggtcttgaactcctgggctcaagcaatcctcctgccttggcctcccaaagtgctgggattataggtgtgaaccaccatgcccagctgagaaaagactgatatgaacattaggtgatttataaaactacataaggctaggtagccaccagcatgactgtgtggggtaacaggaaaatcagagagggtgagacatgttcttacaatgtcgactcagatgaggttgctagataaaatacaggatgcccaggtaaatgtgaatttcagataaataacaaataatttttttgtaaaagtatgtcccatgcaatatcccatgcaacattttactggtgtcctgtattttcatttgttaaatctggcaaacctacacccagaatgtaatcttctgctaaaaaaatctcatgttttaaatctcacagtgtaggcatactgcaaagtggatatgtatgtaggctttgaagtcagttgcatcctattcctgtcactcactcactagctgggtgaccttgggcaagttacctaaccctcttgagctccagttttcttctgtaaaatgaagatagtcagttcctatctcatttgattattataactagatgagagaatatacacaggacttagatgagttaatacatgtgcatctgcctggtatgaggaaaacaacaggtgttatttttatatacagttctacaaaacacctagttctgtgtctggaacaaagcaactgcttcaaaaattagtcttttaaaccatatgacaaacaaattttagtaaccatattacacatcacatactatagtaataatactaacattggtcacataatttagctttgtcaagggtaaatggcttttgtgaaggggcctgggtacctaatcatcatttacaacaatgtttttaagggggaaatcattgaggccaaataaataaacacattttctccaagttgtggatgattttatgtgacatgttgtccagatcaaactttttaaggtatcctacatcaaaatacataatacaactggattgaatacgcctttttcaaaagcccatagaatctattctgcttaaattatttccattagaggctgggcatgtaatctcagcactttgggaagccgaggtgggcagatcatctgaggtcaggtgtttaagaccagacaggccaacatggtgaaaccccatctctactaaaaataaaaaaaaaaaaaattagccgggtgtggcggctggtgcctgtaatcccagctactagggaggctgaggcaggagaattgcttgaaccagggaggcagaggttgcagtgagctgagattacaccactgcactccaacccagacaacacagtgagactccctctcaaaaaaaaaaaaattgtttccattagatattttaaataattgcaaaagaacctcacaccaatgaaaacagagcttctttccaccacctgaaactcctggtgccacaagcttataggcctggaattttctctactggtctttttcctttcctccttttatataatatatataagtattcctccataataatccagctctgtacctttcaaactgtttcctaactggcatcaagcagtttctcaagctcagactgggtatattttctttttgtttggaaactcgatatgctttcatgggaacataatttttttttaaacagagatgttttcaaaacagcttcttctaacttcacaaaatagcttaaaacaaccatgaacattcctggctcagaaattctgcctatgtagatttaagggactattactctcctatcacatttgcctctttctttacccttcacatgaattcaaaaaatcaacctctctcacaattacagcatcatcctttaaagtgaagatccctattaaaatataaatgtttcttaaagaccagttgtacatttttttcagttttatattttatcagtagtgatttctgagacctattcattctatctctgaaatctacgattagtgaaaatgaaaacagaagagatgccaaaagcaaaagccgtgaggaccatcagtaactgagagaattaagatggggtgtcattatgagaagggccgggtgaagggtgaaaggtgaagttgaagaagataaacttcacctccttgacagttttgtgaaggaatggataaccactggtagctaccctacccaaaggaataaaacagaaaggagcctgagctttaccccacatgaaggtttaagttgaccacaggctgcagtcctcccctaattccttgtaaacaatgttgcatgacaaaaatgttaggtcgtgttggcatctctttgggggtgaccacccccacggatgtataaagaatactatctaatatttctcttcccaactgctgcttagtagcttagtagagttccgtgtatacaggacacagctgcaggtttaatactgaacttccctacctccctacattcacacaaaatctgaaaagtaagatacaatgtaaaaaaaacaagtgcaaaaaaatttcaccctggctgggtgtggtgactcatgcctataatcccagcactttgggaagccgaagtgggtgaatcacttgaggttaggagtttgagaccagcctggccaacatggtgaaaactcatctctactaaaaatacacaaattagccagacgtgatggtgggtgcctgtaatcccagttatttgggaggctgaggcaggagaattgcttgaaccccggaggcggaggttgcagtgagccaagattgtactactgcactccagcctgggtaacagaacaagactccatctcaaaaagaaaaaaaaaaaattcaccctaagaaatgaccattttgttatgatggcatatgcaaaatagtcttcaatcataacatttatccattttttaaaaagatcacttagtgtggccagagttgtgttcattgctggggacacagacattataataactagacagacaagatccctgtttttatggagcttacttctaacatgggaaacaaataataaacagctaaacaaataaaaatgtcaataattcagaaatgattagtgctatgtagaaaaagaaaacagaatgagggaccaagaattgacgggaaatggaatggcagatggctggttagctggttacccaatgaccattcccaactcctccctctcctgcctcttaagaggctaaaaaggtaagataataatttccccaccatccctttcagttaggtgtggtcacatcaatataatcttcttctggccagtgacaagagaaagtctcctggcagggtgttgggaggttcttggaaaaatgtttcttccttgataaaaggaaagaggtgtgtagtgagtattctcatgggcctgactgcctctctgcttcttgccactgtaaactgtcacatgaagatgtcagggcactgggtggtatcttctgaggtcaggggaagtcctgagactcaccgggacatagtgccctgacactgtggtgctgctaggacactcacctccagacttactaagtaagcaaacaatgtctttatggcttaagccactttgagttttgttactcatctctgaaagcaccctgtctgaaacagggtctggttttagatggagtggttagagaaaggttctctgaagaggttatatggcagctgaaaccccaacgacaggaagtccgccataacattcaggcagaagaaatgatgagtgcaaagaccctggtgtaggaatgagcttgttatgtggctacagcatatgaataccaaagaaaatgatacctgatataaccggaaaggtgggcaaaggtaggatgacacagggcattgtagggcatggttttagtctattgaaggaaaattcatcgcaggtttcaggcaaaggagtgaaatgaatatgccattttttttaaccccctcacgcacatttatgttttaaaaatacaactttagttgctgtgtaggtggccaagcatagaagcagggagaatagttaacaggctattacacccagcactttgggaggccgaggcaggtggatcacttgaggtcaggagttcgagaccagcctggccaacatggcaaaatcctgtctgtactaaatatataaaaattagcccagcatggtggtgagtgcctgtaatcccagctactcgaaaggctgaggcaggagaatcacttgaacctgggaggcggaggttgcagtgagccgagattgtaccactgcactccaacctgggcgacagccagactttgtctcaaaaaaaaaaaaaaaaaaaaaaggctattacagcctgggcaacatagtcagaccctatctctaccaaaaaaaaaaaaaaaaagtaaaaatttgctggttgtggtgggaggctcccagctacttgggaggctgaggcaggagaactgcttgagcctaggaggttgaggctgcagtaagctgtgatgctgtgatcacaccactgctgatgatggtggcttagaccagggtgatggcagtgtaggtggagaaaagtagatgaatattgaaaatattatggagacagagccaacaagattagtttatatgtgatggggttagggaatggggatgacccctagttttgagagcctgagagcaagagagaaaaagtttagggagcttgaaatcagtaatactactatacacaagttaaattcccactagatatccacgtagagatatcagttggctattgaatatgtacatttggaaaaatctcttttgaaaacctgtgcccatttgaatcaattcattcatcactccataaatatacactaagatcatactacactccagaatgtactatgttaataattagatatacaatggtaaaccaaactgtatccctaccctcatgaagatctagtataattagttgtagaggggtagagagtagtaaacagataagaagaaatgaatgtattaagttgtagtaagtccaatgaaagaagagtaggctgctataagagagcatggtgaggaccctcccctgggctggggtcagggaggcaatggaagcagcagcagagatgatgaagaatggctcatctaaggtagaccctccaggacccctgctgctgacagatgacaagagagtctagccaacatgccgccttgggtcccagccgtgttccaggtccttaacaacgttctaggctccttgaggcctggacttaggactgttgtgatagtctgttgtcctggaagcaattcagaggtttttttatagacaaaagaacctaaatcatcacgtggggagcaggttagagagaaagagggataagtggagccgagaggaacaaagtatccccatagattttgttctgtgtaagaaccccaggacctaggaaggggaagagagtctcagtaatgtttgccattgatgttcccatcagcctggtaggatagagccttgccgttatttaaaggaaataatgtgagtagtaggcagaatggttccccaaagatatccatgccctaatccctggaacctgtgaatgtgttatgttatatagcaaaagggattctgcataataattaaggttatgaaccttaaagtggggagactatcctggattatccaggtaggcccaatctaagcacatgagcccttaaatgcagggaactttctctggcagcagcaggagaagtcagagagactccaagcatgagaaagaattgacatgctattgcaggctctgagatgcaggggcccacatagagggaccaggatgaggcctctaggaggtatgatggctcccacctgatagccatcaaggaaataggatcttagtcttacaaccacaaggcaccggattctgccaacaacctgactgagcctggaagggcagtcaacctcagagcctctaaaaaggatcacagtcctgctaagatcttgattttagccctgggagactctaagcagagaactcagccaaacccacccagacttctgatgtacagaactgtgagataataaacagtgttatcttaagccactaaatttgtgttaacttgttacagcagcaatagaaactaattcaatgtagcatttcttatataatttaatttgagtactaaaattcataccagtcattctatcaccttctaataccctactagcacctgaaatattagaaaaccaaaaatcttaaagagtatagtgctttctacttcaccttacacattgggctgggggctaagaaacctgggttctaattctgattataagcactgaacaagtcaagagaccccggtcttattttttatttcagcataaggaccttaagtaaatcaacctccttgaacctctgtttccatatctacaatatgcatgagttggcctagatgatttctaaggtcatttcagctctatgagcaaaaagtgacaggtggacattgttatctgagatgagctaatttaatttataacccaccactttcatctggcagagagctcatcctgagagtgcattttgatgggaggagagggaagttgtttagggctgctggggcccagcactgagagtttttgatatcaaggatcagtagcatgggtctccaaaggaaagatgaattttacctagggtccagcccagctttccacagtaattatcctagatgtgtcaacaacttcttactgaagattccttgcaagaagtggtctggtcaaagaggacctgccacctgtgtttgctttccattctatctaataccaaacctctcagagaagagacacatttctagaacccccgagtgtcctctgtcagtttctacacgtttcttcccagtatgaggtctttcaaattctgaagaaaacaatttggccaaggaatttgcacctcactaaattcaattcactacagcaaacattttttgaacacctgctgtgtgctcattgagttagtgggaaccagttgttttggaggtaaatgtttggtttcatttctaagttctgacttcagtatcaagaggcaaagactagacttactaaagtcaaagcaaagaacaacgaagtagttgagatttacagctatttgaaaaggaggtgaaggacttgttaagaagcgagtataagcactgagcaggaagttactaagcattatttctcaggagcattcaccttctgtctcacatcttattcacatcaacattccgggtaaattttgatctgtaccactgtcctcagtcagggttttctagaaagcaaccttcaagtttatgaagcagatgttaattttttttttttttttttttgagacagagtctcgttctgtctcccaggctggagtgcagtagtgcgatcttggctcactgcaacctctgcctcctaggttgaagcgattctcatgcctcagcctcctgaatagctgggattacaggcatgtgcaccacgtgcagctaatttttgtatttttagtagacatggaaaatgaaaaatgaaagtctttccacttatatttgtatatttgctctattatttgagaattttcaattctgcgttacaccatgttggccaggttggtcttgaactccttgcctcaagtgatccacccgccttggcctcccaaagtgctgggattacaggcatgagccactgcgcctggccacagatgttaaatttaatatcgcattaacatgtattttttcatggacaaattatgtgactatatgaaaacatggctgaacatgtattttcatatatttcacatggataatatatatattcagtatattagacagtttataaatgatcatttctcagtgcttcttaattcaatcctctctgcatttcagtaatcgttgactcaaatcacctatgctggctaggcagggtggctcacgcctgtaatcccagcactttgggaggccaaggcgagtggatcacctgaggtcaggaattcgaaaccagcctgaccaacatggtgaaaccccatctctactaaaaatataaaaattagctgggcgtggtggtgggcgcctgtaatcccaactactcaggaggcagaggcaggagaattacttgaacctgggaggcggaggttgcggtgagctgagatcgtgccactgcattccagcctgggtgacagaacgagactctgtctcaaaaaaaaaaaaaaaaaaaaaaaaaaatcacctatgaagcaattttcaacctttcttcttcagagacacatcacaaatgtgttcatatgtgtgatatacccccatatatccagaattatgtgcaattctaggagctcgacctgtaattccaaccctttaatctccatctaagaaatcatactgaaaaaaatattgttatgtatatacccttaaatttattccaattaatttaaaaaaaccaatgattatttattagtaagcagttatttgcaacatgctctgtttaggacatagcaatatattttgacacctttgttgatatgcacggtcctgatatgccacaagtataacatgaaatctaaattcttgaaggctaaggtgcttggcacagagaaccagagaaaggtaataagagagaaaagtgcacttattctctctgctgggcaactgtgagcttataactagttctccgagtctactaataagcatttaataagaatctactaatgagcacttttcttgatccataaagtcactattgacattccagcaaagtttcacggcctgcccccaatttgaagatttatttctctctttggatatagaacaaaataactttatgtacattttatttcactttattttactttattgggttggtgcaaaacaaattgcagttttcccatgaaaagtaatggcaaaaactgcaattactttcgcaccagcctaatattttattttgagacagagtcgcactctgttaccaaggctggagtgcagtggtgtcatcccaactcactacagcctctgcctcctgggttggagagattcttgtgcgtcagcttcatgtgtaactggaattacaggtgcacgccaccacgcccagctaatttttgtattttttgtagagatggggtttcgccatgttgccctggctgttctcaaactcctgacctcgagtgatctgcccacctcagcctcccaaagtactgggattatagacatgaaccaccgtgtctggctctttatgtgcatttttaatatgaagaggctatatagtatggtggctgagagcacaggttctagactagtggttctcaatcagagataattctgcctcacagtgaacatttggaaatgtctagagacatttttagttgtcatgtctgagagagggaagtgttactgacatctggtaggtggaagccaaggatgctgctaaacattctacaatggtttgggcacagtggctcatgcttgtaatcccagcactttcggaggctggggtgggagcatcacttgaagccagaagtttaagacaagcctgggcaacatagtgagtccctgtctctatcaaaaaaaaaaaaaaaaaaaattagccgggcatggtggtgcatgcttacagtcccagctccttggaaggttgaggtgggactatcatagacctaaagggaaaaaactaacaagcacaagatagggtatgttagccctaggagtttgaacctaggagtttcaggctgcagtgagccatgagtgtactactgcactcgaggttgggtgacagagtgagaccttgtctctggaaaaaaaaaaaaagcccaaaacactacaatgacaaggacattccccgacccccaccacgacaaagaattatctggccccaaatgccaatagtgctaaggttgagaaagcctgctctagagtcagcctgcctggggttcaagtcacttataatctgtgtagctgttggtaaattattttacatgtttgtgcttattgggtgtcttcaacaataaaattagaataaataataacaatactcactttattgattttctatgataataaaataaattacacaagaaaggagctaaggacaatgtctggaacaaagcaagtgctcaacaaatatttgcttttgctttcattatatgcattgaaaaaaaattgagaagaaatacaccaacattttaacagtgattgtttctaggtggcaagatcacaactgatttttattttcattatccttttatactgctttatattttccaaattttctagaatgatatttgtattactctaatatccaaaaacatgttttaaaagaatgcagataaaagaactttatttgtgatatagtaaaaagagcacagaattaaaaagacctggattcagatcctgactctacctgccgtctgtggacattgaataggtaagttaatctctttgagcttcagtttcctcagctaaaattggggctaataatgcatatcatagagagttgctatgagaattaaacatgacagacatgcagtgtctgggagagtataccaaaggaaaggctccaggagatgactgctttaaaggtttggccaagggaaaatgactccacaaacagggaaacatattcatgatggtaactgcccttttgccttttattttttgttttttgagatagggtcttgctttgtcacccaggctggagtgcagtggagtgatcaccgctcactgcaccctcaacctcccaggcccatgcaatcttcctacctccgtctcccgaggacctgggaccgcaggtgtgtgccaccacacccagctatttttgtagatctccctatgacttttttttttttgagacagagtcttgctctgtcacccaggctggagagcagtggcaccatctcagctcactgcaacctccacctaccgggttcaagcgattctcctgcctcagcctcccaagtagctgggattacaggcacctgccaccatacccagctaatttttgtatttttagtagagatggggtttcagcatgttggccaggctggcctagaactccggaccttaagtattctgcccccctcagcctcccaaacagctgggattacaggcgtgagcaaccatgcctggcctaaggtctccctatgtttaggctggtctcaaattcctgggctcaagcaatcctcccgccttagcctcccaaagtgctgggattacaggcgtgagttatggcactcagcctccctttttctttttaagccatcctctcagcacaactcccatgtcatccaattttttgccttggctgatggagaagaaactacgtccacactctggtccttctctctcctctcccctccctacatacaccctaggaagggatctgatcattcccctggcaggccctgactcatttggcagggtttacttgcaggcaagctgttgtgtccgaaaggcaggacccaggtatcactttctcatagtctttacccatgctcattgtccctcttcttatttctgctttcacccctcacctctaggttgaaatcatacttggcaaggcctctcctcaaggggaagcctctccactttctctccctctgttctatcctcccatttagctggttgagtaggttgcccccttttagactccagagggatgtgtaggaagcccagctaggcttccagatccatgcctcatgtgtgtgctagccctgcttatctgagaagccctgcatgtgtggggggcatgtagcacttgccagctggtttgtgcttccgtcagggctgttgtctgttttgtgcagctcgctcagcaggtaatgtttgaggtgagcagcatgagctggtagaattcaaggacacacactttatccacaaccccttaatgatttaattagatggaaaaatcatagattatgtttgtgtatattatcaggagggtgactactttaagccttactatcttgctaacttgaatttaaatcctgaccaagctttcaaaatgccccaggaaaatcttcttcattcaggacaatcttcttcaatcatgccatggtttgggaaaggtagtctgaccctaacccacactgatactcaagatcccagagttccctaggaaatagtcctgcagtcctgtgagctttctatacagagttctaaggactgggagtcagactggattaggagagaattgcctgaggcaggagttgacttctcaagacattcactctcaaactgaattaaactgtttcaacgctgggagatggaaccacccaaaacatcagaggaaaataagactgttaggggtgcttccatttagatatgaatgaaaatatcaggagaacttcattctaaatataaataaaaatgtcagggggattggtgatctccaggaaataatttatgtatactttctaaactgtaatttgtagctgctccagggccagcctaactatataaacttcaggcataattttgactgttgccaagttcttactacacatgtgtctcctcactgtcctctctataaatacatgcaaaataaaacaggcatggactcccaaattggcaccagcagaatatgtcattgttttgagtcttctcagtcttcattcacaagagtatattgagagttcaccataaaccaggcctggtgataagtgctagaaatccaaagaggaaaggataccatccctcaagaagctcacttcatgtgactataatagcatcaaagtgttacttgttccagaaaaatgtagatttcagcagggatcaaatgcttaagctaaaagactaaagttcaatattgtaggggacacaattacgtcttaaagtactgcgcaatgaaaccctgaagggaactggtaacttttcttagtttttccatagcttataggaatcagatcagtcatcttttattatcaaaggccagaaggaaatctacacagatcaaaaaaaggaaatctttatacctcagaaatttctagcagttaaaaaaagttattagcaaatctcctcttttacccttaaaaacctaaaataatttgcaaaagatacctattcccttattttaggtataatatcattttaaaaaataaatccagtcagtttgatattataatttatatacatagttttagaagtttttaatctattttattttgagaactaggtaggtgcttttaaagaaaatatgcttaggctggccttgctaggttctaggatggaagagtgtttctacgttcgattttttaaaaaacccatgatataattctagatttcttttttcttgagacatcaattggtcaccatagtaacatagcgttttactacagagatctatacagcacaagggaaacagaacggcaattacttactgggttacttgggggtacagaatgtgactacagggataatttaagattaaatatagatttctttggggatctgttttagcaaagcaagctgattcaatcttctagtagcgtcagctgaacaaaatttgaagccaaattgactgctgacatcatttgaaataatatgagcaggcaagcagcatagctcagtggttaagagcacaggctttggggtcaagtttcgtaggtccaaattctgcttctactgtttgctagctgtgtgaccttgggaaagttccctaacttctctgtgcctctgtttcttcatctctaaaatgtgggtaataaaaccttcctcaaagggttgttataaggattcaatgactgtttgtgcttagaacagtgccttgcacattagaaagaactttcttaagtatttgttaaataaagacaaaataaaatttaaaggggctcctctctttgtgctgaaaatagtcaaagacatgaaaatttgagttcacggctgattattttagcctgtaactttggtagattcctttgagaacttccccagggtcttgttgctagcatttctacaagatgtgaaattctgtggcagtctactgtcctaaatcagagctgggaacaatcacaagcacccctggttccaggaacatcagaaggaagatgatcacacagcacaaaggaacagcacgcctgcccacttcagctccccaagccctgccaataacctctgggaacatgggcatagaataagcagctgaaaaaggatgaaacagcttttattacagtgatgatgaaacctagttggtttcggtaattttttcccctctttccaggcttcaaggggaaaaaatccttttcatcaatgagtgctttgtttcattaattatcactatacacaatttccatccaatttttcaactgacacatactctgatgaattttcattttacagaactacctaggcatcttttctggactggtaacaaacctaaagcctctaaccagcatctaaggcaggacaaaatctccaaattgcctggaaaaaaagaaggcattatgtcctctgagccaaatttcagtcgcaataccaagggatccctatcacataccttcatccggacttgatttcagagacgttctctttagatcttcttggtcaggaatagcccttgcataggagtttggagaatgccataaaccaccaggaaagcctggaaacacattcatttctgtcctctgccttccccttggctcacagcctgcttcctgttagggagacaagatgacgctgtgcagggtagactgttaaaccatcttcccgcccccagccccactctcttgttgcccctcccttctcctttccaaggctctggaatgtgtcacatgggaaatggatcatgtggctgaaggggagaatgtggccatcttctccctcccttcccccacttttcctttcaggagcaaagcagcagaaatctctgtcttgattggctcagaccaaaaatctccatatgaaaaggggaagattcaatcacccaaacctccttccttctctattttcttttttttctatctgaagatttatcctgaccattcagagttgctcagtatgggagataaatgatgctttcttaacctcaacccctctctttctttcttacagtcagtatcctgacctggcaaggtgttccttaacctcccctctggatcccccttagcacacatctgggacaatggagcgttcagcaccacggacagcattacaccctcttcaagtgcttgttaaagccatttgtctatttcactctcaagtaaataaaaatattttttaaaatttccctgaggtcctgtgcctaaacataaaccacaccatatgtttagggctctgacttcccctactatcagcttactgttaccttataaacacaaacataattttcaaatttccttaaacccaaaagaccatcccatacctacctccctgtccccatcccatcacccatcctcactctttaaatatggtcttttttttttttttggtgggggggagggagattcctgtaacatagtttactgcatgcccaaatatctatgcttatggggaaaaccacagaaacacataggaattctggggtgtacaagtctagatgtcattagccccatccctaggcctcaggcagggctgaactggagaggcagggagggagcctgcttggagctgttttgtgcagggtctatcctgctttgctgacgtcctagttgccatggtgctaggtaactgctgaagaggatgatttcttttaaaaccggtcgccatgggagcctgctgactaaagaaaggaagagggaaaaggactgaattgctgaggagggatttaaacagtattctcagagccaaattggattgctgtcggtcctaaatcttgaaaggaatctaggaattagtatggacactgcaatagttactctccccatcctccactgcttctttccttaaaaatctagttaggtgcaactgaatgaaaattccagcttcacagattgaccctgaaatgccatcacagggtggtggaaagaactcaagaaatcaatttctcctcaggttagaatatctgacttttgggaagccattatctaagtcctaacagccttaattgggagatactttagagccacacctgactgtcgatgctaggaacaatgtgtggattctttataacactatggaagaaaagacaattttttaaatgtgagttgtcaaattattttaaataaatacaaattttattaatacttggatagcatttggattactccaagtcagaaatacaaactggctatacatttgtctcataacactggcatataacttgttgtttctaactcagaatcctaaccaaagcaattcagaatatttattttttgaaagacgaatgctgacttgcaatgtgtagaaatgaaaactttgtaagcaaagaggtggcacaaggaagctggagtataattttcaagaaactgaaggtccttcctggatcaacatcctcatcgtattttctacttttattttaggaggagtgaggttaattctagtttttctatgtaagactcagagaaattcaactgttaattttaacacttgacattttaagaaaattcatttatcaaaaaagttagatattgaagaaattctttgagtcagcaggttggtgacttggatatcatctcctctcttagtcaagaataattacaacaataagaacaactaatatttaacatgtgccaggtgtttacatacattatgtcatttaatcctatcaacccaacaagatgagtactattactggcatttctgttttaccgatgaagaaatggaggcttgggggaataagtaatgtgcccaaagctgcatagtgtgggagctaggatttggaaccactgactcagcctccagagcaggcatagtgtactatgctattctgcatcatgcatagtagactagattaaaataactggtcaatttaatgtgttgtgacttactactatggccccttgacataagaaatcacaaagattgctttaaattatttgagacaaaaaaaatgaccaacatatttattccttccaggatgactgcatgtatatattatggcttaatgatatttaaaatcatcttgtaaggagtcataacccaaaattttattaaggatggtcataaaacatgttacataatatactaattctgcttaaaatatattgccaaagttataatcaccaaatttacttttgacattggaagaagataaagaaacagttgtcttccatccaaatgcacaaaattccacaatacttgtgcaactggggtaatattttgaacatgagtaatgtgatcttctcatctgcctggggaatccatttgccttggagatagtgttttggcactgtttagatgttacaaaaggaatggaaaaaaagaaattaatatttggcttctgaaattcaaaatagaaacaagacaataggcttgaaatccaggctattgttttgaaagccagtctctaaattcctttatttctgcccttagcttgtcatcaaccaaacctggaagactttgctcagtgttctgtactatagacctctggcttcaggtaaaaactttccaaggggtcccaaagcatgcagagttttatgggaactaatttctagatcctcaacttctacaagtatgcattctaaaactgcttttctgagaactggtgcagtcgagatgtcatgctggttcttggtttccacttagcttttcttccatcttacacagattgctgaatctctcttccacctttacctcaaatcctgcgttgtctgaatttaaaaacctcctggggaccaaacacaggaataactgaaaatattggggatagtactgagaaagtgaatagctccaataattaggtaacaaatccttttaaaaatcaagagctttccaagtgctttcaacaaaattggaaacaaaccactacccagtggtccactgagaaattcattaaaatggttttcttaaaacaacgctcttaccaggcacggtggcatgtgcctgtggtcccagcaacacagaaggctgaggtgggagaatcgcttgcacccaggaggttgaggcttcagtgagctctgatagtgccactgcactctaatctgggagacagagctagactccgtctcttaaaaaaagaaagttcttctttacagaaaaatgctagttaataaatacagactactatagttagaacaccatttttgcaacccccagtgaaataattgactcaggaaaagatcacaaaaggtgttcaaagtataagatgaaaagttgttgaacgggttatttgtagattacttataaagtgcaaagggatgtgtgtcctttttcagtgaagagagtgggagggggggtcatcatcttaaccaagtgaccaaatttagcgttactaatagtgagacaagctgaaattatgtgcctaacatgaaatgatgtaacctactcaatgttactgaagtattctttctaaaaatgtttaacccgaatataatcaaatctgtacatataatgtcgagtttttttttttaataaaaaggcaagggttggagaaacaagttataagatattatgaggaaataattggccaaatcaagaatgcataatattctacaagagaactagcatggactcatcaaaaagtcaaatcatgaaataaaaggctgcctaccacagtgagttacctccatgttgagagcagtgctcagggtaagggatttctgccttgactccctttttgagacaactgcccaagtccctcaaacctcattccttgcatttctatggctgttcaggccaagtccacaatagcatggtcagacacagatatgacaatcaattattctaagcctttctgttctcttgaaggatgatgctgaactaacagccagtaggcctgccacaaccaagacaaggtaaccccacagcaggggccaggggtactgagtctgccaggggaggtggccaatactccctgggagatttgtctgaatccaaaggtgggccacgagttcaccatgagttcaccagctgcaggcttcagcatcacaggacagcatgttccccagggatcaggcagacaaggggtatgtattaggttgttcctgcattgcaatgaagaaatacctgagactgggtaatttataaagaaaagaggtttaattgtacacatttgcaggctgtacaggaggcatggtgcccacatctgctcagcttctgggtaggcctcagggagcttttacttatggcagaaagtaaaacagaagcttgcatgtcacatggcgaaagcaggaccaagagagagagttgggggtggtgccacacacttaatacagcagatcttaagagaattcactcactatagtaagaacagcaccaagacatgagggatctgtcccacgacccaaacacctcccaccaggccccacgtccaataccgggtattacaattcaacatgatatttggcagggacatatattcaaactgcatgagggtgtcatcctggaaacttgaaagtacctcagtgcatactctaggtccagaatgaagccaggaggtaccctctctctcatcagtgccacaaggatatgtaattatacccccacttccccccaaacaaatgaaagtcatctacagaaaaaagtgacaggacctctttgggaggtattatgaaagatgaaacatttcatccataggatactaatactatctaaaggaactgaatgaattgaactatatttgaaacaggattagacactttttttttttcctgtaacctaacaggttgtggtggttttaaaatacatccacaaattctttgatatgccttcaaagaatgcatctaaggtctggctgccacattagattttagatgtgaaacctaatccacctccccctgaatgtgggctagacttagttacttctttctaataaatagaatgtgacagaagtgattctgtgacagtttctacctggctctcaccttcttggattacttactctgggcaagccagctaccacgtcataaggaaactcaagctgccttgtgaagaggcccacacatagcaaaccgaggcttctcaccaaccagcaccaactagccaaccttgtgagtgagctgccttggaaggagattctccagccctagtcagtgaccatacccctagctaacatctcaactacagctttgtgagagacccgaagccagatggcctagttaagctgttcccaaattcctgatccacagaaactatgacataatgtttttgtttgtttgttttcttttttaagctctgttgaacttgatattattcttccaagatattaaactgtagggaattttgttatgcggtaatagatgactaataggtgaaaactctagacaaaataaaggacctacattttcatgagatatctgtagcgagttaaataagtgtctttgctatatatgtgtattcctaatgtggaagatacatggttttattaggacaaaaaacattaagaaggggagaacataattaggcacataacactgttgtctaaggagaaaaatgaatccccttaggttgagatggatttattatgactcagaggaagtgcagggaaatcaagaacaaaaagtggcagccagacgttagattagacaagggtcctgaaagtggtcagacccaaggtagctactgactctctttctctaggagaccacatggtctactgcctccaattctctctgtttcttcattagctgcattcaccagcttctcttgagatcaactagttctgcttgtcccttattgtattactggccccaaaatggctgcccctaaatggtggccttggatctgaaattcacatgtccttataaattcaatgcttctgtcagagtgacccagtctctcaatgttctgactctaaattcttaggaggcagagtctgtttgacccagcctaactcagatacagagccagatccaaacagctgggagaacaggatggagaagagttcccatactatcttctcagcactctctaaaaagggctgttggcaattttgcctttttgtaattctatttgagcaagttggaagtttaattagctttccaatcaaccaaatttctgcattcgagtcttaaccatatataagtgttactgtggcttcaaagaaaatatggattctgaagtagtgggttttgattgagttgactgtttttaaataactctttggattttaattgtgatgcagaagttatagtaacaaacatttggttttgtacagacattatttccacgctggtggataagctcaataaaggtcatatcccaaactaaaaaatataaaataaaataaaataaaaaataaaaaaataaaaagggctgttggtcaattttataaaaggcaaagtcaaacagagggaggaatgactgatagatgaaatgactggtctcttggtgcatctgtttctaaaattccgttaactttccagaatgagcctgccaatagctctggtctaaactcaacccctgtgacctccatttcacctccatttgagtcacctgctgaacaagcatgcccttcacactgcttgtattgcctccgtggcttagacttgacagtttctctgccttgtcctctttgtgaacatctactcctcttttcaaaccctgctgggttttatcttatctgtagttctatttctctcccactctgtatccttccaaaataagttagtcacattttccttttcaccatagtactttaattttcatatatactacttatacgattgcatatgtcatattgcattgacttcatagattcttgtaaggtggatgtcatccaattcatctttatacctctaggatctaaaacagcaaagtaggtgctcagcgacagtgtaccagcacactgaataagcatgacttttgagattaacctaaaaccacctaattttcattttccactgtccctttgaaaacacccttcaagggtgtctggttgcaaggctggttcttctcttatccctgaattaaaacttgggtggtcccattactttttctggtcatttttagttaagagatgttaataactaaaatatccagtcctatataacaatcaaaagttggcacctgacttagtttaggcatttctccctcctcccagtttgtgccttctgtagtagatttaacaaaacagtgtggccacttctcttttttcctgacttgtttccttagatcttgcccctcctagtttctgatccctccagggtttgagaggaggatgagcaatacgtcttactttgttggtactaacatgagctgccatcagtttccctgtacctcacaggtattaaagactgattccttatctcaatgggcacttacgtgggtttagggggacaaaactctacttctatgaatttttcaactatagctcctttgaccagctggccacttatctaactccagaaagacctttagcttttccctgctgaagtctattcctctctttgagtggtcatcttggtcaggtccagtgatgactcgctgctggcttctcttgtctttttttttgtaatattagccaggttaatggcggggttttgccatgttgcccagaccggtcttgaactcctgggcttaagcgatccttctgctttggtctcccaaagtgctaggattacaggcgtgagctactgcgcctgactcaaatttaatttcttgtaccccaaaaagaggcagaaagaaagacggactggataccctcatttatagaaccagaaccccatactggtacaatatgaaagtttctgaaaaaggtccaacaggtatttgatatccacaaagcacaaaagacctaattatagttgttttttttgtttttttttttctccaactgggcttaagcccctttctcctttgctttctgagcaaaagtactactggcctccagcagctgaaaaagcccttaagaaactgaagcattacttgtctttggctctagtcctggctcactctaacccataaaaacctttaaagacagagaccaatctgtctagcattcctatcggtcccaggaagattctctgtcactcatgtgtgcctgcttttcaagaaaaggaacccaattaaagacaggtaacttcatgtggcaaaagatattcttggccattatcactaccttttttgtcttatattcaataactaaagtagtatggtgatttcaacttctgagttatttataaacctagaaaccagaattgtcctactagcaagtaacttgtctcttagaagctgaaattgctgaccatgccacttgtattccaagtgattctgtgttccctgaaaggctacaaagacaggcttgaacctcacctttctcatctgttaataataacaaaaccacttgtgtggtcagagctgccacatcaaccctgataggctaccggaaaacacttcattatcaatgccctgctgcacatgcattcccatgtacagcagcctctcattggaaaagaacacacatttcaatcatgccttgatgccctccccaaccaatgaggtattgcaggttgtaaagatccgccccaacccactactgccatcagccctgctgatggcccaagattcaccatgtgtaatgcaataaagacatcattatctgtgttgcctgtgctagatcaaaagaccagcttgggagactgacactcttctatctctacagctaagcctgtgtatcctggcaattatactaatggctttatcaatgacctttcccaaattagtacgttaaccccattcttatcacagtggccttcctcctgaatagagctcatgatgccctacttatctgcctgtctcaagctctaaacttcattcctccaaacgtgttttccaaaacggagtcttgctctatcacctaggctggagtgcagtggcacgatctcggctgaccgcaacctctgcctcctgggtttaagcaattctcctgcctcagcctccggagtagttgggattacaagcgcgtgccaccacacccagctaatttttgtatttttagtagagatggggtttcaccatgttggccaggctggtctcaagctcctgacctcgtgatccccccgcctccgcctcccaaagtgctgggattacagacgtgagccaccgtgcctggccctagagggaactcttaaagcagtggctctcaacctttgttgcaaaatggagggttttaagaaagtactgatgtctgggctccactcgcagagattctgatttaattggtatagagaaaagccagggcattaggatttttttaagctcccaaggtgattctaatgtgtgggcatggtagagtacctgtcttttttttttttttttttttttttttttgagacggagtctcgctctgtcgcccaggctggagtgcagtggcgtgatctcggttcactgcaagctctgcctcccgggttcacgccattctcctgcctcagcctctggagtagctgggtctacaggtgcccaccaccacgcccggctaattttttgtatttttttttttttagtagagacggggtttcaccgtatttgccaggatggtctcgatctcctgacgttgtgatccgaccgcctcagcctcccaaagtgctgagattacaggcgtgagctaccgcgcctgacccggtagagtacctgtcttaaagctccctaaatacagacggacctacgatgcacagagcatccacaattcaactgataggtggcatgtactttacactaagttctatgctacctcattttgtcattacaataatcctatggcacaggcactattatccttattttataaattgagaaactgagattcagacaggacacacagagtgactggcagaccctaaagtcaaagcccaggtctgattcccaattgtacacactttatatgacatcatatcgagatgtcatgcctctcagagctggatgatcccactccctaaaacaagacacccaggcttcaaccctgaaatcctattccattgcctccatggatttttcctgcagcattttcctatgcacttcacacatacagcgcagctgccaggatatactttaggctgccaaaatgaaatgaagtcactttcttggtaagtgattaccatgcctggctctttactgaagtacttccattctatatattcacactgggatccttctccatcactgctagcttcaatcctgtggctttccatatttagtttttcttacagatgaagtgatactctttacctatcagccattcctttgttggagtaaaattacgtattccatcagcattcttctgccttgtactccagatagtatacaaagaatcaaattatagtagctaagtggcatagaattgctgccgatatcaagatggactctaatatctagtgaactgggaggctagaggctagaagtatgtacttctgtaaggtgtcagtgacacatctgagtaatgtggtagctaaatgccaccatttcattccatgaaatccacatttcattctggctaaagggtaaagctggtgagaggtgggaggggccaggaggctccatcggaaggaggcagacacttcaggtgttgggtggtacctttaagatgttgcggggccaaatccaatgccggtgcaggtgtcccatatatcctgagagacaaaaagaggtcagattggtcagatccctcgagacagttcccaaattcctgacttctgttaccgcgactgttcttcgcaattccacctcggcctgtgttcaggactgtggcttttagaatcttcctcattccattccattaggggcgtcccgatttccaccttatatacaccatgtactaaatgcatgccatttctgcctgtttacaaacatgcataagttcacactcttttaagaaaaatgtcctctactgtcaacttctttctagtctggcctcccaggtaggctacagagctactgccttcatttatctctcaaatcttcccatcttctccttcccactgtattaccttagctcacactcacatcctcttggtcaccagccaaaaaataaataaaactcctttgtcccttcagatttctctcttattctacaacctcattaatcggctctcccgctcccactcctttactacttcagtcgctgaaacctcccctcacagagttcacggccaatataaaaacggaaagaagggatgaccatacgagcttgtggacttttgcctgcaaaatctcatagaatgtggtgttgtgtacgtgaatccatcagatcaacgcgacggacactccccaagggccaaatcggaccgcctctcactaggcggaaag

SEQ ID NO: 299 - DNA, 5004 bp, Homo sapiens
  source 1..5004: mol_type = genomic DNA
cttcttcgtcagcctcccttccaccgccatattgggccactaaaaaaagggggctcgtcttttcggggtgtttttctccccctcccctgtccccgcttgctcacggctctgcgactccgacgccggcaaggtttggagagcggctgggttcgcgggacccgcgggcttgcacccgcccagactcggacgggctttgccaccctctccgcttgcctggtcccctctcctctccgccctcccgctcgccagtccatttgatcagcggagactcggcggccgggccggggcttccccgcagcccctgcgcgctcctagagctcgggccgtggctcgtcggggtctgtgtcttttggctccgagggcagtcgctgggcttccgagaggggttcgggctgcgtaggggcgctttgttttgttcggttttgtttttttgagagtgcgagagaggcggtcgtgcagacccgggagaaagatgtcaaacgtgcgagtgtctaacgggagccctagcctggagcggatggacgccaggcaggcggagcaccccaagccctcggcctgcaggaacctcttcggcccggtggaccacgaagagttaacccgggacttggagaagcactgcagagacatggaagaggcgagccagcgcaagtggaatttcgattttcagaatcacaaacccctagagggcaagtacgagtggcaagaggtggagaagggcagcttgcccgagttctactacagacccccgcggccccccaaaggtgcctgcaaggtgccggcgcaggagagccaggatgtcagcgggagccgcccggcggcgcctttaattggggctccggctaactctgaggacacgcatttggtggacccaaagactgatccgtcggacagccagacggggttagcggagcaatgcgcaggaataaggaagcgacctgcaaccgacggtaatgaccctttcccaaccatagaatgtgtttggggccccgctttgcctgctggagggtgttaaccttagcttgcttttcggcgtattctgatttagctttgggagagctaactttattggtcttaggtgttcagtgctacctggcccactgcttgtctgtttgtgacttttaagtcagaaactggagatggtaagatccgataatttccctaacttaatacatcgcggtccctctcactagcaactcctaggtatgtgacaaagttgggatgtttatcaacggtccgcctcctggctagggaaagagctctggggcggagaatgcactttctgttttttgaaaacaacctcattttgtgcccttaaaagccactggggatgacggatccaggattgtgggtggaggtagtgggtttttcatcccctgactatggggccaacttctgccagccattgttttttctaataaagattgtgtgttctttttaaaaatttcccctgcgcttagattcttctactcaaaacaaaagagccaacagaacagaagaaaatgtttcagacggttccccaaatgccggttctgtggagcagacgcccaagaagcctggcctcagaagacgtcaaacgtaaacagctcggtgggttgatcactaaaggagcacgcactggaacccggggccttcagacctcacgatacctgatcttactggttgctggcaaattaaaagcttatggggttttgttttgtttatacttcgtgaggtcaaaaaagtagcaatggggaaggctggggatacggtaattcctcagagtttctatgcccagagatactttctcttcaaactgttgaccagagcagctacttgtaacccaggccccatcgggtaggaaggtcgtttccctgtgagtcccactaaaacgtgttgggagcaataggttctttgcccatccgaacaagaactagggtactccctcagtccgaattaatgagaattaatttcctagaggttcagcttgagtcggtaacagattttgagccatacatggaaaaatggcaaatacatgattaagtttcaattttgagggggaatgtttggtagaaattgctcatctttggttatgcaagggattagagatgtgaataggatggtatgttgtgttctttgacattttaataaactgtcactttccctgttgtctcctaagtttggagagagaaggaaccagtatttgcaaaaaccaaatggaaagataaaaaagttactaaagtttctacagaatttctggtaacactgaagttgcaaagcagaagttaaattaactcttgtcagtaagcaatccaggaacacgtcagccagtgtatgctaattgtgccgtaacagggtgatttggatatttgtaggggaaatgggtagtaaatatcaagactggtgaccgtaggtcagcccagcacaaaggaagtggagatttttccatgcacaagaatctgatcactgtaaatagctaatttgaataattcagtccccagataaccaacatgggttggttattcataataaactacatattttaatagtttattagcttcctttagaccaagactgtgacctctttattttctaaagcacacacgtagtttagcatatgaggcgataaaatattgatgttaactttttaaatccccagttataaaaattttaaaataacagggattaaggtgagattcaggtttgttgtgtctttaaattgtatatgtgacttcacatatctttttcagcgcttatacaaaacggcactatagaacctccattttacagcaccatatgaagtgggaaaattaggtgaaaattttcctgaagcaaccttaacatgcgcagcccttgttggtttgtgacttgtggcctagctcatcagatgagccacgagaatcagacctggattttgatctggccctgttctgacatgcaatgaggcatttgtaggatttagtaatattgctagttcaaagaatactagaaatattagtaagaacctattcaaaagtattcatgagtattttctgcatatgaatcaggaattagaatattttgaaaatgatgttaataaaattttcctctggaaggcctttataatttttattcccaatcatttttcaaatttagaaagtttaatctgtcacaggagaaaaaaaattaaaaattttcaaaaatttagaaaatttttacccgtaagtattacagtttcctaattatcctatttatttcccacttgcctttgacctagattatttagagtagggtttctcagcctctgcactaatgacattttgggccgaataattctgttgtaggaggctgtcctgtgtgttttagattgtttggaattatccctggcctctcacactagatgccagcagtatcctcctcccccagtgtgacaacctaaaatgtctccagacattgccaaatgttccctgtggggcgggggcaacattgcctactgttaagaactactgctctagaccaaagaacacagcacagaggaaaggaaaaaaaaatccagttaagagaatgttaggtggagatgactatagtcatcaaacttttttccccatcaagtatttccaagctaacatagtgacaaaataattcctgtactctactggtaacgttaatctagtgctcttcctttaattcttccgttttgttttcttttgcagaattaagaatatgtttccttgtttatcagatacatcactgcttgatgaagcaaggaagatatacatgaaaattttaaaaatacatatcgctgacttcatggaatggacatcctgtataagcactgaaaaacaacaacacaataacactaaaattttaggcactcttaaatgatctgcctctaaaagcgttggatgtagcattatgcaattaggtttttccttatttgcttcattgtactacctgtgtatatagtttttaccttttatgtagcacataaactttggggaagggagggcagggtggggctgaggaactgacgtggagcggggtatgaagagcttgctttgatttacagcaagtagataaatatttgacttgcatgaagagaagcaattttggggaagggtttgaattgttttctttaaagatgtaatgtccctttcagagacagctgatacttcatttaaaaaaatcacaaaaatttgaacactggctaaagataattgctatttatttttacaagaagtttattctcatttgggagatctggtgatctcccaagctatctaaagtttgttagatagctgcatgtggcttttttaaaaaagcaacagaaacctatcctcactgccctccccagtctctcttaaagttggaatttaccagttaattactcagcagaatggtgatcactccaggtagtttggggcaaaaatccgaggtgcttgggagttttgaatgttaagaattgaccatctgcttttattaaatttgttgacaaaattttctcattttcttttcacttcgggctgtgtaaacacagtcaaaataattctaaatccctcgatatttttaaagatctgtaagtaacttcacattaaaaaatgaaatattttttaatttaaagcttactctgtccatttatccacaggaaagtgttatttttcaaggaaggttcatgtagagaaaagcacacttgtaggataagtgaaatggatactacatctttaaacagtatttcattgcctgtgtatggaaaaaccatttgaagtgtacctgtgtacataactctgtaaaaacactgaaaaattatactaacttatttatgttaaaagattttttttaatctagacaatatacaagccaaagtggcatgttttgtgcatttgtaaatgctgtgttgggtagaataggttttcccctcttttgttaaataatatggctatgcttaaaaggttgcatactgagccaagtataattttttgtaatgtgtgaaaaagatgccaattattgttacacattaagtaatcaataaagaaaacttccatagctatt

SEQ ID NO: 300 - DNA, 65549 bp, Homo sapiens
  source 1..65549: mol_type = genomic DNA
agtgtgcaggcaggcgggggtgcgcggggcggtcagcgatctgcagcttcgcggggacagagatgtaacccaactcgttcacggatgttccgcgcgccgtgtcaccggctgcgggccaggggtactcggaaggcgcgggcaggagcctggcgaggatgcaccttcccctgccttggaaaggtagaactggggagtgcgggagggtggaggtggcccggaaaagaacacctcttcgcaaccaaaaaaaaaaaaaaaaaaaaaaaagaggaaatagaggaaaaatgtgttatttcaaccgccactcagaacccatcataattcagccagtcggtgtcatttttattgaattaaattttaaaaaagttttctttgatttccagagcgtttttgcgggaggaatatgttaaaacaaactcaagatacgaaatgagacttttgaagtgcctttgatttctgggtacggaaattcttttgataaagcgtgtgtacgttaagatttaggatgactttttttttcttttttgtaatacaggtctaatggaaatgacattctttatgaattagaacccaattatgttttaaagtttataataagtcaaatgattctctcagtccctatgtccgtattagtgaaattctatctccatattagcgaaatttgcatagatacacacctttttctttttgtcttttagtcttgctgcagtgtatcggacgagtttaaccagatatccagcactagccttctaacagtttctaactcagtggtgacattttttagttcttaactcccccaatccttcttagcctaacaaacctcttaattaaggtccatgaaagaccataaaccaacctgattatgcctttagcaaggctgtgttcacttaatctctaatcccatatcataaaagtccgctagtcactcctgacctccaggaacccacctaaccagggtggacactataagaaaacatgtgttttaatggaatgagaacttttttgagttgaagacacgctagcctcaggaagcagtgagctcaccatccctggagtgtgagtcaagcactagtcttggatgaccccttgataggaacgttgtagacaagattcaaatatcaaatagtatttggactagtgatttcaaagtctattccagacccctgtgaaactgtatttccaaccttggcatttctggatttccactaaattaagccactttccttgctcattagcatcttgtagagctgtgtggctatttgagcgcttgaatgtggctagtccaaattgagatgtgctatatgagataaacaccacgtttccaagaattagtatgaagagaaaatgttaaatatttcattaataattttaatattgattacctattgaaataatattttgtcatattgggctaaataaaatatattattaaaatgaatttcatctattccattttacttttttagtggagttactagacaatttacagatgtgtctcaaattatatttctattggacattactgttcaagactatcacctgtggtaacttgaggccccatctttaaaagtggtgactattaatactgaggagtaggtggtaacttctagctgccatcctaacttctcaaattaaagtgagacccaaactcagcctctgaaagctttattatttatttatttatttattcttcttcttattttttttaaaagatagagtctccctgtcatccaggctggagtgcagtggtgtggtcatgtctcactgcaacctccaactcctgggctcatgcaatcctcccaactcagcctccagaatcactgcaattacatgtgtgctctgaaaccttttttttttttttttttaactttgtagagagtcttgctgcgttgcccaggctggtcttgaacttctggcctcaaatgattctcctgccttggcctcccaaagtgctgagatgacaggcatgagccaccatacctagcatctctgaaacctttaaatagaattctgccaacatctaacacctactgtttaatctttaattaattaattaattaatttttcttttaaagacaggtctcactctgtcacacaggctggagtgcagtgggcatgagcatggctcactgcagcctcaagctcctgggctcaggagatcctctacttcagcctcccatgtagctggactacagatgtgtgccaccacatccagcagttttttttttacttttgtagagatggggtcttgctatgttgaccaggctggtattgaatgcctgacttcaaggaatcctcacaccttggcctcccaaagtggtgggattacaggtgtgagccactgagcccagcctgtttaatacttaatgtagggttcaagcccagactatgggaatatagtatagatatgtctgatgaactcagacttggtcaccacagcttttcacattatggcaataggaagactggaggccggacacattggcttacacctgtaatccgcacactttgggaggctgaggcgggcagatcgcttgaactcaggagttctggaccagcctgggcaacatggtgaaaccccgtttctacaaaaaacaaaaaaaaatttaaccaggtgtggtggtgctgcctgtagtcccagctactcaggaagctgaggtgggaggattgcttgagcctggaaggctgaggttgcagtgagccgagatcatgccactgcatgctggcctgggcaacagtgagaccctgtctcaaaaaaaaaaaaaaaaaaaaaaaaaagagagagaaagaaaagaaagaaagagaaagattggaaactccaatatgttagttgtgactctgccaaaaaaaactatttagaccccacacaaaacctgcacaggcagagcctcactgcgactcttcaggagataggaagaaagtggggagacagagcagtatgctcattctaagattgggtctctagcagaagcctgcacaatgaaaaagtataccatattcttggatgggaacacccaacatgacaaagatggcagtcctccctaattcatctgcacctctttacactaaattctgataataggttctgatcatcctgtttcgttcctttgttgtagcagtctgtccactcaggaccataatataattactgtaaatttggaatatgtttgaattgctggtgggccgagtcctccacatctcgatgggtccctttactcctttttttcccccagaatgttcctgttttcttttgcttgccattttccccatgtggatttaaaatgaatttgtctagttttaaatataattctgtcggcattaaaaaaaaaaataaagtgggattcttatctcacacatcaggataaattcctgaagaattaaagaggatgaagtagaaagaaatgaaaccatagacatgcaaggagaaacctcaaaggatttttaaaaaaatctcagagttggggaaagactttctgagtacgacaataaacatagaattcataagatgtaatttttttttctttttggtagagacaggatctctctacgttgcctaggctggtcttgaacgcctggcctcaagtgatactcctgccttggtctccaaaagtgttgagattacagttgtgagccactgtgctcagctgggaggagctcttgcggccaggattttaagaccagcttggacaacgtagcaagacctgtttctaaaaaataaaaataaatagttaagctattctggaggctgaggcaaggggattgctctatcccaggagttcagggccgcagctcaggctacagtgagctatgattttactactgcactccagcctggcagctctaaaaaaataaaataataataataataatataaaaataatttaaaaagcaatggtttaaatggtaatttgtatcttacttgtatttaaccacaataaaaaagaatatacaactactgggacatttttttttgagaccaggtctcactctgttacctaggctggagtgcaatgactcattgcagcctcgacctcctgggctcaagtgatccccctgccttagcctcccaagtagctagggctgtaggtgcacaccaccatgcccagctaactttgtgtgtgtgtgtgtgtgtgtgtgtgtgtgtgtgtgtgtgtgtgtgtgtgtgagagagagagagagagagacagacaggttcttgctatgttgtccaggctggtattgaactcctagtctcaagtgatcttcctgccttagcctcccaaagtgctgaaattacaggcatgagccatcatgcctggctcactggaaaaatttaaagttcatccatggtatgtctaaaagaatctcacacagtgtactgggccatattatttgtgagatgctgtagtggttcaatttcaggctctggaatcctactgcctgggtttgagtccagttactgaactgccatttgcaagttacttcaccttttaaagattttatttcggccaggcatggtggctcacacctgtaatgccagcactttgggaggccagggcgggcagatcacttgaggtcaggaattggagaccagtctggacaacatggtgaaaccccatctctactaaaaatacaaaaattagccgggcgtggtggcaggcacctgtaatcccagctactggagaggctgaggcaggagaatcgcttgaacctgggaggcagaggttgcagtgagctgagatcatgccattgtgctccagcctgggggacgagattgagacttcctctaaaaaaaaaaaaaaaaaagaaagaaagaaaaaagttttttttttttttgtctatataatgaggatgcttataactctcatagggtattaaaagtattcgatggaataatgtatgtgttgtatttagcccaatacatggtatataataatgaccattacatatttgtaaacaatcaaattggccaggcacagtggctcacgcctgtaatcccagcactttgggaggccgaggcaggcggatcacaaggtcaggagatcgagaccatcttggctaacacggtgaaaccccgtctctactaaaaataaaaaaaattagccgggcgtggtggcgggcgcctgtagtcccagctactcgggaggctgaggcaggagaatggcgtgaacccgggaggcggagcttgcagtgggccgagatcgcaccactgcactccagcctgggcgacagagcaagacgccatctcaaaaaaacaaacaaacaaacaaacaaaaaatcaaattaatggggatatccagtttttattttgtcttctcccagtaaccacagccagtactatgttaaccttgtcaatatgtcttattatttttaattactgctgatactaccattaagaaaaacaaatattttaaattggcatttaataaagagaattagatatgcaaaaacagttaaaatggtaaattttatgtatttttaccacaataaaatctttttaaggcacttgttgaatttagtgtcacttccaatgatttctgaaaggacttggtatagatttatttgtggtaataaatcagtagcacatacacccacatacatatgcaatgacaaattgggaaaaatgtttgcaacccacatatcacagggttaatttccccaataaataaagagtttctacaaatccatgaagaaaacacaaaccagtagaaaaataagcaaaggatatgaacacagttatcggaaaagaaaatatgaaaggcttttaataaatgaaaacatgctcaattgtagactattgggatataaaccatatacagaatatataaatatagggaaattgaggcactcagatacaaagacggccattattctttcttgacagtttaatccttgcttccctcctttctacctaagggttagtgatatttttccagcttcattggtgaccaaagaagcaaagagtttgcatgcgtggaagccacgaccgtctttcaggttcagtgtaaaatccctcccatccaaataatgttatctttagcttagtggcatctccttactttgtacatagaaatcccccgaatcagcctcttaaggccagcacaactataagtatgtaagaggctgatgctctcaacacatccccatccattcctgcttttaagtttaatgcctgtacgttgctggtgataccagtctctccaaaaccatcaccttattctggcttttcgttcaagctctctattctcttttaaaagcctcatgaagagttgattacatgataaacataaattgtctaattagtagagagaaactatgctatgcaataaatggtgttaggttacagctaaccgtttggagaaaaatattaaatctcccttacatacacacacattttatatactgcgcatttaaaatgtatgtacttttcagctgggcgccgtgattgttaattactgctgttattaccgttaagaaaaataaatattttaaattggcatttaataaagagattcaaatatgcaaaaacagttaaaatggtttggtcttaatgtgttatggaaactttacacctgtaatcccaggactttgggaggctgaggcgagaggatcacttgaggtcaggagtttgagaccagcctggccaacatggcgaaaccccgtctctactaaaagtacaaaaattagccaggtgtggtggtgcatgcctgtgatcccatctacttgggaggctgaggcaggagaatcgcttaaacctgggaggcggaggttgaagtgagcagagattacactactgcactccactccagcctaggcaacagagtgagactctgtctcaaaaaaaaaaaaaaaagaaaagaaaaaagaaaaagaaaaagcatgtacttttctacgaatttaattttgagaaataatcagacgtatgactaaagatatatttatcaaagtaatcactataatgttaaatattagattttaaaaagaacaaaagagtaaacaaccaaataaaaaccctttagatgtagggttacagaattgattatttgattgaactaaccatagtatatgcaagaagggtacaaattatagccattaaaacaccctgggtagctttatatgtattaacagttatatatcttggctgggcagggtggctcatgcctgtaatcccagcactttgggagaccgagagaggcagatggataaagcccaggagtttgagaccagcctgggcaacgtggtgaaactccatctctacaaaaaacaccaaaaaaaaaaaaaaaattagctggatatggtggcacaggcctgtagtcacagctactcagaaggttgaggtaggaggatcacctaagaaaggaggtctagactgcagtgagctgtgatcacgccactgcactccagcctgggtggcagaacaagactgtctcaaaaaaaaaaaagttatatggcttaatgttaaagtttccatagcacattaagaccaaaagcaggcacagaacagtatctatggtatgaatgtatttttgtgaaaaatttaaaaattcacatgtatataggcatacaattgaaggttacccaccacattaacatctgtagttcctatttctgagggcaggattatgaagagactttcccttaaacatttatgtactgtttgcatttttaacagtagattttaacaaggaaaaaaccatgaaggtatttcaattttttttctttttttttgagacagagtttcgctctgttgccgaggctagagtgcagtggcacgatctcggctcactgcaaccttcgcctcctgggttcaagcaattctcctgcctcagcctcctgagtagctgggattacagatgagtgccaccacacccagctaattttttgtatttttagtagagacagggtttctccatgttggccaggttgatctcaaactcctgacctcaggtgatctgccctcctctgtcccccaaagtgttgggattacaggcgtgagccaccgcgcccagccggtatttcaaatttgaaataattatttttacaatttcttgaacatggaatcagagtttttatgtctcacatacggtctcattcttttcggacattagcagagcacaaggcatttctttaataatttttcctccatttttctatctaacttcagatgccattaaatctgtacatgagttatgaggagtgtatgcatgtttgtgtacatggtttggcttctggggcacataaatgaggtataaatattatccccattaactcaaggatatcttaacaaaccatggaaaattgaggttattccatctttttgccatatgggattttactggtaacatgatcccaaaactcacattccttgatctttggcacttggcacactcagggaatccgcctgggaattcaccagatcaactccctgccttagattagttacttaggacatagtgctgggaaaatagttttacatttcaagttagccgactaatctttggctgtccctctccatgtgactgacctggggcaaatcttagaatctcagaatattggctatgggagaccactgtatcgattctttccattttgcagatgagaatattctaattcttgatttcctgtaaagtggggaagttaaacgaagatgatttatagattccttctggcttacagctctgtgattcttgtttcctagtcaagatcacacattccatccctgtggatcaggttatttttcagggaagctagagtcctgatttttggccacaaaccacatattcagaatcaaaagaagatgatcttataatagcgtaggctgaacaataaacgtttataatctcactagaaaaaaagcacgtgaatgtgtaacctaatggttgcttagtagtgccagatattgctgcattgtcgcgtgcagtctctgggagcctttactaaggccaggctctgtgggcttcaaggtcacaaacaggagcgctggcctcctggagctccacaaggcgtcacagctgtaattattccatggaatttaggtgagtgttgtgaaggatgagtgccatgaagggacctcagagcttctgcttcatgctgtagcagtttggatcccagacaaggtgactaactgaggaagcaagcaggggctaaaatcgaaactctttccccaagccagcctgtgtttactgaaaagaaaagggcctttaaaaatccaccaacactccctttagctgagcagccacttatagtcccagctactcgggagtttgaggtggaaggatcccttgagcccaggagttccagtccacctgagcaacagaacaagaccccatctctaaaacaaacaaacaaacaaaataaaaaatgccattccatccccctcacctgcagtgccttcccctatgttccagtggctgcctgtaggatgctgtaagagtttgaaacaggggccctgacctagagcgagggttagagaatccctcctaaagaaatgactttcaagttgagacctggaagctgagcatgagttaaccagttgaaaggaggaaaggaaggagagtgagccaagcagaacacagtccaaggctgcaagtcagagaagagctttgaaagaatgtgcttgtggctggggggcagtgagccaatggcagaaggaatgagtgctgtggctggagtgatgggctttttaagccacattaggaattttggactttaagtgcaatgggaagccactggataatttaaaggtgacttggcaggcacagtggctgatgcctgcaatctcagtgctttgggaggccaaagtggattgcttgggaggccgaagaggatcattcgaggttaggcatcgaagacctgcctggacaatgtgaggcctcatttctacaataaataaataaataaataaataagccaggcatggtggtgagcacctgtagtcatacctacttgggaagctgaagcaggaggatcgcttgggcccaggaattcacagttttagtgagctataatccaccactgccactcaggcctgggtgacagagtgagatcttgtctctaaactaaaataaaataagctcacacctgtaatgtcagcactttgagaagctgaggcaggtggatcacttgaacccagcctgggtaccatggcaaaaccccatctctactaaaaatacaaacaactaggctgggagcagtggttcatgcctgtaatcccagcattttgggaggctgaggcgggtggatcactcaggagttcaagactggcctggccagcctggtgaaaccccgtctctactaaaaatacaaaaaattaggtgagcgtggtggtgtgtgcctgtaatcccagctactcgagaggctgaggcaggagaactgcttgaacccaggaggaggaggttgcggtgagccaagatcacgccactgcactccagcctgggcaataagagtgagagtctgtctcaaaaaaaacaaaacaaaacaaaaaaactagctgggcatggtggtgtgcacctgtagtcccagctacttgggaggctgaggtgggagaatcacctgagcctgggaggtcaaggctatagtgagccatgatcacgccactgcactccagcctgggtgacagactgagaccctgtctcaaaagaataaataaataaaataaaataagagagtgacttgagcagcttcaaataaattttattgtttcctcactttatctaatattaattgaaatccttagtcttatgttggggttatcccaataggacgtgggaaagaaagttcaagctttcgccttgatagttctccatgatgctgcttaacataaacaatcgagttttcaaaaaccaaaactcttgatttcattaagtaaggagggtgtaatgtgtagtgcttgggccgttagaggggatgtggtcacaagtggtatatctgaggcttttgaaggagtgcattcaaggaagagccctgcttggtgtcagctactgaaccagagatccgaagaagtggacctcgccagcctcctgctccaccccgctaccagtcttagctggagctcccttttctttgtcatactcagccagttgctcattgctgttttagagtctggcccatgttttgctctttggctgtgcgattggcgtgaatcttctaagcaaatgaatagcttagaggtgaatactgaatcttttgcttcaagtagctcagcatttttgtctttcatttttactaagtgactagattcagtattcgaagatgttttggccaaatgattcattatttatttggctttagaaagagacttcaaaaggataatagaaataaacaacccagaggttttttttttaaattgaagattaataaaagagagacctctgctggctacagtggggtaacaacctagagttggccactgactccacaggaagctataatggctgtgacccaccccatacgcttttacagttgtcagcaaattgatcactatttgttcacttcttcagcaatcaactcaagttcttttggagttcattgaagtgaggtataattcccagtccaatcaccactgtttctgtttcaatctttaggaaaagtattagtcttttatatttctcgaacataatagctttacatatgagcccctgccaaactgagacctgaaataattcctgcatcttaccttctctgtttcctttccccttttttgcctccacctctcctcctccccttctccagtaaaacaaaataaaacaaatctacactcaagagagagtactgatagaaagtgagaaggagggagctgggcgcttatctttggcatatcctcagctgaggatccaagctggggggcccagggttggtgttaactacctgagtagagctgtagttcctactgatgtcttccgtgggatttgttcaaccgtgggaatgtggctgcacgatagtggagcaagattcagtgaatgcttcagaatatggagggtcgttatctagggggaggaaggggactgaatgttctcttgagaccttttgttggcaacaacaataatgagtgcctactatgtgccaggccctggactaagtaccttaaataccttaattctgtttcctgcttttcttctctcttcacagtcttaagaatgtctttctatgagaaaaacattgaatatatgtaaagaacttacaacaaggcctgcataaagtagtagctatgcatgtgttcactattttattattatgtttttactctggaatatgctgccactcctacacatgaggagaggctctccccatactcaccagagcaagcaagtccttttttttttttttttttttaagacacatggagtcttgctctattgcccaggctgcagtgcagtggcatgatcatggctcactgcagcctcgacctcttgggctcaggcagtcctcctgcctcagcctcctgagtagctgggactgcaggtgtatgccaccacacctggctaattttaaattttttagagatggggtctcactatgttgccctggctggtcttgaactcctttgctcaagcagtcctcccaacttagcctcccaaatcattgggatgagaagcatgaaccactgtgcctggttaattacatagatatttacatatctactatcttaaaacggtgtccttttaagaatttcaaatgatgctttatagtttctaatatggtgcactgggtatactgttgatatttaaagttttgtgaatgataaatttccctacttcagtagtgccatagaattaattgattcttgtatctgaaatttaatgagtgcttatgaagtatgctggactgtgctaggttctgacagcatttgaaaagaagtttgacatctgcctgtctgtccccttttggctgcctatgaggtgtgtaagatggctgcaatttgaggaggcatcctttgttcctgaggatagaaggtgcattgtggagtagaaagatacaggaactataggcgatgccacaccaactctgtgccacttatctccagaattcctgtacagaaaagaaaagtacacttttatcttgtttaagccactatgatttctgggctctgttactagctgccaaatgcaaatcttaacagatacagaagtccttgaggatttttgagcaaggaactgactgtaaaactggtggctctgcaagggacagatttggggaggggggtgttctggagaatcctaagagataaagttggcttggtaggtggggacagatagtaggggagactgaatgcggagaatacacatcttgcacaggtcactgaattttgtttctttttcccaggacacctctgctaaactcctatttttaccgtggttatttaaatatgtggttattgaggaatttgtattctgctatcgtcaagtggcctgaaagccagggagatcgagaagatgagtgttctttgtgctttaaaaagaagcaggcaaaagctggaacgggaaagagtatcagtgttacagtgaagtgaagttactatgttttctgaactcctgcaagcattttcaaggaaaggaatgtttgttacaggtgattgtctaatcaagatacatttgaaatgtatcctttactggatagcaactgtaaacaatatttaaaaaatatatctcagagtgacttgcagagtaaagataatttcatatgctaaaatttctaaaaggagaaaaaccttttttattaactttaatgttcatataatcacattgagtaatggctatttttttcctagtgaacttttcattttaggttgggcaggtaattttatacctttaattacatgggtcttaaaaatatgatcctatagccataactgaatattataagcttgggtactttatgtttcatctttcattaaggagtatatttctcagatcctaccagatcctacttttttttttttttttttgagacagagtctcactctgtcacctaggctggagtgcagtggtgctatcttggcttactgtaacctctgcctcccaggttcaagcagttctccagcctcagcctcctgtgtagctgggactacaggtgtgcactgccacatccggctaattttttttttttttttgggatggagactcactctgttgcccaggccagagtacagtggtgtgatctcaggtcactgcaacctctgcctcccaggttcaagcgattctcctgcatcagcctcctgagtagttgggactacaggtgcgtgccactacgcctggctaattttttgtatgtttagtagagatggggtttcaccgtgttagccaggatggtcttgatctcctgacctcgtgatccgcctgcctcagcctcccaaagtgctgggattacaggtgtgagccaccacacccagcctaatttttgtatttttagcagagacggggtttcaccatattggccaggctggtcttgaactcctgacctcaggtgatctgctggccttggcctcccaaggtgctgggattacaggcatgagccactgtacccggccctcagatcttattttctatggacaccctactttgcttcagccctgaggtcccagctgccccattcaacatttttaccttccttttctgcattgtcctaacctttaggaaatctgaaccccagtagttgactgtcttctgaactaggtgaacctaatatcccaatctctctgtttccctaaaaatgggttggcaattctaaagttcctttcaaacctggttggacagataattataagccttaatgcaatgacaaatttcaaggtccctccaggcagtgactttcagccttccctctacacatggaaaggaatgtgcccagtattacctgaaaattcttactaggttttgcctcaaaacgtaatatttggaatctttttttataattttcccactacagactggagacaatccatatattactattaaaattgagttgcggctgggcacggtggctcacgcctgtaatcccagcactttgggaggctgaggcaggaggctattcagtattacctggaaatcagaatgccaattactcaataaccatgtatttaaatagccatgatgaaacaggaatttagcagaggttacctgggaaaaaaacaaacccattaattatgtctctcaaagtccttgtaccttttgtaacttttttgtacctcttaccaagaaaaaaaaaattgtatctccctacctttccctccccatttggaaaaagtaccctagaatgcaagagactgaacatcaggttgtaacctggactatctgttgcaaactgtcatactttttttacgaacttgaaacattttagagatagggtcttgctctgtcgccctggctggagggcagtggcaccatcataggtcactacagtctcaaactcctgggctcaagtgatcctcccatttcagcctcctgagtagctgaggctacaggcatgtgccaccacacccagctaatttagaacatttttctttttttgtagagacaaggtattgttatgttgtctaggctggtcttgaactcctgacctcaagcagtactcctgcctcagcctcccaaagtgctgaattacaggcatgagccattgtgcccggccccaacccagtttttattgcaacgtggattgtctacagtttatagtgtgaaaaagtataaaaaatgattcccaattttaggttttgagttatagctccctgaagttcctgggttgcattttgctacagtctgcacacaagaaaaacaaaacaaaacaagacacacagtctgatacgcagagagatgttctctctgtacagttatataataacaatagctaacatttgtggagcactcagtgtgtgctaagccactcatctacattgtttcctttaatcctgagattaaataaattctgagaagtagctgtaatgataaggaaactgagccttggagctgtagctcaacatcacacaaggcagctgagtctgggctcaaattcaggccttggggctgtcctgtcattcttataaataatctcaacaggaagaaggccagcaggctcagtgtgacactcgatcctaaattattctctttcactttctgcccgattaaaagaccatatggtaattaaatatttctggccagcaatgtcttgccatttattgaaaaataataccacaatatctctaataattgtttcattaaaaacaagaacagagccccagctatgtccggaatggctctaagaacatctttctacttctctgcaccttagtctctcctgaggcaagatggaaagaacaaaattacgaggttgctttggcaaaaaaaaaggaacaatggatattactttattaggactaggagccactttttatggcaggttgcaactgtcaaaggacattttagggtcgagaagcccccttgcaaaggacaaaagatgtccatggtaagaaaagcacggaaggcccaagggaaaagttttaaaatgagctttgcctctaagcctcctttgatgctcacctccatatcgattcaggcatttctcaaaggccaccttcttccaaggtagataagagggccctggtcggccgggcacggtggctcacgcctgtaatcccagcactttgggaggccgaggtgggtggatcacaaggtcaggagttcaagaccagcctggccaagatggtgaaaccctatctctactaaaaattcaaaaattagctgggtgtggtggcaggtgcctgtgatcccagctactcaggaggctgaggcagagaattgcttgaacctgggaggcggaggttccagtgagctgagatcgcgccactgcactccagcctgggcgacagagcaagactccatctaaaaaaaaaaaaaaaggccctggtcagggtctcactctgtcacccaggctggagtgcagtggcatgatctcggcttactgcagccttgacatccagggctcaaatgatcctctcacgtcagccttctgagtagctggaactacaggcatgtgacaccaccctggctaattttttgtagagataaggttttggcatgctgccctggtctcaaactcttgggctcaagtgatcctcccgccttggcctcccaaagtgttgggattacaggcgtgagccaccgcgccccgccatggtcaaaagctttatcttcgttaatcttggttgagctggtttcccacttcctatatcatttgcctgaaaggggagacccagcttactttggaggtaggtgtaggtagataagagccaagtgttgtttgctaatgtattgagtgagggatctcattaaaaggtcattttatttgtgcaatcaaagaactcctttggagcccagtatggtgtcacacacttgtattcctagctactaacgaggctgagatggagaatctcttgagcccagtcaatcactgatgccagcgtgggcaacatagtgagaccccatctttaaaaaaaaaaacaggtgtgattaatgttaagcaccttgagatgaggagagcggtttggattatccaggtgagcccaatctaacaaaataaatccttaaaagcaaaagcagagggcctttccatctgtggtcagaggaataggtgactatggaagagtggttgctccctttcccttgtccctgctttgttttctccacagcacttctcactctgtgggaggcacaagaatgcccccctccaaagagatacacatcctaatccccagagcctattaatatggtatgttatatggcaaaggggggattaaggttgcaaatggaattgtttgctgatttgctgactataaaattgggagagtatcttggattatccaggtggacccaatgtaatcacaagggtcctgaatcttggaagaggaaagcagaagagggattcagagtggtgtgacgtgagggcttagcttgctgttgctggcttcgaggatggaggaaaggggctaggagcccaggaatgcagcagcctccagaagctggaagaggcaaggtaaaggattctcccccagagcctccagaaacaaatgcagccttgctggcaccttgcttttagcccagtgagacccatgttagacttctagcacacagtactgcaagatattaaattgatgatggctgggcgtggtggctcatgcctgtaatcccaacactttgggaggctgaggctggtggatcacttgaggtcaggagtttgagaccagcctggggaacatagcaagactgcgtttctactaataaaaaattagcaaggaacggtgtgcacctgtagtcccagctactcgggaggctgaggcaggaggatcacttgagcctaggagatcaaggctgcagtgagctatgatggcaccactgtactccagcctgggcaatagagccagaccctgcttaaaaaaaaaaaaaaaaaatggctggctgtggtggctcaggtctgtaatcccagcactgtgggcggctgaggtgggcagatcacctgaggtcaggagttcgagaccagcctggctaacatggtgaaaccccatctctactaaaattacaaaaattaactgggcctggtggtgcacacctgtaatcccagctactcaggaggctgaggcaggagaatcgcttgaacctgggaggcggaggttgcagtgaacagagatcgcaccactgcactccatatcaaaaaacaaagaactgcttggtttctgatttctcagctctcaactctaggcaggtgatttatttgtccacttaagagatgggaattggacactgccgctgggatcagttctgatcctgactataaatttccggggtgctctgccttagaacttggtttattgcctattaagctgctttcctgttgcctgtgctcagtgtctgtctggctcctggcctcctcttgccaggtgatttggcctcattctgaacctgttttatgtagagtgtctgtctgcccgacttcatggggcagatcacagaacaagatccctgtgccacgatctgctttcccttcaccaaatatcactatgaacttgtgcctacctggatcccatacttgcttcaccctgacaaagctttttcttctctctacttctggcctgctttgaatttattgttttatgcctgtgtgttagagggaaaaatgtattaaaataatgtactggcaatacctcccttcctgtctaaaaaaagtgaatgctttgtgtactcatctccctagagggcctttgttgaattaagcagggtgattggctgtgaggagaattaaaaggcagagagaagaccaaattgctctacccaacacaaaatgaggagatatttgaaagagaattttacaaggagaagactgaagaaggccgggcgaggtggcacacgcctgtaatcccagtactttgggaagttgaggcgggtggatcacctgaggtcaggagttcgtgaccagcctggccactaaactctactaaaaatacaaaaactagctgggcctggtggcaggtgcttgtaatcctagctactctggaggctgaggctggagaatcggttgaatcagggaggtggaagttgcggtgggccaatatcgtgccactgcgctccagcctatgcaatagagcgagactgtctcagaaaagaaaagactgaagagaagaggaaggagacataagtgagctgtacaatttttgagcaaagaaagaaacccaaagaatattttaatggaaagcttcctatattgcgtgtagtgtaacattctctttgcctctctaagcatccagtacacgttgaatttgtggtagattaggtgtattaagtgctgagattggcctcaaggcaagggcaggatgactcagaatagcacaaatagtttcaggtgggaagggggaggaaaaagggaagcaaaaggcaaggaaaatgccaagtggtcttgcctacagcagatctttcagcccgcatgcttgctctgtacttggaattctctagaaaggttgcaagaagaagctgcactccagagtagtctgagaaagggatcaggaagagggcatttatctgccagctccctcctgtctccattttttgtggctgaggttcacactacttagcagagctaaatcccctgaatgccatgtggtgtcatctggcagctccgtgatcactcaggaaattaattttacgccttgcagtgtggctatttcatccgagtctggaagtgaggagtgaccaagagagaacaaaaggaagggtggtgggaatccaagaaggcttaaaacgtatgtctctgtagttgagaaaaggttttacttaaatcctgttccaggccgggtgcagtggctcacgcctgtaatcccagcacttcgggaagccgaggcgggtgggtcacctgaggtcaggagttcgagaccaacctggccaacatggtgaaaccctgtctctacataaaatacaaacattagctgcgtgtggtggcagatgcctgtaatcccagctactcaggaggctgaggcaggagaatcgcttgaacctgggagacggaggttgcagtgagccgagatcgcaccactgcactccagcctgggcaacaagagtgaaactccatctcaaataaataaataaataaatacataaatacatacatacatattgctccaaatggtgaacatgtgcatgactacgtgtatgaactctgatgtcttcataaagaattttaaaaaactattggaaaacatgggaaaacatgctctaattttttttaaatttcatattcagggaggtacatgcacaggttgtacatgggtatattgcatgatgctgaggcttgggtttctggatgatcctattgcccaagtagtgaacgtagtacctgataggtagcttttcagcccttctctcttcttcttcccccttccctccttctggagtgcccagtgtctattcttatttttatgtctgtgtgtacccaatgtttagcactcgcttataagtgagaatatgtggcatttggttttctgttcctgcgttaatttgcttaggttaatggtccccagctacaccaatgttgctgcaaatgacatgatttcattcttttttatggctgcatattctctaatgttaattgataatgccagataaatcttcagacttctagattataatcatggaaccaggtagcgacttccgccttactttttaagttatttaattacccatgtaataatacatatatatttttttctagagacagtctcgctttgtcacccaggctggagtgcagtggtgccattatagctcactgtagcttcgaattcttggactcaagcaatcctcccacatcggcctcctaaagcactgggattactgtgtgaactaccgtgtctagcccacgtctcttactagttaaaaaaacaaaaaacaaaacctgtcattccaggtgaagggagttgctttagtgtaacacctggcttttctctgccttttcctaactctgctcctgagctgtgatttaattggcaaatttggggaaaataaagtgagcatgctcagcttatcctgtccactttcccctttggaatccagccagcatgaggcctgctgtaggggcaggctgacactctggtcgccagggaggcaagtctactttggaccagaactgctagatctcattccgcagcttggtattgggaagctcttctgactctcagatttaaactgcatcctgcaacccagtcctatcaggaataaactaataatttgatcctctccctccattcctttatcttatttcttagttggctgtaaaatttaaaaaggaggaggggtgctttttattgggcccttcttgcaacatttggttcattggctaaaaaattgaaatgtaagaaaaaaggaaggagcacaattagggagaagcaagtgaacacacatggagtgattgaggcttctggagtggtgagggattggccttggcgctgggtcttgttcttggtatgtgtgccggacatgttaatcttggcagtttgtataggcttatattgggctaggtaggtttttgtggtggtgcattagtgcttaaaagccatggcctggggaaaactttggaaaagtcattcagaggctgtagcagggccttgacaagggcatggggctgtcagagggcctaagtggggactggcaggctgaagagcgttaataagcagtcacagctgatgcaaggattcaattataggaggaaagaaacaatcttttcatatactatccttttagatattaagagagtgaaaaaaatatctgctgtttttaaaccatggagcagctgggttctctatggaccacggagcattagtgagagattggcttccaatgtgttagcacgaggtaatgtaaacaaacagtccaagttttaattcctcttttatgttgttttgcactatccttaagggcaagagagggcaaggtggaggggctaagtttgacttcatgtggctcaagaatcagtccctctacttgttctcaaggttgctagaaactggttgcttagattttctctttctttcttagcatgataaagtatcaaacaatatttttttgtgaatttttaaaaccgatacataatgcttgtggatatttctgggatgcatgtgatattttgatacatgcatacaatgtgtgatgatcagcaccacctcaaacacttatcatttttttgggaacattccaaatctttcttctagctattttgaaatatataattatgggtttttttttttaggcctaaggaattccacagaaaaagataatgggaaaagccactgtggcacaggaaaaaaatgtttacttggtattgtgggagccctcttactaggcagaagttcacttccattgcagcactgcagtgcaggcacctaaagatcaaaggggacgtggaaatataaaggctttgaatatctgggtaagaaagaacagctcctctcaaataagatgtgatgactgaagatattgccatttcatatttctaaactttacaagaaggcagcatcctctcaaatactctgagacaggagaaagtactcagagggggatcttcccagatgtggtaagtgtgaggtgcacagtgctgaaattaacctgtgaccaggagatttctactaactgggtttaaattcacaggccatggggtctgtactcttggcattgatcaagtggcattttggtgaggctgcagtctctgcaacagtctttgggcacccaaagcactgattctgggtatgcgattctgcttgagctacctgctaggaattggcttattttatgaagatggctgggatagagccagtgctatgatcattttacatgttctgttaaatctatagattctttagaaaaaagtacatcccagactaggctgatattgaggcaggagaatagggtctggaaacagggaacctaaggtcatttcacgctaactttctagaactaaatttaaagaaaaaccctaacattccacgcctaagtaacaaaaggaccagaggctactccctttgcaaacccccaccttttctgcccagcagatgggcaattggctgtcagcaaccaatcagactgattgcaggcagagtcttagtttccatagaagtgcaactttgtaacttcaccttaacctctgattggttgctttttgcagccaattagttgtttgcacaggagtgtgacgttggtaacttcagcctctaattggtggctttccgccaccaatcagagcaactgcggaccaccactttatttacatgaggtgaccaccaagtggcccatgggaaacctgtagggggtatttggacccaacagaattctgtaacccgggtttttgagccgctgctcaggccgctcccacactgtggagtgtactttcgttttcaataaatccctgctttcattctttagttgcttcattctttctttgttttgctgggcattttgtccaattatttgttcaaaacgccaagaacttggacaacttgcagtcaagaccctctactagtaacaatattatcattattttttgacttggaggccctgaaggaaatgcccccattccaatgaaatacagcttaagctgtacttgtcaaaagatccctgactgtacccccacactgaaatcccttccggtagagacaaagcataataagaaattgggaaagatggccgggcgcggtggctcacgcctgtaatcccagcattttgcgaggccgaggcgggcggatcacctgaggttgggagttcgagaccggcctgaccaacatggagaaaccctgtctctactaaaaatacaaaattaactgggtgtggtggcacatggcagtaatcccagctacctgggaggctgaggcaggagaatcgcttgaacccgggagacggaggttgcagtgaaccaagatcgggccattgcatttcagcctggtcaacaagagtgagactctgtctcaaaaaaaaaaaaaaaaaaaaaaggaaattggggaagatacattttggacttctttgaattttaacccacacatgtaagataattttattttgaacttcactttcttttatctttaatgtctcatgattttgacttataaggagatggatttcatttcttggacattaatttctccctagaaacttgataaagggaggagatttatgttaaagtatattttttctcaatattattggtattttcttattgagttttttttgcgcatattattggagtgtagtatacttttgtcatgtaatctcattgttgatcctctgatatgtggacagtatggataaacataataaaaattagtaatagaaaaatggagttaagccttggatacagaatgtcactgaaccttttttttttgtttgttttgagacagggtcttactctgtcacccaggctggagtgcaatggcgtgatcacagttcactgcagccttgacctcctgggctgaagcgatcctcccacctcagcctcgcaagtagctgggactataggcatgggctactgcacctggctaattttttttttttttttggttgtcttttggtagagatgggatttcaccatgttgccccagctgttgttgaactcctgggctcaagcaatccacttgccttagcctcccaaattgtcaggatcacaggtgtgagccaccacgcctggcccctgaaatattaatgtgttatagtgaactattttggaaccttatgtgagcaaaatcgccattgcctaccagggttcctggaaaggtacaaagtagggtggtatgagagggaagggtaacgtcatgaaggtggggcaaggatggtcctcacaggctgtcaagatgctgtctggaggatgtcagccacacctctggctggcataggctgaatggttaaaccaatgtcttaagagaaaaaacatcgagagaatattagtgggaaatgattcttttttgttttgagacagagtcttgctctgttaacccaagctagagtgcagtggtgtaaatgtggctcactacaacttctacctcccgagctcaagggatcctcttgccttagcctcccaaatagctgggactacaggggcgttcaaccatgccccactaatttttaaattttcagaagagacaaggcattgctatgttacccaggctggtctgaaactcctggcctcgaatgatccacccaccttggcctaccaaagtgctaggactataggcgtgagccagcacgcccacccaggagtgactcttaggcaacctcgatattaccttctgtgataggctgaataatgggcccccaagtatgttcacatcctaattctcagaatctgtgagtatgttatatggcaaaaggaactttgcagatgtgattaagttgaggatcttgagataagagaggttaccttgtgtgtccaatataatccattgatctctataagaaggacagaggaagagtcagtaaaataaagtgatgtgacggcagaagcagattggaatgatgagctttggagatggaggaagaagccgtaagtcaaggaatacagtccagtagaaactgaaaaggcaagaaaacattctcccctcagaggcttcagaaggaaccagtccctctgacaccttgactttacccctaatgaaatggattttggatttctgacctcaagagctattgagaataaatttgttttctaagcatctatatttgtggtaattttttacagtggaaagaagagaccttctataagaaggaacttgattttatctcctgtgtttttggacagggtaatttaatctgactggtaaattctagaataataaactgaacatgattggcttagtctccttctctttgttctttgggagccagtcaagcccaagaaagcacaagttctacttcttgcagggtaggatgctacccatatgatgagatgtgccccactcagtgctgctggacctgggtggctaattaagttcatgtaactgtggttcagtattagcatttggctttcatgttaagctatattctcctgtagttttaatcagaatacagtgatattttgacctccacagaccacttcttggacttatctctttgctcatcactcaggcatgacaaaatggtgactttgaggataatggattgaacaaaaatgatacaatctcttgtagctcccaatttctataagtagtggagaaaatttaaaaaaaaaatcacaactgcattggaaacaagaaatttccaggaaccagaaactatgacaaatccctaaatgacataggatcaggtgaaggaggtaagccacagttaaaactagaacagtagactattgctgcaaaatatagcggacactaagaatactccttgccccaaagtggtggatagcagtgacaggaagttcaaaggtaactaatagattgactaattcaggtaccacagtaggactatctagatggttcaattgctgcttgctatcccttctctatctgtttagccaggtaatagtgatgagtggtatctatctccactcaagaaaaatgggtaggagggtgatgataagataaggcagtgcccaacccccagtgtctggcaatacctgggaggaggggggtgcactcacgttggaacactagccaccaaggtatgaccagtgctacatcccatcctccctcacaataggctaaaaaaatagatgtgacatacatctaaaaggacattgcctctgtaaagatgagtgacaaatcaagaatggatgaactttaaagaaggctaacatgaaagagagacaagaaactcaatagacgataaaacttccatctgagaaaatgaattaacacagcaagaagattaggtcttttcaataagtatgacttgtatcattaaagaaatgtgaaagggtaatatacatatgtataagaataaattagatattgtggaaatttgaatgattgttgaaataatttaatagaagggggttgggtgtgatggctcatgcccgtaatcccaaaactttgggaggccaaggaaggatagcttgaggctaggagtttgagaccagcctgggcaacatggcgagactacgtcactacaaaaaaataataaaaaaaatttagccaggcatggtggtgtgtgcctgtaatcccagctactccagaggctgaggtgggaggatcgtttgagcccaggaggtcgaggtggtagcagtgagctgtggatcacaccactgcactccagccagggccacagagtgaaaccctgcctcaaaaaagttccagaaagaaagaaatatgagtagggaagagaggcagtgcatttaaataattcgaagaattatttaatctcaggcttagtttctgagatggaaagaaactacaaagtccctacaaatagcacgaaatttgtgaatagaaaagataaagagaaaagccttaaaatcttccagaggaaaaaaccagaaggaaggagaatcaaattgaaatcagacttcttatcagtgatattgtattaaaaaatatcagtgtgagtcaggtgtggtggctcatgcctgtaatcccagcgctttggaaggctgaggtgggcggatcacctgaggtcaggagtttgagaccagcctggccaacatggtgaaactttgtctgtactaaaaatacaaaaattaactgggcgcctgtaatcccagctacttgggaggctgaggcaggaggctcactcgaacccaagaggtggaggctgcagtgagccgagattgtgccactgcactccagcatgggcgacagagtgagactctgtctcaaaaaaaaaaggaaaaagaaaaaaagaaaaaaacatcagtgcaatgaagcaatgaaatgtttgtagttttgagagacagtaactcagcctcccaaagtggtgggattgtcccagcctcccaaagcactgggattacaaacatgagccaccacacctggccaacaataacttttaatttaggattctgttagacccaatcaaatataataaaaagagaagggcctttcctaccagacatctacctttatttttatttatttatttagagacggagtcttgctctgtcacccaggctggagtgcagtggcacaatctcggctcactgcaacctctgcctcctgggctgaagcgattctcctgccacagcctccaagtagctgtgactacctggctaatttttgtatttttagtagagacggggttttaccatgttgtccaggctggtcttgaactcctgacctccagtgatctgcccacctgagcaccccaaagtgctgggattacaggcgtgagtcaccatgcctggccgaaatctatctttaatatgaagttattggctggacatggtggctcacacctgtaatcccaggactttgagaggctgaggagggaacatcgcttgaggccagcagtttgagaccagcctgggaaacatagtgagacctttgtctctcaaaaaaaaaaaaaaaaaaaaattagccaagcatggtggcacacacctgtggtcctagctactcgggaggctgaggtgggaggatcgtttgagcccaggagttcaaggctgcagtgagccatgatcagccactgcactccagtctgggcgacagagtgaggccctctctcaaaaaaacaaaaaatgaagttattgttattaaaacagtgtgatataagtgcaagaatagataattagacatttggaacagaatagggagctcagaaacagactcactcatatatgaaaactttatttgtataaaatcaacactccatacctgtaggaaaaagatacattagtctatcagtagtgctgggacaattcgttatatataatgagatccctagctcacttcatataacaaaaacaaatttcacagaaggattcaaaatgaacagcaatttttagcaaaaaaaaaggataatatttttatggtcttgcgtagggcaaaaggaagccctatacccaaaccgtaaaggaaaagattgataatttcagttatattaagatgaaaaaatgtctgcttattaaaaggcatcataaaaagtgagaagttacaatctgaaagaagatattggtaacaaatataacccacaataattagtatccagattatatgaagaactccaaactgcaacatcagctgggcgtggtggctcacccttgtaatcccagcactttccaaggccaaggcaggtggattgcttaagctcaggagttcaggaccagcctggacaacatggagaaacttcatctctaccaaaaatacaaaaaattagctggacgtggtggcacatgcctgtgtctcagctactccagaggctgagatgggaggatcacttgaggccaagaggtggaggttgcagtgagccgaaattgcgccactgcgctctaaccagggcaaaagagtgagactctgtctcaaaataaacaaacaaaaaacataaaacctaaaaaactgcaacgtcaatccttccctgagtttctagcctgccagcctgctctagacatttcagacttgctcctggcacaattgtgtcagccaattccttaaactaaacctttctctctctatataagtctatatcctattagttctgtttctctggagaaccctgactaatccaagtcagaagaatgaagtctggtagcaactgggagactctgagtggagagaagtgaaaagatccactgtcagatgaaggcagacccgtgggtgaagaatcatattgaagaatcctctgttagatgaaaaagcccacgtgactgcatggattttggtttatgttgttgtgtttttaaccttctgttaatgccagcaatcgatttttccagatttctctttgagttctttttcgagaatagctgctttactgtagagtacagaattagacccgtttgggttttcatcagcagccttcagatctgctgctccgcatgcctctttatgaacgctggcaccttttaaggataattctaggccatcttaatctcttttaatttggttaatcttttcaagaatttttgcattttctttcagtttggtaaattgtatagtgaattccctttccttcctctatggattttttgtattttaaaaaattgtggtaaacataacataaatttattattttactgttttaaccacttttaagcaatttctcattgttgtgcaaccatcaccactatccatttctagaacttttaaaaaatcccaaacagaagcttgtacccattaaacactaggttcctattctcttctcccctgtcccctggaaacctctattctactttctgtctctataaagttgtctagtctaggtacctaatataagtggaaccatataatatttttcctttctatagctgctttttttctttttttttgagatagagtcttgctctattgcccaggctggagtgcaatggcacgatctcggctcactgcaacctccacctaccgggttcaagtgattctcctgcctctgtctccagagtagctgggattacaggcgcccaccaccagggccagctaatttttgtatttttagtagagacagggttttgccattttggccaggctagtctcaaactcctgaccttaggtgatccacccgcctcagcctcccaaagtgctaggattacaggtgtgagccactgtgcctggcctacagctgctttttaactgaagaaaaacttctccaaaacaagaactataaaaaatatccaataactcttgcccttaccatcatctccaaagagatttgaagagattggactcaggctcatgttttcaggccatgatcttgcaggtgtctccaggagaagcctgaagctcagttctgaggcagtcacaatgcttttggtgagcccaagttcaccacagacctgcctctgggggtatcggcccactgaaccacaacagaccacccatctcattccacaatgttcagctaaccccgcatgacagctgggacagcaggctcagggctcagagaggcacattgaagaaccagtccagcccatgctttaaaaagtaataactcattttacttaactttttaaactgaaacataaaacacagattcataaaactatgagataaattattgtaaagagaacatctttgtgactgccaatcagatcaagaactagaacgttgtcagccacccccgaaagcccctctatgtgtcccatccaatttcaaccctcttccatctcccaaaagtaaccgctttcttgccttttttttctttaaaaaaaaaatcattttattgagaggtaattcacgtaacatacaattcacttatttaaggggtacaattcaatggcttttggcttatttacagagttgtgcaacaccctcctgagttttatagcatttccttgtatccactggtatctgtagtttcaggcacccactgaaggtcttggaacatatgcctcatagataagggggaactgctgtaactggtcacttttgaaggatggaaagcaactaaagcaactaattcaatatctttttttttttttttttttttgagacagagtcttgctctgtcgccaggtgcgatcttggctcactgcaacctctgcctcccgggttcaagtgattctcctgcctcagcctcccaagtagctgggactacaggcacccaccaccgtgatgcctggctttttttctttttttttttaattttagtagagacggggtttcactgtgttagccaggatgttctccatctcctgacctcgtgatctgcccaccttggcctcccaaagtgctgggattacaggtgtgaaccaccacgcctgaactaattcaattatcttaaaaactggtaaagtgccgggtgcagtggctcatgcctgtaatcccagcactttgggagcccgaggcaggtggatcacgaggtcaggagttcgagaccagcctggtcaacatggtgaaaccttgtccgtactaaaaatacaaaaattacctgggcctggtggtgcatgcctgtaatcccggctattaaggagtctgaggcaagagaatcgcttgaacctgggaggcggaggttgcagtgagccaagattgcaccactgcactccagcctcagcaacagagcaagactgtctcagaagcaaaacaaaacaaatcaaaacaaaaactcggtaaacaaagggacagagccagcatttttcctgcctttcctattgaatgaacagaaacattcaatttatccatccgtaaatgtgatgccttttccacttcaactaagcacttacgtattgtggccttaacttttgcagtttgagatgcaacagcaaaactagcatgatttctttttccttcttcacagtgtcaccgatagagtcattcttaaccacagatcttagcaatctcggcatatgatttcttttctttccttattgagaaccttcaccttttcatttaaagggaacactttacagcttctctttggcatatatgaattgccagagtcactattcttgtactttggggccattaggaagtaaaatagggtgacttgaatacaagcactgtgatatcgtcacagccaatctgataaccaagaaggttactaagtgactaatgggcagggagcgcctacagtgtggttcagctggacaaaaggaggactcacatcctgtgcgggagggagcaggatggcacgagatttcatcacgctactcaaatggcatgcaatttaaaacttatgaattgtttatttctggaattgtccatttaatattttcagactgtggttgaccgaatgtaactgaaacaacgaaaagggaaaccatagagaaaggggagctgctatagttgttttttttaaaccattatgaacacatggatttaaatatctttgaagggtttcattctatcgtaattattatccttaatgaagctcaagttgtcccatcttggccaaaattgcctcttgtgtccccttggcagaactgtagttgtctttgttagcttccttgctatcttgtatgacaagatgctataaagtatatcactgacttttggtaggatgtgatattgacttaggaatagacaaatatgttgatggaaataaggaatgggataattcataaggttatgcaatagatatctgtttttgttgttgttgttgttgctgctgccggcatttatcgcacttcctacaaggacagtttcacaaaatttatttgagatattactcttcattcatttagccttattgaagtgtgttgaagggactgaccccgtctgcagctcgggctgccttgacgtcagtatatccagttaccctgttgggagtgactagtttataaatgggcatggccagagccaacgggagatgagaagacattcactgggacttctaggaaagacattaggataattggccttccatttggaggaagatgctaaatttctacttcttaccattggcaaatattaatagaagtgaaattaaaaccctagaagagtctatgattattagaagaggcagaaaggcaaaaagccatattgatagattgataatttgattacatgatgtcggaactatacaacaccatgaaaaaaattaagacaagcaactgaatagaagtagacatgttatatacataacaaaaaacttgtgtccagctcatgcctgtcatcccagcacttttggaagccaaggcaggcggatcacttgagcctaggagttcgagaccagcctgggcaacatgacgaaaccccctctttacaaatgatacaaaaattaaccaccacacccacagtcccagttactcaggaggctgagatgggaggatcacttgagcctgggaggcagaggctgcagtgagccatgatcgtgccactgtactccagcctgggtgacacagtgagacccggtctcacaacaaacaaacaaacaaacaaaaaccttggccgggtgcagtggctcacgcctgtaatcccagcagtttgggaggccgaagtgggcagatcacctgagggcaggagttcgagaccagcctgcccaacatgtcaaaaccccgtctttactaaaaatacaaaaaattagccgggcgtggttctgggcgcctataatcccagctacttgggaggctgaggcaggagaatcacttgaaactgggaggcagaggttgcagtgagccgagatagtgccattgcactccagcctgggtgacaaaagcgaaactctgtctcaaaaaaaaaaaaaaaacaaccaacaaccaaacaaccaaacaaacaaaacccttatgtccataccacagtaaaccttctatatgtggataagaaaaaaggcaaatcaatagaaatatgtgcaaaatatatgaatagatcatttacatataaggatctgaaagggcaacccccttccccaacatatgaaagttactctacctctctaatagtcagtaaagcacattttaaaacttggtacatagtaggatataccaaagtttaaccattcccctactggtggaaagttagatcatttaaaacttattattacatacaatgctcattgaagatgtgtcttgcctctttggaacatattcgtgcttttgagatgttaaaccttataacctaaacctagaatgtgatagcaaacatcttggtgtctgcgtcctgaatagaagttatatattatgtgaacatacactaaaatttagcatcagagtgttctttgaattgtatttttaatcatgtgcttaatctaatacacttgggaactactggaacttttgctggtcagattagttcaaacagttagaaattgttctctttccttgaaataaagctgattgaaggattatgttgtctgaatagctgtaggattcagaaactcctttataaagacttactttatttttaggtttaaaaatatccatgatttcttttggattaatggtctaaacatgcttatttgactaaagccttacttttttatttatcatggctatagcttgtttgttgttcattagttgtaagtgtgttccagggagaggaaattgtttaatctctactcagtagggaaagaaaatatttatcaaattcaaaatatgtatgccttttgttcaagcaatttcaatttgaggagtcttccctacagaaatactcataagcatatacacacacacatactcacacacaaggatgttcactgcaccattgtttctaatatataattcagttgaaaatatgataaatgtctatcaacaaaggaatgaattagcaaatcatgacctgtccctaaaatgagtgacagccacatgtatcaccttggaaaaatgtctgtatatgagagggtgctggaagggaacagaactcacccccaaatggtttgaatgaacatatatatatacatgaacatatacatatatgtatatgtatagagagagagagagagagagagagagagagagtcttgctctgtcacccaggcctaagtgcagtggtgtgatcatagctcactgcaaccttcaactcctgagtttaagcaatcctattgacccagcctcccaagtagctgggactacaggtgtgcaccaccaccatgcctggctaattttttgaatttctttttgtagaggtgggatcttgctatgttgcccaggctgcaaatgaagacatttttaaggaagagtttacttacagaggttaggtgccaagcaaacaaagaagggatggtgaagtgcctagagactagcaatggtggaaagtgatgcccattcctaaggcctcaggtacaaaggagagggcatagcacagtaggagcccagtgaaatttggaaccatggaggcagggccacccagggagttatagctaaggatggagacagccactgcaaaagacagagctgatgcaggtaggaaacaaggaaggaataccctgactttttaaaattaattaatttattttttatttttttccgagatggagtcttgctctgccactcagagctagaatgcaatggcactatctcggctcactgcaacctctgcctcccaggttcaagcaattctcctgcctcagcctctcgaggagctgggattatagacgcgcaccaccacacccagctaatttttgtatttttagtagagatggggtttcaccatgttagctaggctggtcttgaactcctgacctcgtgatccatccacctcagcctcccaaagtactgggattacaggtgtgagccaccacgcccagccttaccctgacttttttccttttattctctgatattttgctgcagagacctctgcagtgacctttgattggctgaacccactcggaaacatttggcatgggagcctgagtaaagtggtccactggccagagagaaaggacaaatatggcccatgaagatagagaatgactagcatgatgttttgagggtatttttggttttgaaatcaattagcctgggcgccgtagctcacacctgtaaccccagcactttgggaggctgaggcaagaggatttcttgatctcaggagttgaagaccagcctgggcaacatagtaagaccctgtctctaaaagaaaaattttaaaagccgggtgtagtagtcccagctactccagaggctgagatgggaggattgcttgagcctgagaagcagaggctgcagtgagtcatgatttcactctagtctgggtgacagagcaagaccctgtctcaagaaaaaaaattatttttaattgacaataaaagttgtatatactcattgtgcacagcatgatgtttagatatatgtgtgcattgtgagatggctaaatcaagctaattaacatattcattacctcacatttttttttgtatgcggcgagaacatttaaaaactaccctcttaacaattcctaagtacaattatccccccatatccaagaaaaattggttccgggacaccctgtgaattccaaaatttggggaatgttcaagtaccttattaaaaaaagtgtagtatttgtgtataacctatgcacatcttccaatatatagttggcttttgttatctgtgggttctgcatctgtggattcaaccaaccagaaattgaaaatattgtgtgtggggggggggaaaacaatacaacaataaaaaataatacaaataaaaagcaatgaagtataataactatgtagcatttgcattctatcaggtattataagtaatctggagatgatttaaaggatagggaggatgtacataggttatatgcaaacgctataccattttatatgggactttagcatcctcgcatttctgtatctacagggggtcctggaaccaatcccccacttatatgagggggatgtctatactttaaatcatctctagattacctataataccttatataatatgtgttatataaatggttgttatactatctttttaagtttgtattatttttaagttttttttcccaaatatttttgatatgagattggtagaatcatggatggaaaacctgaggatccagaggactgactatatatagcacattatttttatttatttatttatttatttattgagatggagtttcactctgtcacccaggctggagtgcagtggtgtgatctcggctcactgcaacctctgcctcccgggttcaaacagttctcatgcctcagcctcccaagtagctgggattgcaggtgcctgccaccatgtccggctaatttttgtatttttagtagtgacagggtttcgccatgttgggcagggtagtcttgaactcctggcctcaggtgatccacccatctcggcctcccaaagtgctgggattacaggcatgagccaccgtgtctggctacagtacattattaactatagttaccatgttgtacaaaagatctgttgaatgtattccccctaaatgaaattttatatgctttgaccaatatctccccaattctccctgatgatgtttatgttatgttttttaagtggaaaaaaagttgcatagcaatatataatatgctatttttgtaaaagaaaaccacaaccacatatgtgaaatgcacatggttgtataaacatcagcattatgtaagaacacatagcaaactataaacctcagtattacctctagagggtgaaaacagatggagaaggatttatttctaactttctatattttaatttttataatatattttctatttctactaggtgtgggctttattggttgatttctcggtgagtgcgtttccaagtgtgaagggacccttcctgtagtgtcttatatacaatacagtaggaatgttccttctttgccactcatacacctttatgtgcatctcacatggtgttcttccccaggtggatgtgattctccatgccagtgaagagtaaggaaggccacagcatggtatggggatagaataaactctgctgggctaacaaataaaccctgaactctcaatggcttaatgcaataaagatttgtttcttattcatgctgatgttcctggcctgagagttcaccagagcagctcttctctaagcagcaaattcagggatcagggcttctcccatcctgtgcatctgccatcttggaaccttcatttccagccatgtagaggaagagagaaggagcctgagagactgggagaggagttttatgcaagggagtgctgggaaatgtagtcttcctggttctgcaggctgtataagaggcaaagaccagcatctgcttctgatgaagggctcaggaagcctccaatcatgatggaaggtgaagaggaaccagagaggaaggaatgaaagtttcattttaaaaattagagatgaggtcttgctatgttgcccaggctggactcgaactcctggggtcaagtgatcctcccaccccagcctcctgagtagctggaactacagtctcatatcaccacacccggctcaatatatttttatattatagaaatttgttataagaattatgcattttttgtgattaaatgaataaagataaactatattttgcataaaaagaaagcactgttacacttaaggcgaagacaaaggtaagaaaacccctaaatggttattaaacatttaattcacttaagggcactgcagagaggaaacacttttagaaatctatgttaattctgttaacattaaagccaaagtgtaggctgggcatggtggctcaggcctgtaatcccagcactttgggaggccaaggtgggaggattgcttgagcccaggaattcaagaccagcctgggcaacatggtgaaaccccatctctacaaaaaatcaaaaattagctgggtgtggtggcacaaacctatagtcccagcttctcaggaggctgaggtattaggatctcttgagcctggtaggttgaggctgcagtgagccacgagtgcaccactgtcgtccagtctgagcaacagagtgaggtgctgtctcaaaaacacccaaaaaacaacaagaacaaaatgtcaaagtcaaagagtagatcttctgtgctctagtgttggttaggatcctctgttgcaaagatcagaaatcaagtcactcaaggaataaaaggggagttgaaaaaataggaatatatgaatggctcataaaatggaatgatggcaggaaataaaagttaagactctctgtttgcctctcaggaccttatctcttaattttctccagtaaacaaaacaaactttctctgctcttgggggaatataatgggaataatatggctgcttcacagatcctgagttccatatttcagttccagtcattgagaagactgcctcaactctctttaggtccatattccaaaatcttgaaagaatttgattggcaaatttggtttggatgtctacctttagtccaattagctatagtcagtgggcaggatcatgtaatatagtaccaagatactggaatattttaaatggagataaagagatgttgtcaggttaaggtgggggccataagttcccaagctgcctactacagttgcacaaaggacaaagaatattatagattgatgagctaaaaatcacttttgcattgccccacagctaaaaaatttaaaaagagatttctgagagagccataaaaaggcaatagtaaaacactgatataaaatcagctggggccagacagggtgactgacacctgtaatctcagcactttgagaggctgaggttatctgcctggatcacctaaggtcaggagtttgagaccagcctggccaacatggcgaaaccctgaccctactaaaaatacaaaaattagctgagtgtggtggcacgtgcctgtaatcccaattactcaggaggctgaggcaggagaatcgcttgaacccgggaggtggaggttgcagtgagccaagagcacactccaacctgggtgacagagtgaaactatgtctcaaaaacaaaaaacaacaaaacaaactaaaacaacaaaacaaaacaaataaacagaaaaaaagaattagctggtaaatcagctggcatatactatcagaataataaataagagttggccccctgggctgggtgcagtggctcatgcctgtaatctcagcagtttgggaggccaaggtgggtggatcaccggaggtcaggagttcgagaccagcctaacaaatatggtgaaacctcatctctattaaaaatacaaaaatcagccgggtgtggtggtgcatgcctatagtcccagctactcaggaggctgaggcaggagaattgcttgaatttgggaggtggaggttgcagtgtgccaagaccacgccagtgcactccagcttgggtgacagagcaagattccgtctccacaaaataaataagagttggccctctgtatttgtgagttctgcatttgtgaattaaaccaaccactgattggagttattcagaaaaattaaaaacaaccgtacaataataaaaataatacacattaaaaaattggccaggtgcggtggctcacacctgtaatcccagcactttgggaggccgaggtgggtgggtcacttgaggtcaagaggttgaaagtagcctggccaatggggcaaaacccatctctactaaaaatagaaaaattagatgggtgtgggggcccgcgcctataatttcagctactcgtgaagctgaagcatgagaattgcttgaacccgggaggcggaggttgcagtgagatcgtgccactgcactccagcctgggctacagagggagactatgtctcaaaacaaaacaaaaacaaaaacaaaactagtataacaactatttacatagcacttacattgtattaggtattatatgtaatttatagatgatttaaagtacatgaaaggaggtgagtaggttatacgcaaatcctatgccttttttttttgacggagtctcactctgtcactcgggctggagtgtagtggtgtgatctcggctcactgaaacctccgcctcctgggttcaagtgattcttctgcctcagcctcccgagtagctgggactacaggcacgtgccaccatgactggctaatttttttatttttagtagagacgggggtttcaccatattggtcaggctggtcttgaactcctgacctcgggatctgcctgcctcggcatcccaaagtgctgggattacaggtgtaagccaccgtgcccggcctactatgcaattttatacaaggatcttgaacttctgtggattttggtatctgtggggagtcctcaaaccaaactcccatggatgctgagggacaactgtacaaatattgaacaattgaaaaggtcacagataactagatgtaaaaaatagttactggcttgaaaaaaggtaagaatacctgataattgcaccacattgtgtaggtctcacagggtttccatattccctttccaatataataaataaaaccttgtaaaagcaattgaggctgagtgcagtggctcatgcctgtaatcccagcactttgggaggctgaggcaggaagatcatttgagtccaggagttcgagaccagactgggaaacctagggagtcccaatctctacagaaaattaaaaacaaaacaaaacaaaacaaaaaaaccaaccaggtgtcatgcacctgtggagtcccagctactcaggaggttgagttggaaagattgcttgagaccaggaattcaaggtggcagtaagcgctaatcacgccactgcactccagcctgggcaacacagcaagacctcatctcttaaattaaaaaaaaaaaaaagcaattgagtctcaataagtcaagtcacttgcttgaagtcacacacaaaccacagacttaggactcaaactcctcgttttcactttatgtgcagaggcctaacttatagaaaatgcctcctacctttttcaaaggtagtttacttttttttttttagcattgaaagtaaaggcagaaatgacttttaaagtgctacattttcagggaaaaaaagtggattaggaacattagtttccattctggcatgtaaggagctcagaagtcactactcctggctgggcaccgtagctcatgcctgcaatcccagcactttgggaggctgaggcaaaaggattacttgagcccaggagttcaagaccagctggagcaacgtggcaaaaccccatctttaccaactatacaaaaattagccagtcgtggtggcacatgcctgtagtcccagttacttgggaggctgaggtggaaggatcacttgagcctaggcaattaaggctgcagtgggccatgattataccactgcactacagcctgggcaacagagcaagacctccagctaaaaaaaaaaaaaaaaaaaaaaaagtcaccactccatcttagcaagtaaaaagctgagtaaactgaaaaatcaacagctcttcttagatccataagagatgggaggtcatagagtaaaccccaaattggaaacacaggtgaatgcagataatcacaacttaattactggagcagaaatcttcatgggaatcagtgctggagtgggaaaacctgaactgtaattgacaaattgctggaggcttggtgtggacaagtctgtgagataaaaactttattgggaggctcccacacttttgtagttttacctccaggggctctactaggttctcacagtgaattttgcaaacgatcctctcatgcttccaacaaggggagaggaaaaggaaccatcttgaaatgccctagagcattctgttcttaagaacaaggtcttccctcaggagaaattacttaactggagcctaacctgctggggttttataacagcctaactgatctgggggaagggaaatacccaactccagcctagtctagctatgttgtcccacctaaggagagggggagactgagaagcacctgtgaagttcacagtccagagacataggctcactaaaagactgagacctaattatcggactgtagaatgcttcctttccctccacaccttgccaccacattactaaagtcctatttacagtagtttctttagcccaaaacatcatgcctggctatcaagaaaaaattacaaagtatactaaaaggcaaaaaaacatagtttgaagagacaaagcaagcatcagaaccagatgctctggataaagtagacagcatgcaagaacaggtaggcaatgtaagcagagaaatggaaactataaaaagaaccaaaagaaatgttagagaggccgggggcggtggctcacgtctgtaatcccagcactttgggaggccgaggcgggcagatcacgaagtcagttcaagaccagcctgacaagcatggtgaaacctcgtctgtactaaaaatacaaaaattagccgggcatggtggcacatgcctgtaaccccagctactcaggaggctgaggcaagagaatcgcttgaacccaggaggcagaggttgcactgagccgaaatcgtgcctttgcactacagcctgggtgacagagcgagacttcatctcaaaaacaacaacaaaatgttagagataaaaaacactgcaatagaaatgaaaaatgtctttgacgtgcttattagtatactaaacatgctgaggaaaaaatcgctgtttgaggatatctcaagagaaacctcccaaactgaaaaacaaagagaaaaaaagactgaaaaaaaaaaaaaagcaacaacagaaaagaatatccaggaactgtaggacaactacaaaaggtataagtgtgtaatgagaataccagaaggagaagaaagagaatacagaataaatatttgaaacaatagtgattgagaatttccccaagccagtgtcagacaccaaatcacagatccagaaagctcagagaacaccaataagaatacatgttaaaaaaaaaaaaaactctacacctaggtatatcatatttacactacagaaaatttaagataaagaaaaaatccatatagaaaccagaggtttaaaaaatcttatagagaagaaaagaattacatccaacttctcctcagacagtatgcaagcaagaagagagtggagtcaaatatttaatgtgttgagagaaaaaaatcccaccaacctagaattctgtacgctgtgaaatcatcctttaaaagtggcacagaaataaaggtcttctcagacaaacaaaaattgggggaatttgttgccttgcaagaaatagtaaaagaatttccttagaaaaaagaaagagtatataggtcagaaactcagatatacattaagaaggaaagaacatccgagtcagtgaagataaaattttaaaaactttatttttcttatttttaattgctctaacagataacatttttttttcagagctttgggggaatttattagagcagattttgtgtatgaaaaaggtgctgggcttttatctaccattagcaggtgtcatgcctggtggcccccttatggccatcagtttgttggccagactgcaatggctacaatagccataagcagcaacaaaatcatcattattatcccacaagaggttgactttctgtccaccatgttcaaatgcctggtttcagtgcaaagtttttcatctgtgttttccagcaaattggcagagatgttaattatctcattttgtccatccaattcattcccaatttcctgccccatttgtttttggcaacttatgatggaggaaatggcatcgaggcctgtgtcctgttctttgataattttctgcttgctattgtcagagttcattgaaacccaagcctcttgtctcctctggctcctcaaagagccaagggttgggcacttcctaacagataacagtttgttcaaaataataatagcaataatgttctagattatatattgcatatatatagctatgtatatttatgtataagtgaaacaaatgaccacaatgatacaaaagatgtgagagagaaattaggattatttctttattataaggtactcacactaactgtgaagtggtatggcatattcaaaagtgactcagattcattgtaaatgtatattgcaaactctggggcaatcatttaaaaaggttagaaaaaaaagaagcataactgatatgctaaaaaatgagaaaaaaataatttatatgaaacgctcaattgtaacaacaaaaggcaaaagagaaaaagagtgaaagataaaaataagaacaaagaacaagaacaacaaatagaaaacaataaaaaatatagtagatgttaaccaaaccgtattaacaatcactttgaatgtcagtggtctaaattcaccagttaaaagaaagagattgtcagactggatcaaaaaacaagacccaactatatgttgtatataagaaacccactttaaatataaagacacatataaacgggtagagaaagatacaccctgacaacactaatcaaaagaaagcagaattagctatgcttatgtcagacagaacagacttcagagcaaggaaagtgggaagaaagagggacattacatagtgataaaggggtcaattctccaagaagacataacaatcctttacccagtgtatgcacctaacaacggagtgtcaaaatttgtgaagcaaaaactgacagaactggaaggataaataaatgaatccactattataactggagacttcaacatccctctctcaggaacggacagatccagtaggcagaaaatcagtagggcatagttgaactcaacaccaccatcaatcaactggatgtaattgacatctatagatgactttattaaacagtagcaggttacatgttcttctcaaagtcatataaaacatttacccacatagaccacattctgggctataaaatacaacttaacaacatttaaaagaatgaaaataatgtaatgtctactctcagaccacaatgaaattaaactagatattaataacagaaaggtagttggaaaatcccaatatacttggagattgaacaatacaattttatttgtttattcttctcaagagaaaattaaaatattttaaactaaatgaaaatgaaagccaggcatggtggtgcactcctgtagtgctactcgagaggctgaggtgggaggatcacttgagcccaggagttcgaggttatagtaagttatgatcgcaccactgcactccagcctgagcatcagagtgatatcctgtctctaaaaaagaaaaaaaaattatatgaaaaacacaacttaccaaatttgtgggatgcagtaaaagcagtgcttacagggaaatttttgtagcattgaatgcgtatatttgaaaagaagaaagatctaaaaatcaataatctaagcttccaccttaggaatctagaaaaagaagaacaaattaagtctaaactaagtagaagtggccagttatggtgtctcacacctgtaatcccagcactttgggagggtgaagtgggaagattgcttgaggccaggagttcaagaaccagggtgggcaacatagtgagacttagtctctacaaataaattaaaaaattaaccaggcatgatggtgtatgcctgtagtccagctacctaggaggctgaagtgggagaatcacttgaacccaagagtttgaggttacagtgagctatgattgcatcactgtactccagcctaggtgacagaccgtgtctgttaaataaataaatgaaaagtaggagaaaagattataaaaatcagaggagaaatcaatgaaattaaaaataggaaatcaaaatctggttctttgaaatgattaataaaatcaatgaacctcttcccgacttaatacttcctataaagctacaataatcaagacagtgtggtattggtgaaagactagaaaaacagaccgatagaatagaatggagagccccaaagtgaacccacataaatatagacaattgacctttgacaaaggagcaaaagcaagacaatggcgcaaagatagtctttcaacaaatggtgctggaaacctgacatccacatgcagaaaaaaatgagtctagacacagatcttacactcttcacaaaaatcaacctaaaatgggtcacagacctaagagtaaaacataaaactataaaattcctagaagataacaggaaaaaaatctagatgaccctggacttggtgattacttttcagatacaacatcaaaggcacaatccatgaaagaaagaattggtaaactggactttattaaaattaaaaaatgttactctgcaaaagacactgtgaattgaatgaaaaggcaagccacagactggaagaaaatatttgcaaaagacatatttgataaaggactgttatccaaaatatacaaagaactcttaaaactcaacaataagaagaaaaagaacctggacgggtgtggtggctcatacctgtaatcctagcactttgggaggccgaagagggtgaatcactttgggtcaggagtttgagaccagcctggccaacatggtgaaaccccgtctctaccaaaaactacaaaaattatctgggtatggtggtgtgtgcttgtaatcccagctactcgggaggctgaggcaggagaatggcttgaacccagaaggcagaggttgcagtgagctaagatcacactgctgcactctggcctgggtgacacagcgagactctaactccaaaaaaaaaaaaaaaaaaaaaaaaaaaagaaagaaaagaaaagtaaagaaaagaaaagaaagaaaacaaggaacctgaacaaaaaatgggccaatgaccttaacaggcacctcaccaaagaagatattggtggtaaataaatatatgaaaagacgtcccaaatcatatgtcatcagggaatgcaaatcacaacagcaatgaggtaccattacatattgattagaatggccaaaatctagaactgacgatactaaattccctgatgaggatgtggagcagcagaaactctccttcatttctggtgggaatttgaaatggtatgatgagtttggaagacagtttggcagtttcttacaaaactaaacatactctcgtcataagatccagcagtcatgtgccttggtatttacccaaaggaattgaaaacttatgtccacacaaaaagctacacacagatgcttaccacagctttatttgtgattgccaaacatcagaagcaaccaagatgttcttcagtagctgagtgaataaatggtggcatatccagacaatgggacattattcagtgccaaagagagatgagctatcaagtcacgaaaagatgtggaggaaatttaagtgcatgtctgtaaatgaaagaagccaatctgaaaaggctacatgctgtgattccaactaatgacattctggaaaagataaaactatgaagacagtgatcaaagatcagtggttgccaggggttaggagggagggagggatgaacaggcgaggtgcagaggatttccagggcaggtaaactactctgtatgagacagtaatggtggatacatgtcattaaacatttttcaaacccacagagcgtacaataccaataaggaaccctaatgtaaactgcagactttgggccaatgtaggttcatgaattgtaacataggtactgctctgtgggcactggcaataatgggagaagttatgcatgtgtgagggcagggagcacggggtgtctctgtatgttccactcaattttgttgcaaatctaaaactgctctaaaaaatagtctaacaaagcaagtttggagaggaaaatagattacataaaatcattttcttacctaattcaagagcaaatagagttgaaaactcaccatagaaactacattttttaaaaaacgattgggtacaatggcttatgcctgtaatcccagcacttttggagaccaaggcgagaggattgcttgagaccaggagttcatgaccagcttaggcaacatagtgagacttcattactacaaaattttctttctttaattagctgggtgtgggggtgtgcacctgcagtcccagctacccaggaggctgaggtgagaggattgcttgagcctaggagttcaaagttacagtgagctatgatcatgccactgcactccagcttgggtgacagggtgagacccagtctcaaaaaaaaaaaaaaaaaaaaaaacacaacaaacaaacaaaactaaattaataaaagcaaataaggagaataataatgaccaactttcagggtgttagaagatacaccccttgcttcatcatattgcttaatgtgaaccgactgaattctactaaaaatagactttaaacaaagttagaaaagaaaacaagtatccaacattctctcacctataacaggcatattacaaattaaaccattcaaatagtctaaaagctaagggaaagcttaagatttatgatgcctctgtagatacaaaacaagcaggtgttataatccaggctgcaatactgttgtagatgtctgagaactcggaagataatgactaagcctgagaaagggccagacaaaggtaattgtttcccagtatcctggaagataagagaatctttatggctactggagggatgtggactcagctgcagtctttctggcaccagaagaaaaggcatgtggtaaactagatatttcgtaatagggcccatggggcaaacgattctatattaatgatatagtgtaggtttcacccacaggatcccaggtgttctgtgcaggtgcgcacacctgtggaggaggaagcggagcaaactttaaactgcacacattaggaagcctgggacagttaaagagttcccagcatcagatatgtccaaaagaaaagcaagtaagattagcaaagatacatgcctttttccctcagcaaaaagcaatgaaggttgagtctccctttaaaaataaaaaatcggattatgaagcagtaacattcaaaatcatattatattgaattaaaaacaggtaaactgtttagtggaatagatttcctagaagtagatattaacaatggtaacaaatcaatataagactagccagcaataacacatctatagaaaagtgtattttttaaataaaaaatgatcaaaattatattcatctgaagaagaattagcacccgctatgcactgtatataataaactccaggtgggtcaaattaggctaaaatgtttattgtggatattttctttttagttttatctaaccatcagtttccctttccctgacatagcaatcccattgtaatttcctagtgtgaaacttctccctgagtatatatgtaatgtgggtgggaaggtcaagttcttttaccatctcccacttgaaagctgaaggccattcacccctcttctccctgcccagtgcagacagtagatgggcacttgacctaagctcagccaacccagtggtcactcctggaactttgattcttaaactgatacaaggacaaaaggaaagagtggttggtcagtttcatcacacaggctgttccaattacaaaacgactgatgtcctttcagtttcttggttctttagaactccatggtcctttcccatgttcaagtatgtgttccctcagtctcatagcaataattcgcttatattagccagagcgagatttttactacaagttgagtattccttaaccaaaaggtttgggactagaagtgatttggatttcaattttggcaggattttagaatatttgcattatatgtttaccaattgagcatccctaattaaaaaatctgaaatccgaaatgttccagtgagcatttcctttgagcatcactctaaaatccaaaacttactgagcaccagtgtgacgctcaaaggaaatgctcactgcagcatttcagatttcagatttttgcattagggaaattcaacgtctcaacctgtgtatccagatggagacggcaattccaaagaacaaactgaagaggaagagggtataggaggtggatgatggtgtcacagttcacctggaaatatcttctctacaaggaaaggtgttttttttttttttttttttttttttttttttttttgttgttgttgttttttgagacagggtctcactctatcacccaggctggaatgcagtggtgcagtctcggctcactgcaacctctgcctcctggggctgaagcgatcctcccacctcaggctcctgaatagctgggaccacaggggtgcacaaccacacctggctattttttttattttttatttttttgtggagacaaggttttgccatgttccccaggctggtcttaaactgagctcaagcagtccgccagccttggactcccaaagtgctgggattacaggtgtgagccactgtacttggccaggaaagcatcctgacaatgatctgatggtttacatttcttctgcttgcttctccctgtgggaggcatatacctctctatctttttgcttattttattttacatttttgagacagggtctcagtctgttgcccaggctggagtgcaatggtgtgaccatggctcactgcagcctcgccctcctaggctcaagcactcctcccacctcagcctcccaagtagctgaaactacaggtgcacacctcctcgtgtggctaatttttaatttctttttttttttatagagatgggttctcactgtgttgcccaggctgatctcaaactcctgggctcaagcaatcctcctgcctcggccccccaaagtgctgggattacaggagccagccagtgtgcctagctcctacccctttaatgttgggttggccacaacttgattggccaatagaatgccagtggatgtgatggctaccctgtctgagcagccttaggaatgattagtcaattttgcttccaaaacatattctgtactttatccactccattgcatcctaccaacattagccaaatctgagataatctctgtcaactacttcaataaccttctaactgtctcctggctttagttgtgtacctctgagaaccatccttcacacaactgtcacacaacaatgtcaaattaaccttgtaaggccacagatgaaagccttcaatggctccctctttcccacatggcactggaaagctgtcatgacttgtcttctacctaccccttaagcctcatcctttggccttccctgcttcccactttatgttcagcaacactaaacaccctggacactcctccattcctttgtccattctgttcctttgtccagactgccctcctctctctcctaatttttgtccaaataacttctgtttgactctcaagattcagctcaatatcagtgctcccagaaagtcttccctagtacttcctgggcatgtatttgccctgtgctttcttggtaccagcacacaccccggcacttccccaccttaaatttaaatgatatattctgtctttttctcttccaatagatttgccgtctcctggagggcagggactatatcttatttagcttttggtccccagactctagcctgatgtctggcacacagtaggtgttcaatacacattagtggagctgaaatcgaacaaattaaacattaatataagcaaattctgaaagccttctgcctctattcttacaaaagctggtggcattataaatgggttcttctggaaagcaatatagcactatataacaaaaacgatgaagatggtcattctccttgacttggtattttcccgtttgtgaatactcctcaaagaaataatccaaaggaaaaaaaatgtacacagatgtcctggcaactctagttataacagtgaaaaacctggaagcaatccaagtgtctaacagggaaatgactaagcaaacaatgggattattacatagctattaaaaaatgacagaggtgaggactatgtcaacatagacaagtgtgtatctatctgcaggaacgttaagtagaaaaaagaacacaggctagtgtttaaacactagtgattaaggatgtgtgtgtacattaacaaagattggaggctaatttggaggaatgaaaatggctggagtgcagtacttgttgagtctttattttcctgtgcagttccatgaatttttgacaataatacttgagattccatgcaatatagatatcctagaggtcttctgcagaataagtattctaagttataccaagctgtatagtccaagagaaaattttatgttaaattcttataaaattgttataaaataatgatatttctttaagtgaacaaagcatttttctttagttaaattcaacaagcaactatgagagcttgactatgttctagagcacttacattctggggaaattcaaagaaatcatgggcaaaaatcctcaggtgaatatgtgttattattttaatttgctttttttttttttgagacaatgtctggctctattgcccaggctggagtgcagtggtgtgatctcggctcactgcagcctcacctcccaggctcaaaccatcctcccagcttagcctcccaagtaccaagtagctgggactacaggcacacaccaccgaggcgcctgcctcagcctcccgaagtgctgggattacaggcataagccactgtgcctggccgaatttatttttattttggtgaatgtacatattagaacagatgacaaaggaaagtctgcaagacctttggactaaacctcacatttacaagttgtctcaattttattttttatttcaattttatttatttatttattttgatacagagtctggctctgccacccaggctggagtgcagtggagcaatcttggctcactgcaacctctgcctccggggctcaagcgatcctcccacctccaccttcccagtagctgggactgcaggcacaggccaccacacacagctaatttttgtagtttttgtagagatggggttttgccatgttgcccaggctggtattgtattcctgggctcaagtgattcttccacctcagcctcccaaagtgctgggattgcagggtcaccatgcccggcctgaattttatatttttgatgtctccaaaagaggtcctatatttagtcactgagatatacagttaagtattaaaaggaaaaagtcatcatcacataactttaaacttgtgccacttttccacttggtgcactatgaattaatattttataaatcctgtgactatattgtgaatagcaaaatactgacataagatatattacattgcaattaaaagaaataagccacaattttttatattccattatagaatttcttcatttttaaaaatcaactgagaggctaggcactgtggctcacacctataattccagcactttgggaggccgaggcgtgtggatcacctgaggtcaggagttcaagaccagcctggccaacatgatgaaaccccgtctctactaaaaatacaaaaaattagccaggggtggtggcaggcacttgtaatcccagctacttgggaggctgagacaggagaattgcttgaacctgggaggcggaggttgcagtaggctgagatcgcgtcattgcctaggcaacaagagcgaaactccgtctcaaaaaaataaaaaataaaataactgagagtctcaaaaaatggaggtggcccagtcctctgaaaggccttgagcgtaattatcactttatctttttttttttttttttttgagacggagtctcgctctgtcgcccaggctggagtgcagtggcatgatctctgctcactgcaagctccacctcccgagttcacgccattctcctgcctcagcctcccgaatagctgggactacaggcgcctgccaccatgcccggctaattttttgtatttttggtagagacggggtttcaccatgttagccagaatggtctcgacctcctgacctcatgatctgcctgcctcggcctcccaaagtgctgggattacaggcgtgagccaccgcgcccggcatactttatctttaaaatgtaatagttttaagtaggggcctaaagcaaatgggttgttgataactgtataaacacctcctaacatagtcctttccgctagacttactgtttctgctgccatgtaactggtggtcagaaaactaccagttctggctggccatggtggctcacgcctgtaatcctagcactttgggaggccgaggtgggcagatcacctgaggtcaggagtttgagaccagtttggccaacaatgtgaaaccccatctatactaaagatacaaaaattagctgggcatggtggtgcgtgcctgtaatcccagctacttgggaggctgaggcaggagaatcgtttgaacctggaaggcggaggctgcagtgagccgagatcgcaccactgcactccagcctgggcaacagagcaagactccgtctcaaacaaacaaacaaacaaacaaacaaacaaacaaacactaccagttcctagagcagtggttcacaaacctggctgcaggtaggaatcacctgtattctcccagatcccactccagacctcttgaattagactctccagggctggggcctgaagattcctatgcttaaaaagctctttctcgtccttcctacactgaatttcctcatggttcgaggactcagaattcaaactagtacagctaatgccgcggttcagctgcatcaagagtttaacacagtgacaacttgtctctacaaaaagtcaaaaaataaggcaggaggattgcttgatctcaggaggtcaaggctgcggtgaggcgtgatggtgccattgcactcccacttgagtgacagagtgagaccctgcctcaacaaaacaaaacaaaacaaaaaaagagttgaacagatctgaaggctagtttgaaggccaactaccattttcagtgtagtctctctagggtgatgtgttggaagtgcccaacaaacaatttaaaagagaagtctgaggatgtggtccacagatttttttttgtggaaactgaccacacagaacttttgaacaaaatgccttcatttgttcctaaaatttgttattgtgtctttactatatgaaattaaacaaatgctggctgggcatggtggctcatgcctgtaatcccagcactttgggaggctggggcaggtggatcacccggggtcaggagttcgagaccagcctgtccaacatggcgaaaccccgtctctactaaaaatacaaaaattagccaggtgtagtggtgcacgcctgtaatcccagcttctcgggaggctgaggcaggagaattgcttgaatctgggaggcggagattgcagtgagctgagatcatgccactgtactctagcctgggcgacagactgagacgccgtctcaaaaataaataaataaataaaagtaaacaaatgctgaattgaatcgctaagttcaagtgtcagttcttataaacaaggtgaagtaccagttgggttttttgtttgtttgtttgtttgtttttggagacagagttttactccgttacccaggctggagtgcagcggtgtgatctcggctcactgcaactgctgcctcccaggttcaagtgatcctcctgcctcagtctcctgagtagctgggactacaggagcacgccaccacacacagctgttttttttgtatttttagtagagacggggtcttaccatgttggtcaggctggtctcgaactcctgacctcaggtgatccaccagccttagcctcccaaagtgctgggattacaggggtgagccactgcacccggccccagttggtttttttttgttttttttttttttgctttttttttgagacaaggtctctatcatccaggctgtgttgcagtggtaccattatagctcactgcagccttgacctcctgggtgcaagtgatcctcctgcctcagcgtcctgaatagctaggactacaggtgtgagtcactatgcccggccaatttttaaattttttgtaaagatggggtctcattatgtcaaccaggctggtctcgaactcctgacttcaagcgaccctccctcctctgcctcccaaagtgctgggattataggcatgggccaccatgactggccaaagtaccaggtttttatgggcagtaaaactttagcccaaactgtcaattaactcaattttttttgcctccataaagaggcaaatacaaagaaaatgggctttcaacacagagaaaaacaaattccaagatatgggctgaggtcagtatacacgctgtctattttcctctaccttctggttcttcatcccacctctgtactatgatattgatgctctgaggaagaccctgtatcccagcaatattcctcatctataaaataaagatttaattgtgttcctctaaacccaaaacacacaggatgatgtccagggaagttagaggaacatgtgtcagctgaagaatcagtggtatgttccctcttgtctacctccccaattcgcgctggcccacatcccatttggagtgaccatgtctatggagatagaggaggatattcttccacttctaacctcaaaaggacacactggaggcatctagattgaggttacagctatcctttgaggagctgtaacaagaatatttggaagtggaccaaatctagaataatcaagtttgaaaggactatggttgtcctttctgttgctactgttgttatactgtgttgataaatacaaagtatagtcataaaggtgggggatttaatcatgttccagaatgatacggctgttaaggctttccaggtaagccagagagttgagataatccttattcaagtgagaaacgaatttggccctccttatctggaggagagggttagaaggacgatggatggatttggggacatgtagtaggactgaattcctaggctgagctccaaccacctctgaatgccccagagatatctatgttccatctggtctggtctgcagcaagtccacagaagctacattcacttttctgtgctgaattatcaaaataattgcccttcagcccatgcctcatgaccctgtagacagaatccactcatttccctatcacatgggctacaattgctacttcaaatgaaaacctgggaagccaatgccctattgtggttgaaagtgtacaattagctcctcatgcagcctgaccccactgatttttctgatgcatgtgacctggagtgtgccctttctgagaccgccaatgtcttctccacagctggagatgcccaaaactgcacgcagcacttcctgtgggtgtggccttgcattcttaggactgcagggtacccgctgcatgccaaatgatcccaggctccagccactcacagattcacaacgcttttaaaaatacagcagtggagtatgagcggctatgtcagatatgagggttttccaccccctcccttttcttttaaaatatgattttgtaatggtggcctcaagaaacactataattggtcagcctggggtgcgtttgaaggccttctctatcgcgtcattagctattctcaggaaaggcagggtatcccactgggagaatgacaacacacttgtttcaagttagggaagagcctgtggttctcttcctgcgttcaggggaaagcgaacacacaatgttcgtttcctaaatacgggatgtgctgtgctggcaggtcattttccaccatgtcacgtccttctagatgaaggcagcaggggtcatgacaggaaatggcaaattctcagaatgagacaaggctttcccagggcagccattggttctctggaactataaagcacactcatccagaaacagcctcagattttactttcctggaggcagacagaagtgaatggtaagtggggaaccctgaggcatatattcgggatgactttttctcattttctcttttcacctggaaaattatccctggtgggttggattatggaagcatggaagtaaaattaagtcctgtgaataaggagatgaggattctagactgggctctgtgaagaatcagctgcttctagaatctgatgtctgatgcaggcaattcttccagatgagaatgatttctgccctgatagctcagttttgaaatgctctatttctatggctcatttgccacttttaagaagttcctaataatgaagagtacagtggacatgaaggtgggaatctgcaactaggatgaatatacttttcccccaagatgtacaacttgttcgtatctttgtcagtcatcttcagttggcttcaacgtggtagaagttgttgaacaaaaattttggccactttattttattcaaccattactcatttttaaaagaaaactttcataacaaagagacataatggtattaatttaatgtgacttagtttaaatcaagcacccagcaaagactgatgtttctgaagatccaaggagccctagttagaataaacagtgcaaatctcattttaggcttgattctaagaaaagagcctggaagaatcacaagcagaagagttgcttcaggcaagcatctaacttagatgtttcttctgcttggtagaaaatacgatttttgaggttttggtgaagtctttttcattcattagagagagagaaaagtgtgttgcaaaactcctaggatccaattttcacatgatgaaagggctttgtaaactgtacaacccaccacttacaaagtgttatcttaagtagagcaaaggcctcagtactggagaagccttctaataccacgcccctcccagtttaaatcttatttaacacatagctgatgaagcccatcgttaacgttccctgggagagaagcagaagatagcattattcctatttccatatgcagagataaggtcctgagaacttgtgtggctccccccggattccagaacaggtctttgagaactcgtctcatgatccactggaaacagacccgttcccctagcgtggcagtggctgctccgctgaactcgtgccaagttcccgctggcgtccgggcagcagggcgggagcggcggctggcacggagactccaggctgaccgcgtgtctatgtccccgcagggaatggagaggccggcggcccgggagccgcatgggcccgacgcgctgcggcgcttccagggactgctgctggaccgccgaggccggctgcacggccaggtgctgcgcctgcgcgaggtggcccggcgcctggagcgcctgcgcaggcgctccctcgtagccaacgtggccggcagctcgctgagcgcaacgggcgccctcgccgccatcgtggggctctcgctcagcccggtcaccctggggacctcgctgctggtgtcggccgtggggctgggggtggccacagccggaggggccgtcaccatcacgtccgatctctcgctgatcttctgcaactcccgggagctgcggagggtgcaggagatcgcggccacctgccaggaccagatgcgagagatcctgagctgcctcgagtttttctgccgctggcagggctgcggggaccgccagctgctgcagtgcgggaggaacgcctccatcgccctgtacaattctgtctacttcatcgtcttctttggctcacgtggcttcctcatccccaggcgggcggagggggacaccaaggttagccaggccgtgctgaaggccaagattcagaaactggccgagagcctggagtcctgcaccggggctctggacgaactcagcgagcagctggagtctcgggttcagctctgcaccaagtccagtcgtggccacgacctcaagatctctgctgaccagcgtgcagggctgtttttctgagaacatcctttccccctaatgaccgaggccagcaaatcatcctcatgggatgctccagaatttgtagctcccttaggaaaacaccaagctgggttaggagccgaaggcaaaggatgagaaaaactgtttttgaagtgggcaggtccccaaagcccttcttttcccatcactgtgacatctgcctgggcttgagtgctacggacttttcagtcttcctagtggaaaaatgtgacccaaaaactctttttcctttatcaaaaactttctgtctaaacacagctgggcaggcactcctgttttaaagttatttcggggtccctgaccctgccctggtggcttggcctgagactggagagagtgccatcctctgggtcctctccaagtcctactagtctttgaagtcctcaaaatgtgcgtgaggaaggcgtttgcctctattccagaatttctgatacaaagaactccagaatccagagcaaatcagcccttctctgaacgttgtaggatggttcagaacccagagaggaccctggtgctgatatctcctcctcttccctttcccctcagcttacttactcccagatgcggcctgggtatgaagtaggcctttcctgagtggctcccaatccagtcctccaagtactcagaggggaagcccgtgaagccgtcatctaagtcctgctccctcacatgaagctgagggccagatagatggagcgactgccaacttcatttcccgacatcattgtgttcagaagagagtgatgggttttgagttagacagtcctgggcttgagacaggctttgtcactactgtgtgagtgtagccacctaatctctctgagactgtgtaaaacaaagatgataaaatctcaccctgttgtgagatattaaatgagccaaagtgcctagcatgatggtgctggctcatatagtgtagtccctggaatggcaaattaacatcacccaggaacttgttagaaaggcaaattcttggacacaaccctcctgatttatggaatcagaaactctggctgtggggcccagcaacctgagtttaaacaatttctctgggtggttctgcggcacactaaggtttgaaaatcactgcaacaaatgctaacttctaatccccttgatgagctttcacgaagtctcacggcttctctagggactccatggtcttcagagtcgttcacagatgaccaaggacagactgtgtcccagaagccaaaatgagagagagagagagagagcacgcgtacgtgcaccctggggcagtgtctcaccgtatgaacaagggatgtaacactaaaagcccattagggggcagtgtttcccgcctgttgtagaaactggtacagaaaggaatatgaagttcctgaaactgacctttgtctattattaccttctctgaaaagtgccagtccatgtattttttatttattttaagtttgtaatttaatttttaattattgtttagtgtttgcatttaattttatttaatcaccacatttagaaaataataagagcaagtttctaaatgggagactgctgaggctctttgcaagagatgagattaagtttgagtttctaaggcagggcatgagctggaaatagcattgctttccttgattgtctctctccttcagggagattctttttctctagtgttttaagtgatcctttgaagtaagtgtggagagtcttgaatggcaagaccaggagctgagtttaagcttgtaatggaagcttgcattgtgggatatataactgaggaagcatatttatcctgaaggtattttgccagaaggtatcacttgacctggaaaaggaatctatttagttcaggaaagataaaaagtttagaggtatgtgaaggaagcacttagaacttgcaagcctgatgtcctatcaagttatgtcttctgggtgacagacaaaatcgcttgtcttatggtggtgatgtgttgcattttcactttggggtctgtaagaaactgtcagtgaaaatatgtacaattccttcaatttccattcttaacaactgtaatgttgaaaaataagttgaaaagtctttgggaccatacatgcaaaaacggtgcctctgttacttaattatttaatattctataaatgtacccaatctgtccgcacccttcccagtgatggggcagtatgtctgaggaagtataatttcagtactggggtcggggagaggaggtgatgtttctacatttttattttttctataaattgcaattggtctgtatgctggtttattttgaaatttatattggtttcttttcaagctggtgtcatctcctagactgtttcacccagatgctagcattttttttttttttttgagacagagtctcactctgtcacctaggctggagttgcagtggtttgatctcggctcactgcaacctccgactcctgggttcaagcaattcttctgcctcagcctcctgagtagctgggattacagatgtgcaccagcacacccggctaattttttgtatttttagtagagacagggtttcgccatgttggccaggctggtcttgaactcctggccttatgtgatccgcccaccttggcttcccaaagtgctgggattacaggcatgagccacctcgcctggccagatgctagcattttagatcaaacaattcattttagatgaattgttttgtttcacaatcattttaaatcattttagaatgtacttcacattattagttgtgttatggcataaaggtacaaccattccctaactccatcttttattaatgcttaagtttaaattatattcttccaatgcctaagctattccctagaattaaactgggcacttttggaagcagcaacagtaacagcagcagcaaacttttcctctcatattttgggtgtatcaaaagttctagacttttgaagttatgatttcagtggcccactttatttctaaggaagagtgtctactttggaacgatactttgcacatagtaggaactcaagaaatacatttgaataattataattaactgtttagctatcttaatgagaatttgttgacaacaaaagatcatccatcgccttatgtgtgagtaagattggagcctctatcaagatttagtcaagttcagttagattgattctagaaacaaatatttatttctttcttttacggggatgtgaataaggcttttccttaaggccttcattctttaaacaaacaggttgaaatggtatgttgtaaaagagaagacgggagagaggtatttagatgataagtgtacttcacaaaaatgccaaagtttgaaaaataggtatgtttgttctaaatgtttaagtgcttctctgttaggttctggggcttgcaatcatttgaattgttctgtttcacaataaaggagattcactgggttctgcattttcaggattcaatagaactgctccattaaaaaaataatccttagcaagcattcgaatcctaactgctttgatgcacttgccctcgggcacctgtcatttccaatatggtaggtgtcaaagtcaaaagtatttactgggagaaaaaagagaggagtggttgtagaagtctccctaaatcagacatgtcaagcaatcagccaacgtggtgtatttctcattcaatattttagtgtgaattgagacactgagataaagacatcgtgcagagataaatggggatacagttaaatgtagcaactcttgagttcattttttcccactgtagcaaaattaatgctttctctttattgaaataaattgctcattcctcaa

SEQ ID NO: 301 - DNA, 5859 bp, Homo sapiens
  source 1..5859: mol_type = genomic DNA
gcagccattggttctctggaactataaagcacactcatccagaaacagcctcagattttactttcctggaggcagacagaagtgaatggtaagtggggaaccctgaggcatatattcgggatgactttttctcattttctcttttcacctggaaaattatccctggtgggttggattatggaagcatggaagtaaaattaagtcctgtgaataaggagatgaggattctagactgggctctgtgaagaatcagctgcttctagaatctgatgtctgatgcaggcaattcttccagatgagaatgatttctgccctgatagctcagttttgaaatgctctatttctatggctcatttgccacttttaagaagttcctaataatgaagagtacagtggacatgaaggtgggaatctgcaactaggatgaatatacttttcccccaagatgtacaacttgttcgtatctttgtcagtcatcttcagttggcttcaacgtggtagaagttgttgaacaaaaattttggccactttattttattcaaccattactcatttttaaaagaaaactttcataacaaagagacataatggtattaatttaatgtgacttagtttaaatcaagcacccagcaaagactgatgtttctgaagatccaaggagccctagttagaataaacagtgcaaatctcattttaggcttgattctaagaaaagagcctggaagaatcacaagcagaagagttgcttcaggcaagcatctaacttagatgtttcttctgcttggtagaaaatacgatttttgaggttttggtgaagtctttttcattcattagagagagagaaaagtgtgttgcaaaactcctaggatccaattttcacatgatgaaagggctttgtaaactgtacaacccaccacttacaaagtgttatcttaagtagagcaaaggcctcagtactggagaagccttctaataccacgcccctcccagtttaaatcttatttaacacatagctgatgaagcccatcgttaacgttccctgggagagaagcagaagatagcattattcctatttccatatgcagagataaggtcctgagaacttgtgtggctccccccggattccagaacaggtctttgagaactcgtctcatgatccactggaaacagacccgttcccctagcgtggcagtggctgctccgctgaactcgtgccaagttcccgctggcgtccgggcagcagggcgggagcggcggctggcacggagactccaggctgaccgcgtgtctatgtccccgcagggaatggagaggccggcggcccgggagccgcatgggcccgacgcgctgcggcgcttccagggactgctgctggaccgccgaggccggctgcacggccaggtgctgcgcctgcgcgaggtggcccggcgcctggagcgcctgcgcaggcgctccctcgtagccaacgtggccggcagctcgctgagcgcaacgggcgccctcgccgccatcgtggggctctcgctcagcccggtcaccctggggacctcgctgctggtgtcggccgtggggctgggggtggccacagccggaggggccgtcaccatcacgtccgatctctcgctgatcttctgcaactcccgggagctgcggagggtgcaggagatcgcggccacctgccaggaccagatgcgagagatcctgagctgcctcgagtttttctgccgctggcagggctgcggggaccgccagctgctgcagtgcgggaggaacgcctccatcgccctgtacaattctgtctacttcatcgtcttctttggctcacgtggcttcctcatccccaggcgggcggagggggacaccaaggttagccaggccgtgctgaaggccaagattcagaaactggccgagagcctggagtcctgcaccggggctctggacgaactcagcgagcagctggagtctcgggttcagctctgcaccaagtccagtcgtggccacgacctcaagatctctgctgaccagcgtgcagggctgtttttctgagaacatcctttccccctaatgaccgaggccagcaaatcatcctcatgggatgctccagaatttgtagctcccttaggaaaacaccaagctgggttaggagccgaaggcaaaggatgagaaaaactgtttttgaagtgggcaggtccccaaagcccttcttttcccatcactgtgacatctgcctgggcttgagtgctacggacttttcagtcttcctagtggaaaaatgtgacccaaaaactctttttcctttatcaaaaactttctgtctaaacacagctgggcaggcactcctgttttaaagttatttcggggtccctgaccctgccctggtggcttggcctgagactggagagagtgccatcctctgggtcctctccaagtcctactagtctttgaagtcctcaaaatgtgcgtgaggaaggcgtttgcctctattccagaatttctgatacaaagaactccagaatccagagcaaatcagcccttctctgaacgttgtaggatggttcagaacccagagaggaccctggtgctgatatctcctcctcttccctttcccctcagcttacttactcccagatgcggcctgggtatgaagtaggcctttcctgagtggctcccaatccagtcctccaagtactcagaggggaagcccgtgaagccgtcatctaagtcctgctccctcacatgaagctgagggccagatagatggagcgactgccaacttcatttcccgacatcattgtgttcagaagagagtgatgggttttgagttagacagtcctgggcttgagacaggctttgtcactactgtgtgagtgtagccacctaatctctctgagactgtgtaaaacaaagatgataaaatctcaccctgttgtgagatattaaatgagccaaagtgcctagcatgatggtgctggctcatatagtgtagtccctggaatggcaaattaacatcacccaggaacttgttagaaaggcaaattcttggacacaaccctcctgatttatggaatcagaaactctggctgtggggcccagcaacctgagtttaaacaatttctctgggtggttctgcggcacactaaggtttgaaaatcactgcaacaaatgctaacttctaatccccttgatgagctttcacgaagtctcacggcttctctagggactccatggtcttcagagtcgttcacagatgaccaaggacagactgtgtcccagaagccaaaatgagagagagagagagagagcacgcgtacgtgcaccctggggcagtgtctcaccgtatgaacaagggatgtaacactaaaagcccattagggggcagtgtttcccgcctgttgtagaaactggtacagaaaggaatatgaagttcctgaaactgacctttgtctattattaccttctctgaaaagtgccagtccatgtattttttatttattttaagtttgtaatttaatttttaattattgtttagtgtttgcatttaattttatttaatcaccacatttagaaaataataagagcaagtttctaaatgggagactgctgaggctctttgcaagagatgagattaagtttgagtttctaaggcagggcatgagctggaaatagcattgctttccttgattgtctctctccttcagggagattctttttctctagtgttttaagtgatcctttgaagtaagtgtggagagtcttgaatggcaagaccaggagctgagtttaagcttgtaatggaagcttgcattgtgggatatataactgaggaagcatatttatcctgaaggtattttgccagaaggtatcacttgacctggaaaaggaatctatttagttcaggaaagataaaaagtttagaggtatgtgaaggaagcacttagaacttgcaagcctgatgtcctatcaagttatgtcttctgggtgacagacaaaatcgcttgtcttatggtggtgatgtgttgcattttcactttggggtctgtaagaaactgtcagtgaaaatatgtacaattccttcaatttccattcttaacaactgtaatgttgaaaaataagttgaaaagtctttgggaccatacatgcaaaaacggtgcctctgttacttaattatttaatattctataaatgtacccaatctgtccgcacccttcccagtgatggggcagtatgtctgaggaagtataatttcagtactggggtcggggagaggaggtgatgtttctacatttttattttttctataaattgcaattggtctgtatgctggtttattttgaaatttatattggtttcttttcaagctggtgtcatctcctagactgtttcacccagatgctagcattttttttttttttttgagacagagtctcactctgtcacctaggctggagttgcagtggtttgatctcggctcactgcaacctccgactcctgggttcaagcaattcttctgcctcagcctcctgagtagctgggattacagatgtgcaccagcacacccggctaattttttgtatttttagtagagacagggtttcgccatgttggccaggctggtcttgaactcctggccttatgtgatccgcccaccttggcttcccaaagtgctgggattacaggcatgagccacctcgcctggccagatgctagcattttagatcaaacaattcattttagatgaattgttttgtttcacaatcattttaaatcattttagaatgtacttcacattattagttgtgttatggcataaaggtacaaccattccctaactccatcttttattaatgcttaagtttaaattatattcttccaatgcctaagctattccctagaattaaactgggcacttttggaagcagcaacagtaacagcagcagcaaacttttcctctcatattttgggtgtatcaaaagttctagacttttgaagttatgatttcagtggcccactttatttctaaggaagagtgtctactttggaacgatactttgcacatagtaggaactcaagaaatacatttgaataattataattaactgtttagctatcttaatgagaatttgttgacaacaaaagatcatccatcgccttatgtgtgagtaagattggagcctctatcaagatttagtcaagttcagttagattgattctagaaacaaatatttatttctttcttttacggggatgtgaataaggcttttccttaaggccttcattctttaaacaaacaggttgaaatggtatgttgtaaaagagaagacgggagagaggtatttagatgataagtgtacttcacaaaaatgccaaagtttgaaaaataggtatgtttgttctaaatgtttaagtgcttctctgttaggttctggggcttgcaatcatttgaattgttctgtttcacaataaaggagattcactgggttctgcattttcaggattcaatagaactgctccattaaaaaaataatccttagcaagcattcgaatcctaactgctttgatgcacttgccctcgggcacctgtcatttccaatatggtaggtgtcaaagtcaaaagtatttactgggagaaaaaagagaggagtggttgtagaagtctccctaaatcagacatgtcaagcaatcagccaacgtggtgtatttctcattcaatattttagtgtgaattgagacactgagataaagacatcgtgcagagataaatggggatacagttaaatgtagcaactcttgagttcattttttcccactgtagcaaaattaatgctttctctttattgaaataaattgctcattcctcaa

SEQ ID NO: 302 - DNA, 156823 bp, Homo sapiens
  source 1..156823: mol_type = genomic DNA
tagtttagaaagaaatgtttttaatataatatttaaacatattaaaaaaaagcaacaattcaataaggatccttccattgttctttatacagatttaaatgctgtcacgtactttatcagttacatttataattaataaccttccaatcactgagtttagaaattgcagtatttactgagctaacctttctcacaaagtaaggcacaactacatgatcacaagtagtaaacacaatacaaataatgaacccaaaaactaaatgagaaaatgttcatgcataagtatctacagaacttatgaatatatgatccagttcaaggaattacagaatgtcatatacacaactgcattgtgttacaataaatttattacttctacacagaaagaacttagtgacttctaattctattttatacaattttacataaatttagtaagtttatgcacaatattcacatctgcaacaataacaaattgatcattaaaattcaggctaagggcaattaagacacaataatgtgtggcacgttataattacagaataccattcatcaagctcatgtctaggaatactataatggtggcacatttaaatcttatggatcaaatcatccatggttttatagccaaagtgcatttttttaaaaaaactcctatagtcaaacaggtcatgaatatcaaaatatatgatcataatttgctctctacttaaaagctaaacatttttatgcaaatgtaaggttaaaaaaaagtggctttaaagttctcaaaactatataaaataatcataaagacttttttaagagagatgggaaaataacaaatttggcagttactatttaacattactgtcaggaaactattaaagtagataattccacattaagaggtagttgaacaaaatgttatttatacactgcattgaggtttttgtgtttgtttccctcattttttcttcaaaggaacaaatcctataccagcagctttgtcttctttctattaaaaaaaagtctgtaggtatagtttattgtacactaacccagcaagacttaattttaactcacattctgtgccggggtttggaatttactaacattatgtcaatgtgcttttcattaaagccaagagctgtacatgccagctttaactgactgacaaaataatagtaccagcaaacatgtaaaatgtacagccaataaggacttcaaagatgactttttaattaaaaggaaaaaaatttaaatttttatttcgaaaacacattaaattggggagagttagtagcaaaaaatgttcggtttcatttatattatcagtatagtagcctatggtaggtaaattactcgggacttatgaaatgaaattagataaaaatgagaaaatcattcaaacacctatatatggttacttgttgtcttaaaatttttttgtgagtattttgggggtaaaggggagacagacagaaggcctggagtggtgttcaattaggagacaaagtaaacaaatattcaaacccagatttctcatggaatttattatctcaaaaaaaaaaaaaaaacagtggtgctgtgaatatctgtgtttttccagcacacttattaagttatttatatgtaaaaggatagaattaaaactatttggaaggatttataagtatataaaaatgcataaatagttcagtttatattatccaactattatttttaataaagagccactgtatttcttcattatatatgttcaaggatatatgtttatccaagtccagggacttaatcaatgttcttaatagctaatgacaacagggtttacttaaatttttttttaaataattaaacaaatatgtagtgatctctttagtttacatacactgtaggtatagcatgaatataatttcatttcagaatatttgaaagcaaatgtatattaagaactattataaatgaaatattaactactgttataaaatgattgcactgaatgaatgtataactacacttcttctctagaaagattaataaaccaatattaataacttctctcttgagatgttttacaattttccaaattaataagactatgctaaattaaagttcgattccattgttcagcatacaaataagctaatttcttaattatccttaagatgcttagccatgctgtttcagtttttattgtaactgggattcctaaatacatttgtttttggtgatactctatttctaggtgttagttacttaaagggaatttcacaacattatttttgcaaagttaaaattaaaactgggaacagttgacatggaacaccaaattcagaaccattttaactttaagtcaattttacaacttttaaaaattcttcccaatagggtaagaaatagaaagtaaaatatttaatgtcttcttatcattttatattttgttttcaccaataagaccacagcaatattagttactagctttaagatgcaaaattataaaacaaatacatgaagctgatctatgcttgaaaatgttaaaccaaataaaggaaaaaatcagatctatgtaaaaagcaaactcaggttcctgaagatgctagagagacaaaataagggtatgatatgaaggctgatctcaaaagacttcccacttacaagaaaccgagaataagaacattatacaatgtttattattcatcctccaactgacagcgagggtaagaagctttctaagattctaaatggacaatgcgtgggagtttaagaaagagacagaaaaagacaaaaagaaaaattaaccctattctttgcaatacaaccccagataactataagtaaacaaattgattttacagaggtttttataaaatccacccaagaaaatttaattaatattgttaaaacaaaaaccatttttgaattcatattactacatattttaagataaactgtatttagaacacccaagtagtaaattcataacataacaatgcaactgaaccatgaacccacatataagagaaaaaggcagaggaaagtgttacagttctgtgcataacttcacaaagagaatatttaatataattaatgtgctattgtgcaacaaaaacagcaacaagtgataatatcatccatgtacatttttgtacattaaatttaggagaaagaagtaagctatggaattgcattcttcatttgtgaataatgaaattatattaaaaaaatacattgctattttctgtccaaagtttatttacatttcattggctaattctaaacttggcatgaaagctattccaggggctaaatgggaaaaaagtaatgaaagatgataagcccaagtctcacaaaaatagaagagttttacttgatatccataacattccaaaatatactaattcctatttggtctagtattgcaaccagtgtccaaaccaaatagtagtccaagacctctattaagtacatttattaaaaatctaatgttagtgtaatattactctgaagttgtgataacccattatccttgcaagtcattgaaacatgcatcacagacacgaacaggcttcttggaggaaggagttaaggcatttttggctgaacattcagcacagaagatatttccacactgtcggcagtgatgctgtaaatgacaaaaattaaacaatttcaagaataaaaactataccaaaagtattatgaaactacatgaataccaccaactacattatgaaggtacattagctttcaagtcattggtatattatttaatgatatgtttcaatatgttaacttaatctctgttataattaaattgaatgcttcctatttatcaaacactatgctaaacattttacatagaatttattatggaactctcaaaagaaccagaggaggcatttaaaaagtttttataaagtatctctatcaaatgaaaaactattcctatttgccaaatgtttcaggcactaatgtctccaaaagaaatataaacttaagtcattaacacaatggtagtatttagaatatatttttaaaatacctctgctttttcttcctttaaagaacccaatgattactaaaacatgagtttaatattggtgcactgattcagaaaatgattgtcccagacagtaactaagttggaagacaaggactgaatttaaaagtaaaattcaaacacatatgctaaccaaaagctagactgcatgaagttattctatgttgttgttaaagtttactgataaacagaaaattattctgtcaaatgaaggactattttgatggttaaaacattaattatcagtgacaaatgaaatccagaaacatagttacatgaacaaaattatttacccgtctcactgttactgaaaagcctttcccacaggccatacagttttgtacttcattgtcttcggcccactttctattcaacgcttgtgtatgtttgatctgttttttaaagaagtatcgatatattatagtattcaacattttaaagaatgctagattatttctaacttgctgccagagttctataaaattttgactatatgacccatgaaataaaattttaaaaatcagaaatacactggtcagcttctattgtcaaaagtagctatactcataaatctgaatgacaaaataaaattaattgaattttattcctgaaatatcttgctaacctttgctgatttccaatccattctaaacataatgatgaattttccctggtgactctgagaatatactcagatcgcttctttaacacatactgactcatatattctttggtattcttgaattttgtagttctttccatatactaacaattaatgaatgacatggctttctaatgaatctctgaggtctctgaaacaagttctttacttttatatttaattatccacaaaacctacaatactgctaaacagagagtagctatttgaaagtatttataaaacatgagattttttaaaaggtaaaaatatgcttttcactaataagccaattctagactaaaaaactgcttcatatccataggtgactgacctgaagtgattggttttctctgcccagctcctgcactgctgcagttgtattatccagctttctttgcaattctaatactttggtttgaagcttttctatttcaccttctcctttaagacatctggaatagattgcaaagaggtaattaattttttagaaaatcatttaaagacccttctagggtatagataatggactactttagtaatttaaaatatatgatacattaattttgactatctgattgttttacaggttaatttttaaatggctacttaaatacctatagaggcttatgcacttttctcaagattcttctatttttaaaaactatggaatatgacaatctttttatcacttacaatggaaataaactaattttactagatatcaatcacctttccagtagtgctctcctttcatcttgattattctgaaccgttgcttctaatactgcaatttcaccccgtaagtcatccgtttgtttctcaagctcactaactctccgttgactagattgccactccttcttcacagtgcctaagttttcatttaatgctgtaatctgcatggtaagtttagcctcattttcttcatgcttcttcattcctacttccttttcttttatttcggaatgctgaaaaaaaggaaaagttggggggaaatctattacaaaagtagtgcaaaataaatgtaagtgatttattacatttaaaatactggcaatttgcttcttcgggaatggaggcaggagaacatatttcattacacattaataaaactgattccacaagcatctatgtaatatgaattggctcaaaggtcaaaatgctgaaatgatggatagtgaccatcatgatggtgagctaaagtgacacaatgtgagatctttcttcttctccaccagagcaggaaagacacatatggttagggatagcaaggtgccctagagacaaagctgaaatttccttattcgtcccaattccatatgctttcttttctctatcagtctgccaaaaaccattatgaaaccttcaaatgactgtttgaagttaaaattgaaactcttcaactaaaatattcaatggccaagttatctgggcatatttggacttaattcaacagaggaaagccagatgcttcccatttggcatgtgcaacttaggaaaggaaaagcagactttgttcatcataatttcaaactcaagtttccgctcccccttatcaacattcgttttgacccaacaaatgggtttaacatgactagcattcacaccatttaccagatctacgtagttgtggggttgtttagcttctgacacttaaaaaacaaaaaaaattttttaattttatttcatttcaatgttcacttataaaaacagaattatggttacagggtaaaatatttccaaccacatgtcagctatgtaaataaatcagatctccttccttaatcaaaaactaaaatgttaggaaagcatttcaatcagatcttataagtagaacagtcctctcactggattgatttaaagctctactgcaaaacacacttcccccgattaactcactgaccaacttagcttctttctcaataaattctttcttcagctcctcttcttcctttttcacctggtcttttagtatctgctgatttctcttctcctgttcaacagctgccttcagggagtccgcttttccttgaagttctaatttctgctgaattagaagctgtttagcatctttaagatttgttatctcctgttgaaaaagtagggccaaaaataaatcatccttcatagtaaatatttcaaaatttggctaaaatttatgcaatttatcacaatagatcaaatataggttttacccacttatgaaattcttaaagttcagtattttaaagaattggttaaaaagatacaagattatagtatgtcttgctcaacaatcatttaaatccaggtgacaaaaatgtatacgttttgattatgtggagaaaaaaaaacaaactgtactctctattttccctttcctcacttaacatttactggtcatcatttagttatcacacactgagttacgttctggggatataacataaagatgaattatacacattccctgatttaaggaagtcacattctagaggacagaggaacataaagagataattaattataaaccaaaatgaaagtatgcttacagacataaaggacattatgagtgctctcaagaaagaatctaacctttttttaagaaattagtattttacaaagcaaataatagacaattagttttcttcaatgggtaccctatctatgcttataacaggtaaaatgttaaaaataacagattatgaaaggactttaggaagaaaaataattgaataaacaatccctttaaatcttacttctaaactctttcatattttgaaatttactacctgtgagcataattttctaaatcaatacatctcttgattatcatttcaatgagatccaaactcttagggttactttgcttcattgggtaatgtgaaaacaaatgtagcaatttcaatatgtgtacgggtattatgcaatacaaaagcactctggcaagagtatttgtcagaaacaacagaacaatttgcctagcacatagcaagttctcaataaataaataaatatgtatgggtatatatatttctttaaagagcaatataacacagaaggcaggagaaatgattatcttaacatacctttatgctttctagtttgtgggacttgagttcttcgtttagtttagtgatttctttttcttgtctacatttaatttcttctatctctgccaatttagacttctcatttaccagttctttttctttcagtgactgtagaaaaatgatatattttaaaattattttaaagcaaatacttaaatgaaaatgggtgtaataaaaatgactgctactattgatgacactggctctgcccttttctacctaacttgggcaaattacttaccctctcttggttcttggctgtttccttatttatacagtgtgaacaataataaaataattgtaaagattaaatagttatagttaatattgtgagataaattgtacctggtcagagtaatgatactgcaaaactacgattcttactcttataactcctattttattactatcactatctttatataaggtatctagttaggatattatctcagttaatctctagtatatgtagacttttaaatctccattttctaggtgaagaaacaaaggtttaagagacataaaataatctatcagagatagagccaaaaccaaagcaagtctgtatgatctaaagctcacacaactaaactcctataaacaacagttctttttctttttgaaacagggtctcattctatcacccaggctggagtgcagtggtatgatcatggctcactcactgcagccttgacctcccaggctcaagctatcctcccacctcggtctcccgagtaggtgggactacaggtgtgcaccaccatgcccagctaaatttttttttttaatagagacaaggtctcactatgttgcccaggctgatcttgaactcctgggctcaagcaatccctcctccttggtctctgggagtgctgagataacaggcatgagccatcaaacctggccttatgaacaagagttctgtcagaattctctaaacttgaagcacaaatcatgaatttcattccagcttcaccatcaccacacccacagaacatttttaaattaaatttcaggaactgaaccatttagaatttaccaagaatttcagggaatatacactgcagagtaatatcctgtcagctaacaggaatatatgatttcaactataaaacaaaaaataaactctttcctaggatctgaatttttctttcatacagaatttaaagtgatttttaaaatgtactggtcatatattagtaaaccaatgctttcaactttgaaacttaataaactccttagacaatctggttcttaattttaagaattcttaacatgtttaagaattatttctagatcttttattatctcattcacacatctaaaggataatacgttatatgagaaatagttgaggaactatattatcttttctgcaataaccaagggtctatggtgtgaaaaattgacttgtttgtaaaactaaagagcagtaagaaaaaagggtagaaataacaaggaggccattaagaagtacttcctagcattaaaatcccaatgatcaaaagtgtcagaaactagaggtccctctgagagagctgttgaaaataaggatgatgcctgtactaaataagaggtttgactggatgatctctaagacaactgtaactctaagattgtagatttaggtcagaaacatgcaataccttttctttctgaatgtcttgtagtgctttacatcgctcctgcaattgctgttctttctttgctgaatcctgctccaatgtagccttggcagtcttcagttcttgaatcaatttattttgatttccaatttgatttctgtttgaaatcaagtcctcctgtgctagagaaagcttctcttctacagacttacaaaaacaattttcccaaattattatatgccatgtttttagtaaattcaacagaaacatagttaatataaacattgtagaaagcaataaactataaaaagatagcatattatacccttcagtaagacaggtaaaagagaaagaattctaaaatattaactctcttgcttatagaaaacatttataatataaaatatttagtaaaatggaagcaattccaaagcctccaaaaataatctatttactaaataaatatttaaagtatttgctgaatgttgatcacatcttcaatattggctagttgatatgaaagaataccaaataagtagggaccatatcagatacactcagagaacatatatatggttaaagtcataaggcagtgtgaaagaaaacaatcttaaaagagatataattaaatgcttcattatgcatacatatacatttggtaggttctatgatgtcccttgacatgctaaaaatattaataaatagtatggtgttatgatatagtggtttttgtccagggttcctgaatcacaactcccacatcctttgttacagttttttgttacaatgttgggtatgttaggcctcaggaaacagaatctcgtctcctgcccttcttccactggtccctaggcaggcctctaatcttcttccccaccccattttctgattgtgagtcttaagactcttccctgaaagggtcctgcctcataccctgggtgaaagaatgcttccataaaaatccaagagaactgggtttggggaacttctagatagctgaacatacggagcctggagggtggcatgcccggggagggcacggaagctctgtgccccttcccccatatcacccaacacatctcttcatctgtattctctgtaatatcctttataataaatcagtaaatgtaagtaagttttccctgagttctgtgagctgttcagcaaactaactgaacccaaagagggtgtcatgaaaaccccaacttgaaactagctagttggtcagaagttctggaagcctggattaatgattggtgtttggagttgtagggagcagtcttggggattgagcccccaatctgtgggatttgatactatctctagggagatactgtcagaattaaattggaagacacacagttggtgtctgcttcttggtgtgtgtgggaaaatccccatatgtttggtcacagaagtcttctgtgttgatgattgttgtggtgtgagagtaggggaaaaacacaatttgagagagtttttcctgaaacaaataggaaggattattttgtcatggaataaaaataataacaacttcacagctgacaacctgatcaagtgaacaaaaagagaaaattcagccaaacatagaatgaggctctatcctgagaaagcacactgtcctcttctcatctatatcgtagaagtagtgattgtcatttaacatagtccatagttgttgactgttttaaagcccaagtattttgagaagaagaagttggggaaaggggaagctttttcactcatgacacttcagttggggataaatatggtaacaggtagataatgggtatggtaggaaccttgccactctcagctgctactgcgaagaatcagcagggtaagagatccaactgatctcttccatcagatctggaaaaagctgatctttcttattctggagatacagctcctttgaaaaggaggcagaaaacgtaatttagcaaaggatccttgctgagtaggcttgtatacagcaagtactcagtaaaaaaaaaaagaaagatgaaataaataaataaagatcttatttatgaggattcttaagcttcctgaaagtttacttcttaccagtaacccagttacgtctttctgatataaattaaatcttaattttcaatgactgccagtagaacactaaaccccttgaggcttttttcagggaagaattaacatcagctagttcttcactaatccagcacctaaccattaattgagaacactgctaagacagaacaggagggtacaagctggtctttgacttaagggagttgagtacatcgcccaaaaagcagaacagccatgtaaaatggaagctacacagggcaggagagtatacgctatgtgccaaatgcacagaaaaacagtgagtgtgagatgctgtggagtggggtttacagaaggctctataccacatgtgggaactgacctatatgtcacaaagggtgagagtgatttcacataaaaaaggagaaaagttgacaaagtccagttcaaacagtctacagcaactataattagttaatagagatcctgatctaatgtttaaaaataccaacgcttgctagagcctggaaagcaaccctaacctctaaccacaagatttccaaaaagcccatggtttaaataacagcctataaaatgttaaactcacaaaacccagtgactgattttttaaagtcaagctcaaaatttggactgctccatgaaatcctttctgaacatgccaagacatgttttcccctgcctctgaactttcatctacatcattcaatgacatagatgaacatttatactgccatgcattttaaatgttcttttcatctttcttattgcagattataataatattgcatattatttcctctgctcagcatctcttccctcggagaaccctctctcccattccatggttttgttgggactatctctaacccatctactccccttgaaataggcaaatccctaaatggatcaaataccaaccttgaccctgattatgccaatcacattatagcaccccagtaaacaaatgatttctgcagtgttccatggtagctgttgtttttgtctattcagcaagttttcccatactttcttaaaaaaaaaaaaaaaacttcatatttttagttgttttttcttgatttctgatgaaatgatatagagtactaggctaagaagatttatatttaattctaaatctattatcctagaattttcacttcactcagggtgtaaattttacagttaaattctacctctacctttcctggacaacaaagagtggtgtacagcatagccaatctgaaatatccagtcaacaaacttaagtacttcataaataatccagcagatggggctaaaggcatagatcaggccaggctaccttccattctactggtgtctaggtatatacactgttagcccatgctctacactgtcaacccatggtagatagccttgaagtagttaggtatcatgttacaaggctctgaatctctcctcttctctctcttatacacaagaccatccaacatcattgaagcaaaagaaaaataataactgatagccatctcttatcctagtctataaatatcatctgaacttccctaggaattgactattttttttaattagcttcttaagtagttcatacacttctcattttaaaagcattttatataaaatttaccaatcttttattttgttaaaaaattatagtgaaatgatgaaagaatggcagactttgaatcagaactaagatttaaccatggttctgttattgtacagcagtaggcctgtcttctctgcaaaaggaagcactgggcctgctctctttggcaaaagcaagctttggaatagaggatctatccaaggtcccttaacagttgtaaaactctatggcagccttgtccctcagctttctctttttgcccatatttacatttgagttattctttcatgtatgaaattattagtacacaacatagctttcaagcataataaaaatcgctggcttaatgaaagaatatcaatcaaatcaattaacattgattaatttaatgttggttcctgttactagcttatgctttgggtaaatgacatccatatggaaagagtgtgatttctataagacttttccaatcaaacattaagtttcatctcttctatcatttaaatatccttcaaattcatccacttttctccatccttgctattaccagcccacaccaccatcgtcttgcacttagactactgcaaagtcttctggtcttcagattcagccctgtttctcattcctcaatctgcagtgagtcatttgcctaaaatacaaatgtaagtaactccctttagtggttcctcactgttcttaggctaagcccaaactcctccacaaagcttccttgactttcaatactttcaatagtgttgtaaggtcaaataataataatttaacactacctaaatcttgtgtggtattttttcttaataacaactattgctaatttttacctccagataaacagatagatacatagatagatacatagatattctactggcactatgaaaattctttcacccaatttcctatctctgtcaaatccttgcagccaggtatgggttcagtccttttgtttcttctctctctcccattaatctctatttcatcctctttaatgttcatcccagttctaatcaactcatacctcgactattagaatttatggagaaaggaagttagtaacctcttaactcatctctccaccactagtctatcccaggtccaatccaagctgtctgcaaaccactaccaggttgttttctaaagtactattttcttcattttactcctctatttagacttttcactttttcccctcaaatataaaatccaatcatctttgctaggcatctaagatacttcacaatttagatccaaccttttaaaccttaattccaaacataaactagtacgccagcaaggcaattatgttaactgtctgcttgctttattcattctcactatggcaccttttctcaaatgtgcccctgaataaaatgacctttctccggagtctctgtgtattcaaattcaggacctaatcaagtcccacctccttcataattccttataacagcctatggataaaatatatgctccctatctaaataaaacattttaatattctttcattctcagaattttgcaatatgcactttaaataaacaaaatcccaaacataggaaagaaacagataaagcatttccccttaacaaaaagagagacagaaaaaaaactggctgaatcctctgtgagagaacacaaatattccattttccttagaaaactggtaccttcctgtgacctaaaaattgtttacccttttcccattatccttcaatttaataaacttgatactttatctaatcaaataacattaccaaagacaaaatttctatacattgttatataattaagggtaagtttattttgagctataatctcctaattttaatcattaggcaatccagtaatattgggaacttgacaaatattataactaatgtcagaattgcctgacaagcaatggtaaaattgcttgcattttttcacaagtggtttacatttaaaacttaacagcagcctatctttaaagttattcacacacaaagacagcataatacttacataagttaacagtgtcacaattaagatatatccaaattatcttactattataaatatgtcattttaaaatgcccacattttaaacaattttttaaagcatgctaatacaaaataacaatttaatagaaaacagcacactattccacaaatactaacatttccttgcccatttggattcaaatagatcatttaataaatgtctataaaacttactgagactttatggtacagtatagtttactataccttaagatcttgcctggtggctagaagttcagattccctcccatagaaatcagattgaagctgtttgaaagtttcctgacttttttcatagttgttttgtaatactgatattttctctttctctgctgcaagttcctgggctgcctgtgttaactgctgctgtagtttattctcaagctctgtctgaaacatacaatagttatttaaaacagtatgcattccaaaaaccaattacaaatataaagtaaaatccagacaactagaagaaaattccaaacaataagatgaactgtacttatgccccaaatttctacctcaatagggtaaattacttataaagtcaaagaattacaaaatctaacaagtctcaatttaaagaacataaaatacaaaagtaattaatttttttttttttttaaaaaggcatttcactgggaagtactatcaggtctcgggagaaagagtaacaactacattctgagggagcatgcagtgctagatgcctcagctgacgtaatttaaggtggaactaagggaaacttgtacatgaaagaaagtaagaagccattactttgttgaagtattaatatatagtttctactcttggaaattcaagaataacttaggaaatttctacaggtcatcttaattaatatcaaggcagaaaaagaaaatctcacaaagttttaaagctcctctaaactctaaacttgtctttagtcttcaagaagattcaggagatatgcacaaattatgacatagttaaaacatatacatatgcatagtatgaaaaataggtatttgactttcaaaatatactaccttcaataaaattgctgttgaagtcattagtgactgccatgttccaaaatcctatattcttatccttgtcaatgtcttacttgacctgtcaagttgtacctgatatagttgattatgtctccttctagaaacactttcttcaactggtttccaaagtactttatattttaggttctcttcctaccttactggtgataacttctcaaaatcttttactagctccttttcctctgctacttctgtgaatgttgagacaccccagagttctattgctggccctcttttaatccatacactctctctttagaagatctcaactaggccgggcatggtggctcacacctgtaatcccaacacttcggaaggctgaggtgggtgatcacctgaggtcaggagttcgagaccagcctgaccaacatggtgaaaccccgcctctactaaaaatacaaaaattagctgggcatggtggtggacacttgtaatcccagctactcaggaggctgaggcagaagaatcgcctgaacacaggaggtggatgttgcagtgagccgagatcgcaccactgcactccatcctgggcaacagagagacgccatctcaaaaaaaaaaaagaaagaaagaaaagaaaaagagaaagaaaagaaaagaaaaaaaacccagatctcaactagtcccaggctttaaagatattctttacaactgactcccaaacttatgtctctaactgcaacctctccatctgaactctgggttcttatatccatgtatcttcctgatgtctccacttgaatgactgacatacctatctcaagcagaaatctggattcctgagagtagccacgagcatcaaaaagctgttacttctgagcctggctcggagaggggggtctgccattgctgaggcttgagtaggtaaacaaagtggccaggaagctcgaactgggtggagcccaccacagctcaacaagccctactgcctctagactccacctctgggggcagggcatagctaagcaaaaggcagcagacaacttctgcagacttaaacgtccctgtctgacagctctgaagagagcagtggttctcccagcatggcgtttgagctctgagaacggacagactgcatcctcaagtgggtccctgacccctgagtagcctaactgggagacacctcccaataggggccaacagacacctcatataggcagctgcccctctgggacgaagcttccagaggaaggatcaggcagcaatatttgctgttctgcaatattcactgttctgcagcctccgctggtgatacccaggcaaacagagtctggagtggaactccaacagatctgcagctgagggacctgttagaaggaaaactaacaaacagaaaggaataacatcaacatcaacaaaaaggtcatctacaccaaaactccacctgtaggtcaccaacatcaaagaccaaaggtagataaaaccacaaagatggggagaaaccagagcagaaaagctgaaaattctaaaaatcagagcacctcttctcctccaaaagatcacagctcctcgccagcaacagaacaaagctggatggagaataactttgacgagttgacagatgtaggcttcagaaggttggtaataacgaacttctccgagctaaaggaggatgttcgaacccatcgcaaggaagctaaaaaccttgaaaaaaggttttttcaacctttttgaatgatgaatggctaactagaataaacagtgtagagatggagctgaaaaccatggcacgagaacttcatgacacatgcacaagcttcaacagctgattcgatcaagtggaagaaagggtatcagtgattgaagatcaaatgaacaaaataaagcaagaagacaaggttagagtaaaaagaaatgaacaaagcctccaagaaatatggactgtgtgaaaagaccaaatctacatttgattggtgtacctgaaggtgatggggagaatggaaccaagttggaaaacactcttcaggatattacccaggagaacttcccgaacctagcaaggcaggccaacattcaaattcaggaaatacagagaacaccacaaagatactcctcaagaagagcaactccaagacacataattgtcagattcaccaaggttgaaatgaaggaaaaaatgttaagggcagccagagagaaaggtcgggttacccacaaagggaagcccatcagactaacagcagatctctcgacagaaaccctacaagccagaagagagtgggggccaatattcaactttcttaaagaaaacaattttcaacccagaatttcatatccagccaaactaagcttcaaaactgaaagagaaataaaatcctttacagatgagcaaatgctgagagattttgtcaccaccaggcctgctttacaagagctcctgaaggaagcactaaacatggaaaggtacaaccggtaccagccactgcaaaaacaggccaaattgtaaagaccattgatgctatgaagaaactgcattaattaacgggcaaaataaccagcgaacatcataatgacaggatcaaattcacacataacaatattaaccttaaatataaatgggctaaatgccccaattaaaagacacagactggcaaattggataaagagtcaagacccatcagtgtgctgtattcaagagacccatctcacatgcaaagacgcatataggctcaaaataaagggatggaggaagatctaccaagcaaatggaaagcaaaaaaacaccaggggttgcaatcctagtctctgataaaacacactttaaaccaacaaagatgaaaagagacaaagaggccattacataatgttaaagggatcagttcaacaagaagagctaactatcctaaatgtatatgcacccaatacaggagcacccagaatcataaagcaagtccttagagacctacaaagagacctagactcccacacaataataatgggagactttaacacctcgctgtcaatattagacagatcaacgagacagaggttaacaaggatatccaggatctgaactcagctctgcaacaagcagacctaacagacatctacagaactctccaccccaaatcaacagaatatacattcttctcagcaccacatcacacttattctaaaattgaccacataattggaagtaaagcactcctcagcaaatgtaaaagaacagaaatcacaacaaactgtctctcagatcacagtgccatcaaattagaattcaggattaagaaactcactgaaaaccgcagaactacatgaaaactgaacaacttgctcctgaatgactactgggtaaataacaaaattaaggcagaaataaagatgttctttgaaaccaatgagaacaaagacacaacataccagaatctctgggacacatttaaagcagtgtgtagagggaaatttatagcactaaatgcccacaacagaaagcaagaaagaactaaaatcgacaccctaacatcacaattaaaagaactaaagaagcaagagcaaacaaattcacaagcaagcacaaggcaagaaataactaagatcagagcagaaatgaaggagatagagacacaaaaaaaacctttcaaaaaaattcaatgaatgcaggagctggttttttgaaaagatcaacaaaattgatagactgctagcaagattaataaagaagaaaagagagaagaatcaaatagatgcaataaaaaaatgataaaggggatatcaccaccgatcccacagaaatacaaactaccatcagagaatactataaacacctctacacaaataaactagaaaatttctagaagaaatcaataaattcctggacagatacaccctcccaagactaaaccaggaagaagttgaatctctgaatagaccaataacaggatctgaaattgaggaaataattaatagcctaccaaccaaaaaaagtccaggaccaggcagattcacagctgaattctaccagagatacaaagaggagctggtaccattccttttgaaactattccaatcaacagaaaaagagggaatccttcctaactaattttatgaggccaacatcatcctgataccaaagcccagaagagacacaactaaaaaagagaatttgaggtcaatatccctgatgaacatcgatgcgaaaatcctcaaataaaatactggcaaaccgaatccagcagcacatcaaaaagcttatccaccacaatcaagttagcttcatccctgggatgcaatgctggttcaacatatgcaaatcaataaatgtaatccgtcacataaacagaaccaacgacaaaaaccacatggtatctcaatagatgcagaaaaggccctcgacaaaattcaacagccttcatgctaaaaactctcaacaaactagatattgagggaacgtatctcaaaataacaagaactacttatagtaaacccacagccaatatcatactgaatgggcaaaaactggaagcattccctttaaaaaccggcacaagacaaggatgccctctctcaccactcctattcaacatagtgttggaagttctggccagggcaatcaggcaagagaaagaaataaagggtattcaattaggaaaacaggaagtcaaattgtccctgtttgcagatgacatgattgtatatttagaaaaccccattgtctcagtccaaaatctccttaagctgataagcaacttcagcaaagtctcaggatacaaaatcaatgtgcaaaaatcacaagcattcctatacactattaacagacaaactgagagccaaatcatgagtgaactcccattcacaattgctacaaagagaataaaatacctaggaatccaacttacaagggatgtgaaggacatcttcaaggacagctacaaactactgctcaatgaaatagaagaggacacaaacaaatggaagaatattccatgctcatggataggaaaaatcaatatcatgaaaatgaccttactgcccaaagtaatttatagattcaatgccatcaccatcaagctaccaatgactttcttcatagaatcggaaaaaactactttaaagttcatatggaaccaaaaaagagcctgcattgcaaggacttcatgactaaaacaccaaaagcaatgacaacaaaagacaaaatagacaaatgggatctaattaaactaaagagcttccgcacggcaaaagaaactaccatcagagcgaacaggcaacctacagaatgggagaaaatttttgcaatctccccatgtgacaaaaggctaatatccagaatctacaaagaactcaaacaaatttacaagaaaaaaacaaacaaccccatcaaaaagtgggcaaaggatacgaacagacacttctcaaaagaagacatctatgcagccaacagacacaggaaaaaatgctcatcatcactggccatcagagaaatgcaaatcaaaaccactatgagataccatctcacgccagttagaatggcaatcattaaaaagtcaggaaacagcagatgctggagaggatgtggagaaacaggaacacttttacactgttggtgggagtgtaaattagttcaaccattgtggaagacagtgtggcgattcctcaaggatctagaactagaaataccatttgacccagcaatcccattactgggtaaatatccaaaggattataaatcgtgctactataaagacacatgcacacgtatgtttattgcagcactattcacaatagcaaagacttggaaccaacccaaatgtccatcgatgatagactggataaaaaaaaatatggcacatatacaccatggaatactatgcagccttaaaaaaggatgagttcatgtccttttcagggacatggatgaagctggaaaccatcattctcagcaaactataacaaggacagaaaaccacacaccgcatgttcccactcataggtggaaagtgaacaatgagatcacttggacacagggcagagaacatcacacaccagggcctgtcggggggtggggggctgggggagggatatcattagaagaaatacctaatgtaaatgatgagttgatgggtgcagcaaaccaacatggcacatgtatacctatgtatcaaacctgcatgttgtgtacatgtaaactagaacttaaataaaagaaaaaaaaaagctgctacttcccccaataaatggcattaccaactacccacatgcacaaacccaagttatccttgatcctcttcctattacctctcacttttgaatctatcagaaagtcctgatgatgcaacttccaaaatatattcacaaatcattataatcattcacaaaatcctttattttccctttagtcaaaccccaccattctctgttctaaattctccaatagagtccaattgcccttagaataaaatataccattctgttatctcataatctaatttgcatataaatgatctggcccctgtctaattatctgagctcatctcatgttaccttctccctcagaaccaaatttaaccatattggtcatctgtttttagaaaataccaacatcaactcaaatctcttcagcaaagcttctttgatcacccaaccttcagtagaattatgtcccatcactatctttcatacctctctgtttagtttctctacgcactaaagtataagctccacaagaacaggtcccatgtctgttttattcgcagctgtgtcgtcttcagcacctagaattgtgccatggcataaaataagtgcctagtaatatttctgaaacaagtgattgaatgacaaatagactggagggcccggaacatttattaggctatattaacagcctagataagagaaaaagaaagtctggactaaggctgtagcagtggaaaatgagaaggatggattcaagaaagctaggagacagaatgataggaattggtgctaactgcctatcggggagcagagagctgatctccctatacagtatctgataacatcccatgccatcctcctttcatagagttcttcttccaattcacattgaagaattcctggatatctttttcacattgacggtcataatgcacttacacattttcttttctaaaatactgcttcttttctttaacattttttcacaaatctaggtttcttaactctttaattattgttctgactcttaactaagctctctgtgaagtctcaataatggccataatagctctttgggctcatgtttgggctttcaatatttttcctttgacaaactcattcattcatttttttaaaatgattaagagcttatttgctagaaaagacaaaattctctgtctttgaggaactcaaatccattagtgaagaagttaaatgaaaaaaaaaacagataaatgcaacagtttgataactgctccattatataatacagttttcttttgctttacattttgctttctcattaaattataagctgcttgaaaataaggggccatatcctattcactttatatttccacattagattttgagcaaagttggtgagggattgttgacttaacagcatgctttcttgattctagatcagtaactcccgaatagtcttatgctatatataatgttttaaatcatctttagattacttacaataccattaggtaacatagcattaacaatataaatgctatgtaaatagttgtttttactgtattttaaattttggtatttttaatgctgtagtattactttttatttatatatatatatgcagaaaatgtgtaagtgcattatgaccttcaatgtggaaaactatatatctatagatatctacttatatatataactctatagctatagatataaaactacatatctagacataatgtgtgtatacatatttttatgttttatatatatatttaagtgtgtacacacatacatctatacccatttaaacattatccttgttttccctacttcaccatgggccagtgacaatgataactttgtcatggcctattattacatggtctaccatatacactgacattctcaggtcacagtttgctatacttccatataatatccaacaactattttacttccacattgtatgagtcacagtactagaaactttaaatacattatctcaatctttacaacaactctatgactccattaaattgagctcagaaagatgaatcatttctctatgaccagtaagttaatgtgtgtccaaatttaacaaaattaaacaaaatttgcattcagatctgcctggcttgaacatctctagattacttacaatacctaatacaatgtaaatgctatgtaaatagttgttttactgtattttaaattttgggtgttttggttttgttttgttttgcttttttgagatggagtctcactctgttgcccaagctggagtgcagtggcacgatcttggctcactgcaacctctgcctctggggttcaagcgagtctcctgcctcagccttcggagtagctgggactacaggtgcacaccaccatgcccagctaatttttgtatttttagtagagacaggatttcaccatgttggccaggctggtctcgaactcctgaccttaagtaatctgcctacctcagcctcccaaagtgctgggattacaggtgtgagccactgcacccagccaattttgtattattttttaatactgtactgttactttttattgcttttcttctcccaaatattttcaactccaactgcagttacagaatctacagatatggagggtcaactgtacaggcaatatatattaatcacaaatccaaaagaaatattattataactcataatttttaaataagaaaacatgctaaaaatacttgtgttttttatttcactaagttacgatgctataaaaacgaagattttgtaaatatttggatacaaggctagtatattttgaagaaaatgacctcaggatatgaaagcatacaacaaagtatgcactgtgataattacatgttgacttttgattatatatggtaagaaaaacaaaagaatagacacatttgtctactcttggttgtattattaaagaactactattttgtaaagcagcataataatagctacaaaaacagtggtcaacataaaatgtgtatttttgattgttttaatttatatactttgtactttagcagtatgaaagccaactcttaatggcatgatatatttagtttattctacataggagggattctactatcttctccatagaccaattaacatggacatactaacagtagagaaggaactcattgtgctcaaatatttcatattaagtataatccatttttaccaactcttggtctggacaagtattaaaacacttaagaataaaaaatatgctcaataataaattagaatagatttggaaatggaaaccattacagtgtaacttaaaatattaataattaaaactatatgaagctttacactagtgaatgtttttaagatatcccactttgtaatttttattcttagcccttaataagaatgatttattttaaattcctttaaatttttctaatacacgatgaatgttgcataaattatttccttaagtgttacattattattattattatttttttttgagacagagtacctctgtcgcccaggctgaagtgcagcggcatgatctcagctcactgcaacctctgcctcctgcctcagcttcctgagtagctgggattacaggaatgcaccaccacgcccagctaatttgtgtatttttagtagagacggggtttcaccatgttggccaggctggtcttgaactcctgacctcaggtgatctgcctgccttggagtgctgagattacaagcgtgagccactgtgcccggccagttatatattatttttaataagatagtttcatgtctatcaaatgattagtacaataattttaaataacaattatctgacaagagagttatagtgaatggaaatccagactcaggtatttgataatatagtcaaatgctttcatatattaaacttagaaaaaaattagcttatgtaaacttttcaatgttgcaacttatccatctgtattaatcatcatactattttcttaattgccaagtttttcttcctataaaaagtaaacaaatatatcactaccttctgtaaaacagcaattttaagctctccttggagtgcttcaatttgttttttcttctgttcacttgattgctttagctcatttatgttcccctgaagttgttgctcttctttttcattttgttttaaagtattctgggcctgtataagttgttcctgcattgaattgagttccaatttcaactgatgagaagcctgaaagaaaaaaaaaatctatttagccttcatttgttcattcaaaagacgatgtactgagtaactagaaaaaaaaatctatttagccttcatttgttcattcaaaagacaatttactgagtaactactacactccaggcactactctaggaagaaattactgaggctgttggctacagataattagtaaagatacctgccctcatattgctttcataaccaacactattcactattaggtgacatgctggattaatctttattattttttttaacactacctttctttttgacttataattgtatagttacagcttgtaaatgatctacattagtattctcttgtattatggaaaataggtatgtcaacatcaatgtctaaattgttggatgtcaactgtctttcaagaatattctcggccaggcacggtggctcacacctgtaatcccagcactttgggaggctgaggcgggaggatcacgaggtcaggagatcgagaccatcctggctaacacagtgaaaccccatctctactaaaaatacaaaaaaattagccgggtgtggtggcaggtgcctgtagtcccagctactcgggaggttgaggcaggagaatggtgtgaacccaggaggcagagcttgcagtgagccgagatcgtgccactgcactccagcctgggcaacagagcaagagactccatctcaaaaaataataattaaaaaaaaaaattctcatatgccactaagcctattggccacagttgtcgcaaagaatagctctatagtaactatgataaaaacaaaatcacttttgacaaaatacatttagtatctgtctgatgacattaaattacactgcacaggccaggtgctcacgcctataatcccagcacttttggaggccaacgcgggcaggttacttgaggtcaggagctcgagaccagcctgggcaacatggtgaagcctgtctctactaaaaatacaaaaattagccaggcgtggtggcaggcacctgtaatcccagctacttgggaggctgaggcaggagaatcgcttgaacttaggaggtggaggttgcagtgagccgagattgcgccactgcactccagcttggctgacagagcgagactctgtttaaaataataataataatacactgtagaatagttacctcatttagagatctggggcatattttactactaccttgtttgtacaatccactaggatatgtttctgttcaaattcagacatcatacagaagtcacactgaagttcctctgtcaccaaggtaaaccactattatctcccaccctccaaccaaagtcatgttttcatgttctatgcatattttactaagaacctagcattacattcaagcatttgaccatatccaaagttacttttgaaaaaatgttagtgttatatatagacgtctcagcttatctccacaatgaatagcaaaatatttttatgcaaaacaggagtcagagagtatgacaataaggatgatatatgatataaccaatgataaaataataactagcatgagcatttactttattatagtcagtgtactgagtactttaaagatattaacccatttatttctcacaataactctatcacatagattcatatagactctatcatatagaaactagagcacagagattaagtatttggtctaaaagatggcgaaatggcatagctaataaatggcatagccaggatataaatttgaacaatcttgattcagaacttgggcatgaagcaattataattttgctacttacatggctggcatctacaacacaagtctgctttcaatcaacaactagaatacaatcacatcaaatacttgtcagtactatgtcttgctcctttatcaaatcagattttctagaaagttgcatacctagactctagcagctagcaggtatggcttcagagagcaacaaccatatattatacccatgtgtttactcatttgcttgtctgtttttgctggaaacaatagaagcattaaccacagaaaaatattttggttgttctacaaccattatcaagtatacattagtatgtgtataaatgtccatgaaataaagagccataaagagtccatgaaataaaggtcatttctatagaaagccttttaagatttttttttcaaccataaaaatggtccttaaccctgtagttagctgactcaattttctacctttattaataatatttctttatttgggtctttgattataaactagcttaagtctttttaatagtaggcaaaatacaaataacaattttaaactatatacatgatttgttacatttcagagaaatgaacctatgacctaaatatcagtatgaaaatgcttatttttcttaaaactataaaaaaaaattatctgtggaaatgcccccaagaacaaacatgctttatatatttatttgaaaatataaagaccttactatactttacagattttatgttacaaaaaaaaaatcttacctccttctctttttcaagtgactttttcagttccttctgttccttaagtgtgttttccatctgcacttgaagttgatgctttaattctttgcaagttttttccttaaaaaaaatgaaaactatattacataaaaaatatttgtaataaccttaagaagtttagtttataaccttagtaagatacacacgaagaaataaactaaaattatgatgagctaagatgagacaggatcatccatttcaatgataaaactaggaaaatattacagaagtaatggaggagggacaacaaaacactaagggttttgatcatcaaccaagtcacaatggcatattttaaacattaaaatgatatcttagaacactttagaaatcacattttatgtcacacaattcattataattaacttgccacactacttttatagcaatgggcttcaagaaaatggaagcaagaaaacttaggaaacaataaattaagaaatgatcacaataggaaaagtgtacagatagaaaatgttttctctaaacagaaaagaacataacaacacacatgagaaagactaatattcaactgaaaatattcttggcctttagaaaatggcgtgcacacaggtgcatacacacacattattatcttgggcttcttctcaggttaagcaatcccaattaatttcctcataagaactactttaaactatttaaatgtggaaagaaaagcaaactgtgaattaagcagaaaaatcagtacattttaaataaaataatcacttctacctaagaaagtaaatgtaaactactaaccaagtctaatatagcggcttttcctttctgattctccttttcaaattcacttttagagtttttcaaagaatcagaaacttttgatagtttgtcctttactgtagaaagctctgtcattaaagcttctttctccattttcactttttgtagttctgttactgttgtttgaattctgttattcaattcctcatgctgaatctttgtttcttgacttaaagtttcaaaatcttgtttcaggatttttttttcttcctcttgcttggtaagcttttgcttgatactttcaagggcttcagattttttctgtagatccaatcttgtactggatactctaaatatttaaaaaacaatctttttaaataacacataatttaccacttctaatttaccattcaaaattaatcacaaacaattactgagttctgaaacttttttgtatagttcacaagtaaaaataatttaatttcataaaatcgcaccactgaaaaatactttagaacatctcatttgatcatttaacagatgtagattatttttcccaagtcaaataagttagtagtgaagacaaaactatctaagcttcctgacttaatccatttttgtccgccacaactaatcccgaggaaaaaaactatgtatcacagaccctctactctataacagccagaaacgtttttccataaagaatctattcattatgttagttctccaacacagagagaactttgtctctttccttgaaaacatgaaacacattatgtgtgacagttcttaggcttcaaaatatttatggttaacccagaaaaaaatcaaagaaagaaaattaaaaaaatattttatttacaatatagagggaagacaaatgatttactttaaccctagaagctagcagattatacaaaggatttgttatcatttgttccttaatatagttctcttatacatgaatgaaaaaagcaacaagaatgaagaaataaagttatagctttagaaagctatagacttttattgttttcataaaaggaactatgcaaattatacagcaaaaccctcaatacactataaataacagccattttaaaagtcaaaaccagatgctaagtaacagtatttctagaatgcacactagttccaatgtaatcagaataaatttgtaaccaataaaaataagtcaatatgttaaagggaggttgttaaaagatgtactaataaagtatttgaaattgtgtattaatacaatatcaaaactgtatttatacctcgaaatctaattttttagttctagaaacacacttttacctcctaaaaaatagctggaaaagatgttaaagcttaataggttcacaagatattattcctccttgatttttaaaggtccaaatggaaaagtcattatactaatattattttacattttaatatagttaaaatccctgttaagcaaccttagaattaagacttgatatatttatttactatgctgcttaactttttcaaaattaattacaaaatcataagactatgtgaatcaaagaaagcaaaacagaaatagaggcttacatagtcactgtgacacttcttgtttttttttaagtaactaagggaagaaataaacaagtccacaatcatagttggaaactataatatctctttttagaaactgatagaacaaccagaggaacaaattggcaagaatatagacaataagaacagcactgtaattgttatttatagccactccacccaataacacagagtacatatatgtgcacatggaaaattaattatgataagccatatgctgggccttaaataagacttactttcaaaagtttgaattttaccaagaatgttctctgaccacaataaaattaaattagaaattagggccaggcacggtggctcacgcctgtaatcccagcactgtgggaggccaaggtgggcggatcacaaggtcaggagatcgagaccaacctggctaacacagtgaaacccccatctctactaaaaacacaaaaattagccaggcatgatggcaggcacctgtaatcccagctactcgtgaggctgaagcaggagaatcgcttgaacccaggtggcagaggttgcagtgagccgagatcacgccactgcattccagcctgggcgacagagtgagactctgtctcaaaaaaaaaaaaaaaaaaaaaaatcagtaacaataatatacctaggaaagcctcaatatttggaaagtaaacatacttataacctacacattaaagaaggaatcacaaaggaaatcagaaaatatattaaactgcagaggaatgaaaatacattgtaagatgggagggaaacattgggtgtataaatgtaagggggccctcaaaaaggggagccctgtatcctgttatttgggctaagccctgggctcatgggtggggtttagtcaaagtctctatatgtttatctgatataagagcagaagggaccccagccctccttgcctaggtagtactccagaaatgtgagaagacctcagaggagaaatgtatgtacaaagtacataggcaagaaagatcttaaaggttttcctaccccaataggatgtgggagccctgtaagtgaattctgaaccatgagattagaacatagaatgaaaatgggtccacttccattgggcccattggaaacagaaagaaccattgggcctgcagagtttttgaggaacagaacaaaagccatctcggagatgatcttcatggactgatgcctgcattctagagataatgatgaaccatttggttggtaatgtaatggatcagatatgctcctcaaatacctaggcactggaaactaccgtgaggaggaatgccacctgaggcacaagatgcaattctataacctccgattcaaagcatcaggacccaatttactagatatgaaaatgagaatattttcaccatcatatccccaaacaaggatgaaaaccatgaaggtgtgaaacaacttaatcatcaactctgatgggttttatttcacctttctgaagaggacttttctcaggttcttagtctctacctttactactggaacagtcaagagccctcatccccttgacacaagtcaagtccatcaactcagtcagagcaggtgatttgatgtttaaagacaaaatgtactcaaatgtaaccagttatatgaagacattcaaatgaattgggtggaactgatttttatccatcaaaataatggtgagtgatgtgttcattgaagatctcatcatggcaggacccaaattcagcatcaacatcaaggataagctgggcaagagactaattctaccttgggagtgaacgaatgatgctgcagctaagcacttctatggctatatatgttcagaagcacatgcccattctgccaccagagacatttgaaatttcatatactaataaatcgtataggtcccaataacttctaaaccaatccacccttatactcagagctgccatgaatccattgagcactttagtgcaaattagaaaaaagataccctctttcaagataatttattccatctgtggcaaaactgtcataatacactgattttattagaataaggctacatactaccatctgcagaaatcttacatctagcattgacaagtgaaaagtgggtaactgaaaaaaagaaacagatactacaaaatgtagacagacacagtgacgctttcacatttaaaagctattaaaaaaaagcaaagtaataaggtctaaagatggaaacaataaagaggagaaataaataagatagaaaactgacaaaataaatcaaaagctttttacaatagtctgataaaactgataaatctctaattaaattgatttttaaaaagacaaattagcatgattaagaataaaggaggaacactactacagatcctaacagaccttaaaagtgtaatattatgaacaactgccaataaacttgaagtttagaggaaatgaacccatttctgaaagacacaatgtaccaaaactgactcaagaaaaaaaaatcaggaaattagaatagctctatgtctattaaatgaattgaaccccaaatgaaacaatccagaaagagaactctaagcctagccagttcactagtgaattccatcaaacttttaagaaacaaataatatccatctcatacaaactatttcagaaaggaggaggaaatacttctcaattcctttttaaggccagtataactctgatatcaaaacctgacaatgatattaaaagaatactacagaccaatacccctcataaatatatgaaacatttttaacaaagtattatcaaatcaaaaacagcaatatacaaaaaggtaatacagcatggtcaagttaatttatcccaggaaagcaaggttggtttaacagtaaatcaatcaatgtaactgaccatattaacagaataaaacagaaaatccatatgatcacatcaacagatacaggaaaaaaggtgataaaattcaatccaagcacggtaatttttcttttttaataatttttttttttttgagacggagtctcgctctgtcgcccaggttggagtgcagtggcactggagtgcagtggcatgatctcagctcactgaaacttctgcctcccaggttcaagcaattctcatgcctcagcctcccgagtagctgagattacaggcgtgtgccaccatcccctgctgatttttgtatttttagtggagacgaggtttcaccctgttggccaggctggtctcgaactcctgacttcagatgatctgcctgcctcagcctcccaaatttctaggattacaggcatgagccacaaggccgataattttttttttatatataactaggtatcaaaggtaatgtcttcaatctgataaagggaatctcagaaaaacctacagctaacctcaaacttaatgatgaaacatttaatatttcctgcctaagattagaaataatgcaaagatatttgccaatactgtttacattcacaatgttactggatgtcccagccagcaagaaaaaagatataaaaggcctataggttggaaaggaagaagtaaatttgtctctattcacagataacatgaatgtctagttagaaaacatcaagaactctacaaacaacaactaaaactaaaaagtaaattgagcaaggttataggcagaaaagtcaatatatatttaaaaattctatttttatactagtcataagtggaaaattaaatttaaaaaacaattacatttacaatagcattaaaaaaatattcaggaataaatttaacaaaagatgtacaagatgtctatgttaaaaaccataaaatactgctcagagaaattaaagaaggcccaagtagataaagagacatatgtttgtgtattagaagactcaatgttgttaagatgtcatttctccccaaattgatttatagtttcaagggaattctaatcaaaatacaacagttttatttgtagacatgtacaagttaatacaaaaatgtgtatggaaaagcaatgaacttacaagagtcaagacaatcttgaaaaataataaaggtgaaggattaatatctaatatcataaagctacattaaaaatataccattttatggtatattaaaaatatcttctggtttcttttgtgtgttatgccacaccaacttagctacatttatgactttcaatatcataattatgatattagatactatgatattaggtaccaataccatgatactggtgtcaggataccatatagacacatagactgtggttgtctacaggaaaaggataaggaaggtattgactagaagggcaagtgagaaaactcctggagtgatgacaatgtcctatatggtgctgtggctagatccacagatacacagaatatacactgattaaaactcaaagtacatatgtaaaatctgtgcatttaactatgtgtgaatttcgcatcaataagaaaaacaagaaggcacactggtttttgtgtttcctttgtcttcataaacatagacaatctgccaaaatgcatcacaaagctgaggttattttttttttttttttctttttgagatagagtatcactttgtcgcccaggctggagtgcagtggtgtgacagcctcgacctcccaagctcaagcaatcttgctatgctacccaggctgagaagatcacttcttataagaaagaatccattccctatttggtatagctagaaggctaactacttttgggtaacacataaatatccccgaattttttaattttacagtaatttattcaaatttgtgaacaacataaaacaaggtttatgccagagaaatgagcaccatatcattgttgaaaagaaactggatgacccaaattttataaaactaagttttcagtcctttctagagaagtttaaccctattatgatggctttattttttcattcacattaacatcagtttataaaatcaacacaaaataaatatctaataagtctttaagcactacgatagcaaaatttaaatctgaaggaaattttaatacttagttcacaatcttttcccttaatttgtaagtaaagtggtttagcttacatttccttctccatttcaagttgtttactcaattctgtggctctgagctctaaatctgtgttcagctgtctttgctgttgtagatcttgcaaagcctgctccttgcttgctttaacttcaagactatcagcttctagtttctatgaaagaaatatgatatggcagccattttaatattagtaattatcaatctattattaaatactataacatttttgtttatattcaaacaggtgtgacatacaaaaaaaaatttattataataaaaaacatattctgaaaccattactaagggtgttatttattttaaaatctttcagaagacccagcagaaagctttatacatgatagactgccactaagtgttggtgtttaaaattaattctgggctgggcgcggtggctcacacctgtaatcccagcaccttgggaggcagaggcaggcagatcacttgaggtcagaagttcgagaccagcctggccaacatggtgaaaccttatctctactaaaaaaaaaaaaaaaaaaaaaattagccaggcgtggtggccggtgcctgaagtcccagctactcaagacgccgaggcaggagaacggcttgaacctgggaggcagaggttgcagcgagctgagatcgcaccactacactccagcctgggcaacagaatgagactccatctcaaaaaaaaaaaaaattaattctgaatgaaacaatcaacttaaaagaaacatagaaacataaatagttattatctcagtaaaagttattaactcaagtatgaaaaaataagttaacaggttcactgatctactcacttaaaacatattatcttttatagtcacagttaaaaacactgatgtaattataagatatttaaaactaaaatgaagttctcacgtactccttctcattaacacctattgatcctaaatataaagccaattaagttcctgattttgcttctttaatctcttggactagatgacattgttgttcttcagaatatagtttgcatctcacatgtatacatgtaattatgtgtgtatttttacaaacttacaaaatcaaactgttgaatataagtttgaaaagctttacacaatgcatttccttgcagtggtagtgattttgcacactaaatattttataaactgattggtatctgtagcccttaccattgacctacactgaaaatattcattaaataaaagatatttgatgtagctaaattaattatacatgtctatataaaaaatatgatactccctaaaatgataattacaaagtgttagagctgataatcacaataaaaactcagttctaaataaccactatttttaataggtacccaaaaagaattctcattagacacttttcagtaaaataatacttctgttatttttaaccatgcctaaagtaccttgcctttgctattatcgtttgtcataaagaaaaaggaacctataaacagaattgtaaatgtaattattcccccatactatattggtatgtatgtacatatattcatttcatgactctaaacttatacacacacgcttcaccgggttgaggaagtataagttacatatatagtaacttgagaagtttttgtttaactgatagtagctcaatttttaaaaattttttttttttttatttttagccaaaggcagttaagcagcaagcggttctaatttgaaggacacaaaaactcaggtcaaatccttctgagatgtctaatcatcttatctcttcagtaaatcaacacattcatatggagttgtgttaaagtaagatacagtttatcatagtctcaatgtgtttttaaattagaagcaaaatccaaagggtataaagttctaaaaaggaaaagtctaccatatctgaaatgtgatattggagtaagttggtaagagatggaagaatgaaggaacagaagagacttcacaacaaaaaattgagaagttccttgtaatggtagagtagatacctggttatctgtctttggaaaaagtaacacattacaatggaatcagtatgtaagttgactgtcatttataaaagatgctcattaagggagacattaaaaataaagatagaattcaaacttaagacatgaaaaattacaagcaattttttaaaaattttataccacaacttcacctttctttgttaactaaaaatctttgattccatgtaggtcatgagattccattgctactgaagtagaaaatatgactaaattcaacttcttttatacaaaccttaatttgaccttctagctcttcggttttctgttctaaagagaggtatttctctttatattctttaagatgactttccagctgactgcaatgttcttgcttgtcttgtaactttgcagtgacctgatccaactgagtagtaatcttatttaactcctttagaaaagtacaattgaagaaaactttggtaaggtttactatattgtagtggccaaatgttcaacgtaaaattgaaaactctaattttatttaaaaaaatatttggagtaagagctcagataaatctaatgatatatcagaggctatacttacctaccaatataaacgacatgaactaaattcttgcatagtctgagatcctaagtttatatgtataacagtttaataacttttcaatgtttatctaggaagaattattttaggagccaaatattagccaggctaataataaaataacacttttatattataattaaatattttcaatgttcaagacaccaatttttaaaactattttttaaaaatattacagtgtttacatttatgatgcttttcaattcatttggaatatccagttgcacaaaaaaaaaaaaataaaataaaaattactagtaaatctactatgtaccaaaagtaggacacataccaaatttaacagcaaacattccattcaaatgggcttttcataaagggtaaatatagaaaactgttttgttctgttttttaacttgatatacttctgtattgttttttaaaaaatggaccaataaagccaggtgcggtggctcacacctataatcccagcactttgggaggccaaggtgggtgaatcacctgaagtcggagtttgagaccagcctgaccaacatggtgaaaccctgtctctactaaaaatacaaaattagccaggcacggtggcacatgcttgtaatcccagctacttgggaggctgaggcaggagaattgcttgaacccggcaggtggaggtttcagtgagccaagattacaccattgcgctccaacctgggtaacaagagcaaaaaactccatctaaaaaaaaaaaagaccaataactaatattactccctgaataacaagtaaattttaaaaatttctaccagtaaaagctaagaaaaatctaccagcaacattcaccgtgaccctaaagtaggatgcttctattctaccagagtatcgcttctgtattccctccagctcctcacttcctcctattaccaagaaaggagtaactcttataactgaggtagaatatacagtgttcttttcctgtttccaagtggcaagtacatttgggtcatggtccagtctacctactaaaaacaaatgtggtggtctgccccatccaatcaccaacacttgaagggatggggcaacaattcaaaagttaggaggaaacattactgctctacaccaaggtctaggctaggggagaaggacaatatcaggaaaccaaccacacctgcacactagtagaaatttatcaaaaacaaagctgttatttttatctccatctatgtgacccccacttttactactcaactggaactcatggagaaattaagggggataagcaagtctatcacaagattatacaaaactgggtatcatctttacatgtttgcaatttatttatctaccaaagcactaggtgatagtatgaaattgcatctgtttccctacctgctgtttatcttgtaatgcattttgagctgtgtccaaatgattctgaagatcagctctttgagcagtttttgctgcttctgctgatagtaatagttcggttttggctttaatctgtaacagcatttacaaattatttaatttatatttagttcttgatttcctcttgcttgaacgcacactccttttgtgactaaacaaactatttaaaaattaagtccttggcaaaaacatatggatttatatattgaaaaatatgtatgtgaaaatcgccaaaataggaatgataggggagaagactcctaataatgctggataaataataaaaagatatcctcatgtgattccaaaacactttagtattcctttgctaagaaagaaaaggtacactttttttccaaaaaaggccactgtattttcagaagtgagtatctgaaagtctaccactattatgataaagtaaataaccatgccccaaaaaatgattactccgaagataatcaagaattacagaattcaatgactcaaaacagccagacaactggcactttgtaaaattcagtattccctgataacttctcacttaaagggttttatttttgaagctcacagtcaaaatattaaatattaaaaattcaaggctgccaataaaatcaaacaagcaaaaagatctatcttgttatcaaaagtaacacctttaagtgttggaatacctttagtacaactcacctcgaatacgaaaagcaaaaaataggccaagtgcggtggctcacacctgtaatcccagcactttgggaggccaaggcaggcagatcacaaggtcaagcgatcgagactatcctggccaatgtggtgaaaccccatctctactaaaaatacaaaaattagctgggcatggtggcatgcacctgtagtcacagctactcaggaggctgaggcagaagaatcacttgaacctgggaggtggaggctgcagtgagctgagatcgcgccactgcactccagcctggcgacagagcaagactctgtctcagaaaaaaagaaagaaagaaagaaaagcaaaaaagaaaatatatatgtaaaaacatgtatttaaaattaacatattttgagaaaacagtaaaaatggggggtgcattcttttagctggttgaagagaggatcaatgaacataagaaatctaagatttacattgtatggataattacaagctgaaggaaaaattcaaataattttttctcaatatcaaaatacttaattttcacagaaataatagttacatcaaggtatatacatttacattgatttaaaggtgaaaactaaagaaatcttccctttaaacaacacatagtaaatctatactgatgaatatatagcatagactacaaatatatttttgcagaagtcagctttatttacatacggcatttcatctatctgaggaaccaaaaactcatgaaatattttaacatatgataatcactcatgatcttttttatacagcatgcttcaactaatgtaatatatgtatattccaaaatcatgtagcatataaagaaagtttgggggaaattaagtaattgctccactagtttgccttattttagaaaggcttctgatggggggcggggggggaaatgtggctattcatatagccagcccctctgtttgccctttttataggcaatgactaagtaccaattactacaaggctacaattgttgcaacttttgcattaaagcccttaaaacagtaaaagcagtgaagtgccctcatacatgtgcataataatgtaccttgatgctgtcctgatcatgcacacaaggaagtaccgtggaagtagagatcaaaaggtgtattatggaactttaaactgagaaacagcttaaaagcctcatttgtatagttaaagggacactccagaaaaaaacattaccttaacagttaagctacagctggctacagctaataccctttggctaagcacttttggttgacattcttttattaataatatcacttaaagcactaggtttttctcagagtcctaattctcaaaagaaaagtaaggccatacatcctactttatgaactaacactagctcataaagaagttaaagtagttttgaaaaaagcctcaaaaacttaaaaaatatctacaggtaatatttttcagagtaatggcaaagaagaagttactgtcaaggtgataatgggagcaatgatagtaacaaaaaaatgggctgatctcattgctggaactagttctgaaatgaatagcagtggaagagcaatattttgtaaaggaaaggagcttacaatgcagaaagaatcacagactgccctaatatattagttcattcacattgtcactagactcccattccctcctcattcccctcccccttatatttgacatccacataacaggttatctatcatataactcatctagcaaataattttttaaaaaagaaagaaatgtatattctctccaagttctagtaagtatgccagttatattattatattccgtctttccagtggaatcattatcttacagtaaaatcaagccttgaactatttctataaatttctattctatatcatagaataagaaatcaatagtaagaatggagaaaaaattatgtcttactgcttaccccatgattgactcattgaggaagactgctatatagaattctgaaagaatacggcaccatgtaagggaattttttttttaatcagaagtcagacttttaaaggaagatttaaaaaatcaaagtcaaaaaaatatttagcatagaaatctaatggtataatatctaactaatttgaatgtaaaaaacaatcatggcatgatcaaaacaaggaaaatctaaaagatttagtgatttcactaggtgtagcttgaggacagagagagcgcacctgagagcaagagccagagacagagagacagagacagagagagagagggagaggagaaaggaagagtgagaggaaggcagaagggaggagggagggagagacagagagggggagcaggggagaaagtcaaacaggaaagttcaacaaattatctagatatagcctttatctaattcttatttcaaatttttttcaattaatatgcaaggtaaaaagagatagaaacagaatttaaaacatttgacggtctaaaactggtgctttacacaaacattaaatttaatattacctgtatgtcaagctgggagaccttctccttgctttcatttaattgactatttaattcattgacactagtttctagggaaaggacacggtcttgtgcagctctaagatgtgccttctgctcttgtacctggtcatgcaaattctcctgggcttgtttatgactttctgactgattcttcagcttctctgttagttgagttacctgttatacaagtaagactaatcgtgaagttcacaaatgacataacaaaaattcagaaacctaaatttaagaaccatgagaatattaaagtgctttatgatagtttatctcaaaatttttcaagtaaaattattcacttgccaaaatatgtcaacatagtatctcaaataccaagaaataacattaaattcaaagactgatattacttttaaaattattgagctgtaagttatataaaattcattcaatttaagttgtacaatttgagatttgatgaatgcatacacttatttaactagccatcaccacaatcaagataaagaacatttccattagcccagaatgtttcctcatgcccttctgcagtcattcctcccatcccatctctaactccagccaatcactgatttggttaagtaataagttttctttatatattctgggcatttctgaattgtcagatacacatactgcaaatgttttctcccattctgtgttacggcttttattttcataatggtatcttttgaaaagcatacttttttttaatttagatgaaatccaagtcatttgatatttctttgatgtaccttgcttttgagttcaccaagctttttgaccatgtttttaaccaaaaattaaagttttttcatttgcatccattgaaattttaaaaattaaaattttttcagccagtttctattttcctcctccccacccttctgtgacattaattgtacttatgctagcttacataatactatcccatgggtcactaaggtactgtgtttttttccccatccttttttccctctgtacttcattgtgaacagtttcaactgccttgtcttttacgttcactgatattgctttctacttgcttaatctattaagtacatccaataaaattttcatttcacgttatttttgttttatctctaaaagttcaattatttttattttttttttaccatttctgtttttttttaagagacagggtctcactccgtcacccaggctggagtgcagtagcacagtgatagctcactcccaggctcaagtgatcctttcacttcagcctctagagtagctgggattacaggcacaagttactgcacccagccatttccactgctatctccatcattatagttttttgtttctatccataagcatatttgaagagctgttttaaagtacttgtctggtgactccatcatctcttacttcagggtctgttcccactgaataatttctctcctcgtcatggctcacattgtttctgtttcttcacatgtgtagtaatcttttactatttattgtgaccactctcgattttgttgtcttctttcaaagaatgttttgtcccagcacatatttaatatttttgtggttctactggatccttttaaggtcttttttacacttcgtaaggtcaggtgtatggcagcttttactctagggttagtttagccttactgccctcctaaggtatgacatttctgatatgtctactgaatactccaagtgttcaaccacatctttcttctgattggctggaacctgaacatcttccagccctgtataagcactagtaatttttcagcctgtagctccttgatagtattcattggcctcatagaatcccactttacaagtacaaaacttggcattgaacaaagcctcaagtgaattcctaagcagatttctgaagctttttctctgtactgctccttcctttctggtatcctaccctacaaattcgatctgccttaacctccctgaacttcagtctctcaatttaatttaatatctcacatcctcggttcaataagaccaccaggctttccttagattcccccaagcggtgccacagtctggaaaatgtctctggatcaaaagttagtgtggtcaaagagttcatgtcacttgcttctcttctctcagggatcacagtcctgcactgcctattgtccaatgtctgaaaacagtagtcttgtacattttttccacttttcttggtgtttatggtagaagggctaaataggtattaactatcccaatatggccagaaacagatttattttaatttattctttaaaatgaatgcagggcttcctgaccatatttatatgataagcaacatcaagttgtatacaactaaaaactaacctaaagaattcttcaaaactaactttgaaatttggggggaaatctgttatattctaattctaaaattagaaaagtgatatggctttctgatactttgttttaaatattttctcatttagataataactctcttattacacaattcttccaaaaaagcaactgtaaattcttttttgtttgaaaatgtatttatctaaattttataaacttttcctaaactacattttaatgctggaacattaaggcaacttatcaaaattattattggctatacatgatgcaaagacatatactttatcaaaatatgttactgttaagtctgtatattaatcaatacacagtaaaaactaacacttgattaatatcttcaatttatgaatacatttcattattcttttttctaaacatcacaaaatgccattaggcaagcatgcactattaatatttctgtttttccagtgagctaataatgtaaaatgatttattcatagtcacactaacttacatccagggacatgaactgagaaattttcctttgtcaaatcatgttaactaactttcactacaatagtaacctacctcttaaggtacatgagatgctatttggcaaaaaatatataacacttaaaatgtgctaaaaagagcaagaatgaagaatcatttaaataaagcacttagtaagacttagagagacagaagtaaattttacaaatataatatattttacaagcttacttgctcctgtagtgtatggtttttttcttgtaactggttaagaacagcagtctctccttcaccagcctgaatttttgcataaagatcttctctttctttttctagtaatgaaatattttctttactcttctgtaataaagcttcaaggttctggatcttttggtccttatcgccaatttgacgtagaacttgttccaaatcattctgtaaagaattgaaaactactactttaagaatagagaacttaaaaagttattcctcaaacataaaatgactaataataaattctatcactcaaatactcagtcttacattttttaaaactattacatttcaatatggtaaatttagttaagtacttagaactatatatttaataatataaatctatatcattataagctagaatttaacaaaaaactctcacttaaccacgttttttttctaacactctaatatgacctcctgctactactctttttctgaccctgatttcagacacatgagactcaatctcatactaggcacactcccacttcaaagccttagtgtaccaactgttccttttgcctggaactcttcccccacagagtcatatagtttactccccgttcaactgtttgttcaaacatcaccttcttaattaggactactctgaccattccatttaaaatttcagcctttcccaatattccctatcttggttatcattttctttccatagcgcttactttccaacacactaaataatttgcttacattgtcatgcttatctgcctcactccaaccaccccccattaaaatgtatactctaaaaaggatttttgtgtctcagtcattgatatatccaagatatctgacacatgttctaaaaaagtcactgaatgaatagaaaaataaatgattccactctaaatcacatatacccgcaggctcacttcaataccccaaaagaactcttccatcgatatagcaagagatccctcttcttttactttcacaccactctgctgacacagacccagcaaccatgtggtactctcatgatttgtgccaatattaaaatatttgagatcagtcactttcaagcatacttctcatccttctaagctttggtcaaatgacaaaaggcaaccaaacctctctgcctctcagtctctgttcctgccaccgatagataactcctctctctacattccactaatctggaatcagaattccaggcctaagcttctttccataaaagtcactctgagggaggggaacatcacacaccggagcctgttgggggttgggggcaaggagagggagagcattagagcaaatacctaatgcatgcggggcttaaaacctagacgacaggttgatggatgcagaaaaccaccatggtacatgtgtaactatgtaacaaacctgctcattctgcacaagtatcccagagcttaaagtatatatatatatatatatacacacacacacacatatatatatgtaaagtcacactgttttcaaaccttaactgaaatttgattctccctttacagatgccaattctccctcacccctcaccctgccctggtcggtaatgtctattccactgggcaagtagaggagggttaccttttcctggtatttcactgccattactctctctctcatgtgaaagcttcgtgctgctctggggagtatgccatttacttattctactctctactttttgttgctatcatctattaaatccctacctcattcactgaagacttgagacctgatttagtctttctctcaatcccaatttctgccaatttcctgggaaatacaaaatacatagataattaagagcatagcctcaacatttatatcatcttaattactggacctttactcattccacatttcaccccctcatataggatttgtaaccacctgaaattcttccagctagaaatttctaactatcctactgtatgaccacaacttactgccttccaatttaatgacctaatttctgttattcaatgtcagagacgtcaatttccttctaacgtattcagcatatgcctagcttttcttcctgaacttcctgtgtagatacgaactaaccttaactattctttcaaccacattgtccatttcctttcacccaaaaatttccaaaagccactcccaaaatagcccaattctccattcctttacttctaagcactgtaaaatcacaaagtaaaatcacaaagctccatagatcgacgctactacaaatttctggttccggtttcaacctccatcacagtatatactcagaattatcttgtcaatctttttatttgaatgaggtcctcaccctcaaacattcccctcaataacgacttaaaagattccatattatctctacattctcaatctctgcttgcctgattttcagctcttactatctccaactttatcaagaaacatgagattttcaggaatgatcaatctttattttccaaaaataattttatataaaattatatatgtatatataattacatacacatataattaattagaaccatgtttaataatataaatctatattattataaactcgaatttaacaaaaaaaccttcaattaaccacattctttttctaatgctctaaactcatctcctactactcttcttctgatccatgagacatatatatatatacatataactacatatacatataattatatatatagatatatggagctatgtatatataccccactccatattttcctcctttcctcaagcttcagtggatgagttccatttcaccctcccccattgtatccgttacctcgtagcttcttaacaataccttattccctcagttgcctctcccccaatatccttaataactccctccctatgaatccctttgtcctagactacagacatgtccaggtctctcgtattctcaaaaacattccccatgacacatccctctccagtttctgtccagtgtttaaacaattcacatttacatttcaaaaataatttatatttacattcctaattccctcatctctcatttactcattaatcgacaatcagattttcatctctattactttactgaaattatgtttagcaacattatcaatttacttcttaattgcttactctaattggtatttttcatttatcatactgagcatcgccaccacacaaacccacatttgaaggtgctgattacccccaactttcgacccttcctattcctttggcttccatctgcaggttattcttaattactctgatcattctcactcttccttgggctgctcttcttctacccagtcatcacttaaggggtggtgtttctcagaagtcttatgtaaccaattacctatttttctcactatgctctctcttctggctgatcacatctactctaataattccatttacttcatatattctgatgtctctctcggttaacatatatagcacgattccctcctccgagctttaaattaatattaaatatatcgcgctggtgcctcaagacacatcctaaactgaacacaccacattcccctatgagatggccatttgtctcacattcactaacacagctgatgacacctccacttaccatgcatccaccgctaccaacctggaagtcattccccttctccctcatcccttttatctattaagtcaaccagtgctgtttatttattttacctcctaagtatttctcacatttgtctgtatgacttcaacaactgcttgaactaagaccattattatttttcatctgaactgctgcatatattagtcttttaactcatttcattccagaatattcccacccaaatccatctttcacacatcgacaagaatattctatttaaaaagcaaatctgactatggcaattctttcttaagaccttcaatacctttccatcttcaaaatctttccatcttgaaatataaatgtcatgtgagatctgctataaacttacccatatctaatgctctgacttctttaagtaatctctaacttacactttaaggtccagcaaaacctaagagtttagttcacactagcttcagtatcctttatccttgtaacttctatctggagtaaacttctcactaccaccatctttgcaccccagaaatatctactcatcctttgtgctcagattgtcacttttaaaaagttttccatggctgctcctttccagactctgtttggtttaggtaactattctctatgctaccataacaattttatatacagatacacacctagaactagactcattacatctgttagttgtgaggacttttcatgtttccataatgagggactttgcctggcccctctttcatcctttctgtattcctccccagggaataagaatttaaacttattggaaagtgcagaataagaaacaaataaccatgttcaactgagtccctgctgttccctcagtttgagagacaacctgtctgcaaaagggtgaaaggctgccatttctagctttgtggctaaattaataaagttaattctgggtacagtgtaagaaagcccacttggctgctgacttataccaaattcttcacacttgctttactattgacatttcttccttgacctttacaataaagctcctagagttatctatattcactctatcaaacttttttcttcccattctctcttgaaccccctccaatcaggcttttgtctcacttctttatgcaaatcaccctaatcaaggtcatcaatgacctccatattgccaaatccagtgggattctccatcttcattttgtctggtctccatccttccaaatgcccagactaaaatccttggagtcacccttgagttctctctcaatactctacaataaatcagtcagctttacctttaaagcataactagaatctgacttctcactaccactctaatccaagctacatcatttcttgtctggattattgtagtagccttttagctaatttctatgcttctacttatgtacctatacagtctactctcaacacatcagccagaataattctgtgaaatcataagtcaaatcatttcaccgctttgctcagaaccctccagtggtttttcaacttaactcaaagtaaaataaagtccttaaaattacctatgaggaactggaggttctgatctcctgtgagctctatgacctgccctttttaactcttctaacactctcccatccagccctgacttcccgttattcttgagacatgctcctgcctctggaccatttaacatactaatgttcttctctctgaatcacaggctcctccttccttcaggtctttcatcttttcaaagaggcctaacactgcagtcccaactctggcctccccaaaacacttccaactccccatccctccttccttcatctttatagcacttatcaccatttaacatgctatatgttttgcctatttaccttgattatccttgcctctctcactaagctccatgagagcagatatttttgtctgttttgttcactgctatgttcacaaaatcagttccttggctgagactagaagttaataaatgttttttgactaactgaataaagaacaaataaatgaatccagtattttgatctctatccatctgactcccatgccactctccaaactcagaagagaagggcatattatttattgcctccctcaaactgcaatattgtttctacatatatatcattagattgccatctcctagagggcaagcactctgtctagtcacagtgctgagcacagtgattaatgaaagaatgaattaaagccgggtgcagtggctcatgcctgtaatcccagcactttgggaggatgaggcaggcggagcatgaggtcgggaggacgaggcaggcggagcatgaggtcaggagatcgagaccatcctggctaacacggtgaaaccccatctctactaaaaacacaaaaaattagccgggcacggtggcggacgcctgtagtcccagctactacccgggaggctgaggcaggagaatggtgtgaacccaggaggcggagcttgcagtgagccgagatagcgccactgcactccagctccagcctgggcgaaagagcaacactccgtctcaaaaaaaaaaaaaagaatgaattaaaaaatatcaaagtcaaattcacttcagcatttgggcaacctccccttaccataacaaaatgaaaacttctttcaatattctaaggtatgctgcagactttgtataaatttaacccaaacaattatattttctacacctacaattccagtgttcagattatggttataaagcaggaaaagaaatgaccaacaaatactaagttctactgaaggaaatacaaaatattcttctttactgggctaatgatgccagaaaattttatttgaacatttttcattttccaaatactgtattttagtcaataataaacaataatgaataaattatttataagtaatttaaataaatgtatttaactaaactgatttaatagataaatctaataaatttaagtaaattaatatataaaatataataaatacataataaattagtttataataaatattttacattatgttggaaaaacttttcaacatagtaatcaaaagaaaaataattttctgattatccagacttcaaagttatcaaaatccctcacaatcaagtattttgtactttctagttttaccacaacaaaaggataatgatttggattaattaattttattttttctcttatattctatgtaatggtaattaatttgtgtttacaaggctaataacgcaactaatgtttacctgagcttctcgaagttttgccgtggtgctttgctgaagagcctgttgttcttgatgctgttgctttgttttatctaattgatgctgcaattctgtagaatttgtaactttttccttcaacttaaaaaaatgtagattgtcaattgagaacttaaaggcataatgctatcattcataagtatctggcattacttcaattctcaagtctgaacagaacaaaaaattcaggaatatataagataaactttaaaagtggtaccttggctgggcacagtggctcatgcctgtaatcccagcactttgggaggccaagatgggcgaatcacaaggtcaggagttcgaaaccagcctggccaatatggtgaaaccctgtctctactaaaaaaaaaaaatacaaaaattagccgggcatggtggcagatgcctgtagtcccagctactcaggaggctgaggcaggagaatcacttgaacctgaaaggcagaggtcgcagtgagccgagattgcgccactgcactccagcctgggtgacagaaagagactccgtctcaaaaaaaaaaaaaaaaagaaaagaaaaaaagcagtacctcattacttacagaatcttaatctcatgttaaagaaagtattttctataaataggcttatcctaaaaaaactttctccaggctggcatttagtttattatttttttgtaaactagtatgatcaaggaattaattacatataaattatttttaacaataatttaaaccacatatcagtatttcttttatttttttccttaatagtcataattatcacttattggaaaagaataggatcatctaccacatctaagattttaggtctagaagaaaatctattgctgaagctacagattttatcgtagaatatgtgtttaattctggccagttgtggtggctcacacccgtaatcccagcactttgggaggccgaggcaggcaaatcacttgaggtcaggagttcaagaccagcctggccaacatggtaaaaccctgtctctaccaaaaaatataaatattagctgggcgtagtggcgcacatctgtagtccctactggggagactgaggtgggataattgcttgaacccaggaggcggacgttgcagtgagccgagatcaagccattacactccagccagggtgacagagtgagaccctgtctcaaaaacaaataaaattaaattaaaaattaaaaacttaaaaataaaaaagtgtgtttaattgcaataaagatgcaatttaataacttttactttatattacaggcatcatttatggcaactgcaagtctaatgagggacagcattcaaatatatgcttaatttttaaaagcaaaaatctttaaatggaaactcaaagtttatatataccaactacatgtcattaacgatctttaccaacaattcatagtttactgtttcattaggaagtagtccttcctgagtaggaagactctagcagcctgatgggttcacccccagaatttttcctgcctaaacctgaaagagtagttttccttgtgcatttctgttgagaactttagggaatacaattacaacaaaatgacttaatgtagttaataagcaagatgttgctattggagagcaataaatttgcactttaaaaagtccaattaaagctttgacaattaacagattgatgaatcataatcatgttaaagatgcctcaagcctatcaataaattgaaaatgctagcttacctgctcttctaaccgagaaagtttgagttgtaaatcagccacttgttgttctttatccatcaacttttcacttgaaagctgtctctgttccttcagcctaccatgagcttcccctagttggcgctctgtctccagaagtttgctatgtaactttaaaaaaagaaaaaaaaatgtatgtacatatgtacaaacacacacacagcaccacctactttccaaacaatgttttacttttcaccaaaataagtacaatatcttaattttcgtgatactttggggaaacctaagattttatacagtaattttaactgcaactgaattttaatcatatattataatgaatcacataaaattatcgttaaacatcacaatttttgtttttgtgttatgttactgctctcttaaaacaaatgcaggttcttgtttggatataagtgttggaactttcaggaacttaaaagaataaaatacaacttaaaaattaagacacttagtacacactcagatctattttacagtattgtttaaagttccacagtgattcttgttggttttccatagccaagaactactacagttaactttttacatttgggtattggatagtgcccagtgcattcccaagtcctcatactggcacataatttctaaataaaatacaggaaatgatcatatatatagatatatatatgtgtacatatatatatcatatatatatatatatggtgaccctcattcattaactttacaaatgccacccaattaaaactaagggagttaagaaccatcacgagtagtccaccctgttatacataccctatcctaacagcaaatcagtgttccttcctacctcttacaacactttcctgccactagttcgctctcactaatccctctggctgtgagacacatctgctttcgaactgccacctgtcaaaacctatccgatattcccaattccaagtaccacctcctctctctaacacaaagatttcctgatcacataaatggattaaaaattacaacagctgaagtactaagagggggaacaaaagaaagaaactcttccaatttcccataatatacagaatccttttattataattctcataatctttggtatgatagatagtacttgccttatcctctccatgatatttacacaattattaaaggtaggtactgtctcttactcatttatgtatcccctagtaaatgagggatgtgtcttttagaaagcataaacgcagccaggcacagtggctcaggcctgtaatcccagctactcaggaggctgtggcaggagaatcgcttgaacccgggcggcagaggttgcagtgagctgaaatctcgccactgcactccagcctaggcaacaaagtgagattccatctcaaaagaaaagaaaaagaaaaaaagaaagcataaatgctaaatttgtttatctgaactaaaactcaaatatgtaagttagtttaagttattcattgatatccccatggctcagtttccttccactatgaatgcttatatttattcattcattcactcactaaaacataggcagattaacaagcaaaatgctggctgggcgcggtggctcatgcctgtaatcctagcactttgggaggctgaggagggtggactgtctgagctcaagagttcgagaccagcctgggcaacatggtgaaaccccatatctactgaaatacagaaagtcagtcaggtgtggtagcatgtgcctgaagtcccggctactcaggaggctgaggcacgagaattgcttggacccggaaaatggaggttgcaatgagccgagatcatgccactgcactccagcctgggtgacaaagtgaaactctgtcttaaaaaaaaaaaaaaaaaacaaaaaacaagccaaatgccaggcagtaaaaataaaaaatgagtaagagatggtctttgcacccgaagagttcagagtctattaaagaaagacataaattatgataataaactatattatggtataagtaaaatattaaagatatgtacatgcttaagctatcttgggtgtggggaagcagtggcatgtttagaaaggatttttagggagagtgtggggggggcgggtgagggttgaaaaattacctgttgggtacaatggttactatacgggcaatgggtacactaacagtccagacttcaacattacacaacacatacatgcaagaaatctgcacttttaccccctaaatatattttttaaattttttcaaatatttaacttttattttaggttcagggatacatgtgcaggtttgttatataggtaaattacgtgtcacaggggtttggtgtacagattatttcattacctaggtaataaacatagtacccaataggcagtttttcgatcctcaccctcctcccaccttccaccctcaagcaggtctggctgtctgttgttcccttctttgtgtccatatgtatttaatatttagctcccacttttaagtgagaacatgtggtatttgattttctgttcctatattagctcgcttaggacaatggcctccagctccatccacattgctataaggagcatgatcttgttccctaaaaaaaaaaattataaaaagtgacaagtgaagtaaatagtatctatcaaggtgaagaggaataaaaagaatatttcaggtcaagaagacagactgaatgatacaacaaaagcaagacacagcacacatgtaggaaaaaactaaagacacttccatattcttgcagtgaagaataaggaaaagaagggtaaattgctgaggaggtgagccaacaagatcactatggatagtgcatgtcataacaagggacctcaacttaatccattaggccataaagagttattaatgggcttaaagcatggttggaacatggtaagatttgcctttaatatagattactctgatgcctatataaagaatcaatttgtcaggggcaagaaggaaggcagatcagttaacggttgttacagtggtttaagagtgagacaaggaggacagggccagcagaagcagggaaggagaagacatgttacagaaatattcttaattcttctgattcactgtatcatggaactcacagtccaaactcaaaaattagtattagcatatgtgaagtgcttactctaatttctgaaacataactgaagctcattaaattactaacataatcatgattattattattactaaaggatagaaagccatgaaaattattaattatagtaaaataaagtatcactgccattttagaaaaacagctgaacattatcaaaaaagtagctgagacctgaatatcccccaatttccattttcaaccaattttcaatgttacctaaagcaataattagaacacaggtattaaaaaattaagttaatggcaaagtcaaaacttgcattaaacttcatctgatagccactatattattaacctatacaaaatatttttgcctttaagctagatttacctacacaaaatacttttgtgtaggtaaataatgtagttcaaaatatgagctatataggtaaataatatatgaattgtatataatatatgatatgaataatatatgaattatatatcaatatcatgatatgaatatcatgatatattgtgtgtatatatactatatatataaaatatatatttcataaatatataaatatataatatatatttcataaatatataaatatataatatatagttcatatatatataattcatatattatttacctatacaaaatagccacagcattagggctgattcactttctacaaaatatctaatttttatttattttcaaaaaagttttccctaaaacacataattttttaaaaatatccaatttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcaagactccgtctcaaaaaaaaaaaaaaaaaaatatccaatttgtatgctatttgttttataataatgatgcttttaaaatttagtaacaaaaaaatttcaaatgaaagaatggtcaacaattcaaattaattataatagctaaaatctagtgagtacctacacgccccaggtaccatcctaagcaatttatagtatcaattcataaacatttccccacaaagctgtaagatggatattataatttttttaagggaaactgaaattaaaagaaatgagatctgacaacactacaggatataaaagttaagagttaatcttttaaaatgacaatattttttcaacatgaactatattatgatcaaataaccatcaagtacacgaagaagaaaccagagggagaattacaataaataaaattaacagctcttacttgattaatttcactttggagttgtaacccatgctgctccttttcttctctctgttgttgtagctgcttaaactccgcctttagatgctggtacttggtctctacctcagataattcttctttgagcttttgagtagcttctcctttttcacttagttctacatgtattctatgcagtgaggtttcagatgcagacaatcttgactgaagctgttgacaatctaggtctttttgatgaagggttgcctgaatattctttttactcacagattcttcattatgtttctcctctaacttagtatagtcttgttcttttttcagcaagttttctgtcaaggtctaaaatatcaatttaacaatttatttccttttctaatatttttaattactccaattactcaaacaatctttggagcagtactgtctcctattatacattttagtcaatattaaaatataaaacagtgacaatgttctagtcaagaattaaatcattacatactaacttgtgatttcactattggtccacttaactaaaatctactaatacaacttaagaattgccaagcaaatgttgacataaaaaaaaaataaaatctactggattttttaggttatgtgacatatttatattcttccacttgagttaaaaactgaaactaccattctaccaacaaattattttgagtaacaatatactatgcaaactttgatttttcactgtgcaatttcatagttggtaagagctttagcacagcaatatcatccactgttctaatgcacctaacctattgattgcatctttttatgctcttcttgttaaagaccaagttttggagtcacaagctaagactaattcaaatttttttctaggtgtattaaaaaatgatctaaagctaatcacctgccttaaattttgtcatttttcaatgctatcaagtataaaacacaaaaataacacttctaatcaaagacctggatcaaccaacctaatctaatgtcaaagcctggtctcagtggggttgtaaaaattaacactaaacattttaagtaaacatatttaagcaaaaaacatggatcagaattttaactaaattctgtaagacatccagccaggataagaagctactgtaagtacctggtgagtcagttagtggacctttagtgtacaaacttacatgcagtgtgctggaaggggatgacactgaaataggaaagaacaatcaaagccttcatgctttaaacaaaatatactctaaatgaaatacacacaactaaacaaacaacaaccacaaaaaccttctaagaaagttaaaacataatgcatgagtcagaatgggttaatagaaaagtgtgtcaaatttcttaaggcacaatttttttaaaaaatgagcaaagtcaaggggagctagctagttaagatcatctaaatacaatgaagtttgagcctggttttaaaagcaatgggaaaaatcatggaatacatacatatgatacatgccatctgctctatataaatgtataagacatgaaggaaaaggcaaacaagtttcaggtggggtgacagcaaaaccctattatttcacaggggataatagatctttattgctgcgttccccaacatgggaaacgcagcaataaaggttcttgaatatttgtctaagaaaaagtaagctaatgttacttatcaaacagaaatatactatggaaaagcagtgtccagagagatgataaaagtatgtataagagaggccaggtgcagcagctcacacctgtaatcccagcactctgtgaggctgagacagaaagattacttgaggtcaggagttaaagaccagcctgggcaatatagcaagactctatctctaccaaaagaaaaacaaattagccaggcatggcggtatgcacctatagacctagctacccgagaggctaaagcaggaggcatgcttgggcccaagagtttaaggctgcagtgaactaagatcacgccactgcactccagcctgggcaacaagggcaagaccctgtcactaaaaaaaaaaaaaaaaaaaaaaagagtacttataagagaggatgacagacagacttaaaagtaagaagagcaaccattaagtttacagcaaaattagctacaagatgtgtgctttgactaagcaacaaaaacagaaaaaaagacatagagccaagaaaatcacagaacaaaaataatacttctgattcaactatgttagaaaaattatctttttataaacatttctttgtaattccaaatttttcttgacataattctacatttgttttgtttaggaaaacatttgttttagaatttgtaagcaaattattcattaatctataaatcatcttttttttttctttttcttttttgagacagtctcactctgtcgcccagactggagtgcagtggcgcgatctcagctaactccaagctccgcctctcggggttcacgccattctcctgcctcagcctccccagcagctgggattacaggctcccgccaccatgcccagctaattttcttgtatttttagtagagacggggtttcaccatgttagccaggatggtctcgatctcctgacctcatgatccgcccacctcggcctcccaaagtgctgggattataggcctgagccaccgcgcctggccagctataaatcatcttttgtaaagagaattctaagttactgaatttcataaatgcaaccatgttcacatacactgagaacttggatggaacataccttttaaaatatgctacaaaaattaaggcatataatgagttagagtcttcttccccacagacttacttagaaagtaaccaactaatcccacctttctatatacacccttgagatagtttcactcctttttttttttttttttttttttttttttgagatggagtctcgctctgtcgcccaggtgggagtgcagtggcacaatattggctcactgcaagctccacctcccgggttcacaccattctcttgcctcagcctcccaagtagctaagactacaggcgcccgccaccatgcccagctaattttttgtatttttagtagagacagggtttcaccatgttggccaagctggtctcgatctcctgaccttgtgatctgcccgccttggcctaccaaagtgctgggattacagacatgagccaccgcgcccggctgatagtttcactctttaaaaggcaaaaaacatatggtaacaactagggactgtttaaaattgccttgtcccaaaaaaattaaccaaaatctaccagcattattacaaacatgaaagagaattaaattttctttaaaagtaccgaaaccactttctttctttttaaaagaatctaatccactcacactttgtaatttttacaggcaaaagactaactatattttattattaaaacttttcatttttattatggtcttcccatggaatctgaagcaaaatattatagtgaatacatggtttttgaagagtgactttttaaactatagtgaaattcattaaaaaataataagagcattttcacttctccatattaatctttacaacaaaatatgagatagagatttacagatgaggaaggtgaagttgacagagcctgatatgattggtcaaatggtagaatcatggattatgattctaaatccaataaatttttcataacacaattgagacattcaataaatcaatttgtactccctaaaatatatcctattcaaatttaaattataaaatgcatgttaatcctatgttataacctaattatcatttgagtaagcaaaattcttcccttccaagtatccagtccctttttattttctcaccaattgttatctcaatatatattcttacagcgacaatttccctatattacgctccatttttcatttgttacttgttcagataatgaaatgaatataaaaagagtgccatgttttaatgcttcatagcttacaaagttatttcagagatctcatctcacttgttcctcagaatagcttggtgagaatgaacaaattaaactactttgtagctcgccaacgtctcttattttatgagatacatatgctcttacattgttctatgccttttgtacacctagctctcaaaatgaaatgtcttaacccctctgccatatgaaatgctccttagcaaccttaaagactcagctaaaaagttatgttttatacaaaagccttttactgcctaatttactaggcagtaaattaggaaaactctcaccttggtcttgacccaatcctgtatcacaacacttaacaattaaaaacaacaaccagccgggtgcagtggctcacatctgtaatcccagcactttgggaggccgaggcgggcagatcacaaggtcaggagtttgaggccagcctgacccacatggtgaaaccccgtctctactaaaaatacaaaaattagccaggcgtggtggtgcgtacctgtaatcccagttactcaggaggctgaggcaagagaatcacttgaactcgggagatggaggttgcagtgagctgagatcgcaccactgcactccagcctatgtgaaaaagtgagactctgtctcatttaaaaaaaaaaaaaaaaaaccaacaacaacccacattcactaaggtgcttactaaaagtcaataagcacttttattattttattaatttatgtaatgttcctattaatcctaagaggtaagtgggtataataatatttcttagcaggagagtaaacagactctcagaggcttagtgtcacagccagtaagtggcaaagctgagatttaagaatgcctgtgactactgcactatactgttcttatcaatataccactttgcaatgcagtggtaatacaagcgatataataactactggccaaatgtggctcccactttggcatgtgagcgtcttagaactgggactggtgaaaaaggagagcaatggagaaaagcgatgaaggatgagacccaaaaaaatctctgtctcttccaatgacctatattatattgtagtgactgtagataagcaatataattttgtttagaatttataaggaaacagttaattgagctgtttaaatgtcagaagttatttttgttaaaaactaggaagaaagtttcttcaatttttccattatgtttttaagttttcaaggctagtaattataaaacactggtttaaacctgaaaaccttgacattaacacaaaagcaattatcttttccatccattatatattacaatgttacctatccacgttgatactacctgtgacccacaaaagctgcccaggacatttcatgtaatagccttcaaatgaccaagtaaagagattccaaattcaaagcacttgaaaatcaccactgtcaataattatggtttaccaaagacatggggtaaggaggggtgagagaagtagatagtgaggataataagaaaaggcagatgcaactgtgggcttgcactgactggtgaccaaatcccaaacagagaaaccctttgggaaaaacaaaacaaaactgcaaagtgttaaatttatgtaaggcattattaagattagtagaaggtcttattattccctaataagaaatgttccaattctaacacaataaaataatcttgattctatgtattaatcataaaatagccacaggacttctttcaataatgtgcacgtgtgaatatacatacacacaacacacacaaaatgtgtgctagagtatttgactgtacatttcagctatcaatatcaaatcatgtcctttattaatagcttaatgtttgagaaacacataataacactgatcatcaacactcactgcttgcaaactgctactctacatatcctggtcagcttccaagagatagaaggtaagctctgggttcaaagaaattaaaaatcaaacagagggacaaaggcaaaactaaattatgtagaagttttctacgtgtagtttgacaggatataaaaggggcgcaaggatctagaggtttactagggaaaagcacagctatgaaagattatattttaaacatcaatcaacaccaagagttgatggggaaaggggcaatggtaaactggtataattactttggaaaatagctggaggtcatctagtaaatctgagcacgtgtctgccctacaggacaggaatttcacttcgagtatctaacatagagaaattcttgtactaatgcataagatttatatatgaatgttcatagctataatatttgaatatttgtagtagcaagaaaaataaaaaatagaaagtatacatggaccatttctcctccacaccaaagtataatacagttgtcatgaagaaaagtactcatgtgattgagttatactgaactagccacacttttttttttatgaaacaccacttttactagaaagaccgacagactattaatattcggacttgagtaggaagggaatctgtcactttaaagaatagaattgatagtatttgttgccagtgataaaactcaagctttcaaatacagcttagaattttggaaaacatgtatccaccaccatgagcttgacagcttcctcatatttaaagcctaatctgagattgatggtgatattgacaaatgtgactgtttttatattgtacaataaaatgtatcaaaatttggaagatctgagtaactcagtgaaccaatattttccacatgactaatgcatgatcttataaaatcacgcacaggaaaagatccactcaaaaggcaagatagatcaaattttaatgttacagtgtacaaaaagtccactgactcggtttcagattccacattgtcactaacttttaagacactattatcaaatttgagcacagtatcaaataaagaaagccacaattatctgaaaaagtattaaaatattccttccttttccaactacatatctgtatgagactaaattttcttcatatacttcaaccatatactacaatagatttaatgtaaaggcagatatgagaatctacctgtcctatattaagctagacattaaagaggtttccaaaaatgtgaaacatcacaactattcttgctgaattcttttgttttagaaaatggtcatttttcataagaaatgctatttatgttaatatttaatgagttaatgttttttaaataaattaatatttttaaattacttttaaatttcgatatgacaagtgtccatagatataacctcacccaaaaatggctctttggagtccttaatcattttgagaatgtaaaaagaagtgcttgccaagggcagcaaattaccctgaaacttcatggcagcaaattaccctgaaacttcatggcagcagcctaaaacaatatctattatatcatatagtttttgagggtcaggaatctagaagtggcttaactgggtgatttcacctcagggtctctcatgaggttatagtaagctgctggccagagctacagtttctgaaaacttgactaggattggagcatctactttcaagctcatacacatggctgttggcaggaggtttaatatttatagctaattatatttctctttattcccttatgccctatttttttctttcttgactttttccttattatatttcacgaaaatgttaagttattacaacttaaccaacacattcacatctctgaataaaagggtttcataactctctactgccccaccaccaaaaaagtaaagacaaagggaaaaagtattaatattagtacctcccctaaccccaaacaaaatactatatgttgctctttattttttgagatggaatctcactctgtggcccaggctggagtgcagtggcatgatctcggctcactgcaatttctgcctcccatgttcaagtgattctcctgcctcagcctcctaagtagctgggattacaggcatgtgccaccacacccagctaatttttgtatttttaatagaatgggatttcaccatgttggccaggctggtctcaaactcctgacctcaggtgatttgcccgccttggcctcccaaagtgctgggattacaggcgtgagccaccgcacctggccaatgttgctcatttataaagaaacaatacagaaaatactaacatttaaaaatacaaaacaaagttgaaggcttatcttcctgattttaaaacttattacaaagctacagtaatcaaaacagtgtggtactagcataaagatggacatagagtccaatggaatagaatagagagccagaaataaacctttgcatatattgttgctatggtctgaatgtctgtgtccccccaaaattcatatactgaaactctaaccctcaaggagatggtattaggagatggggcatttcagaggtaattaggtcctcagggttgagttctcatgaatggaattacaaaagaggccccagtgaggtctcttgttcttttcaccatgtgggacacagtgagaaggcaccatctatgaaccagaaagcaatgtttcaccagacaccaaatctgctagtgccttgattttgaacttctcagcctccaaaatagtaaaaaataaatttctattgtttataagctacccagtttatagtatcttattataggagcccaaacagactaagacaatggtcaaataatttctgacaagggtgccaagattattcaacggggaaaggacagtcttttctacaaatgttgctgggaaaaatggatatccatgtataaaagaataaaattagacccttaccttatactatatacaaaattaaatcaaaatggatcaaaaacctaaacataagacctaaaaattagaaaactcttataagaaaacaaaagaaaagcttcatgacactaggtttagcaatgattttttggatatgacaccaaatagaccttaacaaaaatgaaagtagataaattagactacatcaaaatttaacattcctacagaatgggataaaatatttgcaaatcacatatctgataaggggttaatatccagaatatataaagaactcctacaactcaataacaacaatgaaacccagttttgttgcatatggccagcaagcacattaaaaaatgttcaacaacgtagtcattaggggcatgcaaatcaaagccacaatgagataccaccaccctatacccattaagatggctactctcaaaaaagaaaaagaaagtaagtgttggtgaggatgtagagaaactggaaccctggtacagttggtgggaatataaaagggttacagccactatggaaattagtatggcagttcctcaaataattaaaaatagaattatcatatgatctaccaattccacttacaggtaaagaattgaaagcaacgtgacaaagagatatttgtacagccatgttgaaagtggcattacagccaaaagattgaagcaatccaagtgtctatcagcagatgaatgaataacatatatacatacaacaaaatgttattcagccttaaaaacaaattctgacagaagctataacacaaacgaaccttgaggacactataagtcagtcacaaaaagacaaatactgttggatgtagtaacccaaagttgaaaaaatttaaaaaacaacatttttaaaagacaaatactgtatggttctatttatatgaggcacctagggtagtcaaattttagagacagaaagtagaatggaagcttccaggagctagagagaaggagtaatgcagagttaacagttatagaatttcaactttgcacaatgaaaaaagttctagagattggtttgcacaataatgtgaacatattaaacactaaaaaaaaaaaataagtcacattgtactatgccaatatattttttaaagtatgtaagattaatatttaaaatacataaaatcaatttgctattatatatagctttaaaattctcacctgatttttttgtgttaattcattaactgaacttttcagtttttgtagttcctgtacatatacagcaacttcctgggggcctttggcaagttcactccttagctggcttattgtggcctaacaaaacaaaacaaaacaaaaattaaagcaaactaaattgtctaaaagataaaaaaaatgaaagtatataaaggttttaagaaaacaaattttttgttgttggaattttcaattttgttctttatcctaccacctatactgccacattatgcttttttcggcttacgacaaatttttacaatttaactaagatgcataacttcatttatttagtaatacataaaatgaaaatctggcatcctactttaagtttctgaagtatcaaattgcaaacctaaatttactggttcttaaactctatacttcaatcttccagaatttaaagataatatgccagttatatctacatttcctcccaacttctatagcataaaattatccttttactttaagacatgtatatacaaacatgcaacacagagcttgatattagtgaatcatctttctaaattgtaaagaaaatatctttgtccaaagaagttaccaagctgaagttatacacagcttccttaagctagatcactatatggtcaggtataaccgtcaggcatgaacttgctttagtgcattttaattattattatttttttttatacagggtcttgctctgtcacccaggcttgagtgaagtggtacgatcacagctcactgtagctctgagcctccccgcttcaagcaatcctcccacatcagcctctcaagtagctagggctacaggtgtgtgccatcacgcccagctaatttttttattttctgttgagacagggtcttactatgttgcctaggctggtccccaactcctgggctcaagcgactctcccactacggcctcctgggattacagccatgagccactgagcccagcccattttaatattttaaaaaatgtgaaaatcactttttattactaaagcaacagtttgatcatttaaaaataatataagacaaagacaggtaagcaaagatcttggaaataataaatttcgaatacataaaagctgaaccattacagagaaagacgaagtatttttttttaagtatggtctgctgcaaatgacattgacaaaataactttctattatattaatatttctaatattgcttatcggctttactttccactttatttataaagttacaatcatttccagtgtctatttctttattactgaataaactttataatatgaataagatacaagttttaaattttttcttaatacttatacttattcatatcatatattacaaatgagtgctttcatcttcaagggagaaatctcagaaggctactaacttatcacggcaacaatgctattatttaagagatcattggctgatcttcttttggaaacccttccagagtgtgtggaacttatttttttaagggattctcagtggtggtgtatcctcatccattttatggtggctttgattctaagttttggaaaccaacaagtttataggcaaggtaagtgactgaactgaaagatcaaacacttgggcttattttattttaataattattttatttaataaccattttattttaataacttgggcttattttaaaaatcagaaggtaagcgattggactgaatgatcaaattcttgggcttattttaataaccataaattaacaaaattagtttttttagtgtgttccagatgggctaaaagtcaatgaaaataagtttcaaaaatgcttttaggaatggaatatgtctgagatatgtgcatggcctgacctttttgggaaaacattcacttaaaagtacaaattctgatgcaatgaaaggcaatctgtaacattaccatattgttacaccttatacacagtgcttcagtatcatatgtaacagctgatatgttaatatatacataatcttatacaattcaaagaagaaaatgttgaaatattcatgtattttcaactacactcaagttaaaggcctaccctaaaaccatctgtcttaaactgaacatgtaaccttgaaatggatttagctactgtgagtttatttcaaattactatttctaataattttgaatcccaaaattattttgttagtagggtaacaatttgactattttaactcactatgttttaatcatatagcaaaaatgccaatttattacaaaataaaatatcacatttaaatccctacttgtaaatatcttatcaaaaaaatttgcacaggttcctggcacataacgcacagaaataataacagtatatattaaaatgcaaattatgtgtatatctcattaaatatcatgatttcatattgaagttcataaaatttattaagccaagtgtaaggtctatcttgctgataaattccaacatgtagaaataagaatttctagtaagaataagaatagaattttccttattaaataaggaaaatgtaaagcaaacacactccaaaatatcctattttagagcttttttgtatcctattttatagcttttagatatgctcttactgtataaggttaacaactaaaaaactggacattaagtgtatcatttacactttgtacaacaaatttggatattgtgaaaactaaaatttttatatagataaattccagcacttgaaactttaaaatttactcaaggggacaataaggaaagatttgggaagacttatacatccagaggccaactttagttatgaagaagaggagtgaggagagtgaattctggaaaggcttccccttttctattgcacattatgaatcattaatcttttacaataatcacatattatgtttatatttggggaaaaaataaagattaaagacagacaataattacaaaagacaaaaagtaaatacaatccctcttcagatatcactatgggtgaagttcaaagatctctattcatactgaccttcttctctaataggccaagattgtatgtgccttggactttaaccttctcctgggaatcctagctcccactgcttaactctgactcttgcttatttcattcttctcacacatatcctccatgagatcttccccgacaactctaaaactgttctaaagtattcccacttccactaccgcccatatgcactttatttttcttcctcgcagcccttattattacctagctttctatcatgattcagtgtacttgtacagtctgttgtttgatttccacaaaggattaagccttatgggagcaagcattctgtcttattcagtattttaatccccacacctaaagtagtccctgacacttggaagacccaaaaagactcactaaaggaatgagtaattatacctccaaagagataatagatatttatttccaaggaaacaatatattagatcctataaaaagtttgcacttccttggttttctgaaatgttattgaattcaatactgaatttttactaaaaaactttacaaaataaggaaagatatttcaagcaaacatcctgctggtgcattagaattaaaattattgttttaatatgctacaactataagtaaataatcattttaaaatggttgaagctatgcatgattagcaaaacaaaaatgagcatgtcttcaaagctctaagattgccttaaaacataaaattgccatataacaattgaaggtgacacattaagggtattattaatattaaaaagcctcccaaaatcacattacctcaagtttaagcatctccattagaaagcagaaaaagtaataacaaaatggtggatgaaaggtggcagacaagactgacaaaagtacacactgagcacataattaaaatgaccaaacatgcctacacatctagtctcttaaagaagcatactttaaaagatatttaaatactttcatagctatgcatgggtataatcatacttattccatatctacatgaacattttagcacttaaaactgggattcaatgagtttatttggaaaaaagtaaaattctttaaaaatcatttccattaaatactacaccaaatataagttgattacagcttagatattttcaataatgtagatttgtataaatatactttttaacctttaaatcctcaatttccaatccataaaacagccaattatctataaagaattttcaaatgctttagaatgagatattttctatatgccttcaaaaatacccaggcaaaaagaagtcaatgaattcataaggtatgcattcaatgaaaataataaacacaaggacatacatagttaataatgtacaccagattatgtatcttcagccccaactaggtatactagtcaaataaacatttatttgagctaaatgttaaaacacatattcctaaaattgccattaattttgtttgaaataaatgtttacttgagattttaattttttttctttttttgagacagagtctcactctgctgcccaggttcgaagtacagtgacatgatcttggctcactgcaacctccacctcccgggttcaagggattctcctgcctcagcctcccaagtagctgggattacaggcatgcgccaccacacacccggctaattttttgtatttttagtagagacagggtttcactgtgttggtcatgctagtcttgtactcctgacctcaggtgatccaccgcctgggcctcccaacgtgctgggattacaggtgtgagccactgcacctggcccttaaaaataaatttttagcttctttaattcctttgtatgtgttttgtttctgatgccaatatttaggtttggtaaaaacagcaacatccataataaaaattgttgtattaagtcctataattcactaacatacttaattgaaaataactagaattgaattttaataaattaataaaacgtcatatattcagattaaggaaaagctaaaaaacaaatgcagttataaacaaataaatgagatgaagtaattagtaatttttttcatatggaaatggtatgacacaactcaaaagtattttaagctattacccaatacaaatattacaacacacaatatggcaaaattagaaaagtaattaacaataagttttaggacaagattaatagcacaaatttacttaaaaggcaatcatcagaccacctaaattaggagacaacataataaaaagggaatgacacaggctttggacaaaacctgagttccaaccctagcttttatattaggtgtgaccttgaacaatttacttaatctcattgcctctcagattcctcacatgtaaaacatacttaatagttaacttacagggttataagaaacaaatgcgaccacgttttaagtgcctaacatagtatccaaaacctactggtgctcaaaagagtaagagtttgtttctaataataatattattctgactcttaagttaccatttcctaaagttattcaaaatattttaacatagccaaggtctcattcatcactacatatctattaattaaataggtaataagtattattattttattaaaaatataatgaaatattaaatcacctattcagttactcagcacaaataagttcctttctaaatttatttccaaatacttgaaaagataaatttttatgaaaatttaaatgaaaacacgaagaactgatttctaagccattttccttctttcctagaaataccttttctagaaaaaaaaaaaaaatcaccatttcttacaaagccctgtttgcaggaggagacgatggagggagacactaaattctttcacctccctatctttcataactctagtcatagaatgggtgtggtgactcacatctttaataccaacactttgggaaactaaggcagaaggatctgcttgaggccaggaggtcaagaccagcctaagcaacatagcaagaccccatctctaccaaaaataatttgttaaataaagaaaaacaaaaaaactctaatcatagctttttcatcttaaatgacttattctccttagatataaaggtattttaatctacaatagaaatataaattcataaaacactaaaaattcttaaataagaatttattagagtaactcttaaatattacttagaaatgagtaattcttaaattagagtaactcctaaatgttacttagaaatgtcttcccattagcaagttatattatattctcaccttttttttttttttttttttttttttttgaaacagggtctgcctctatcgcccaggctagagtgcagtggtgtgatcatggctcactgcagcctcaaccttttgggctcaagcaatcctctcacctcagcttcccacctagctgggagtacaggtacgtgccagcacgtctggctaactttctatagagacaggatttcaccatgttgcccaggctggttaaactcctggactgaagcaatctgcctgcctcagctgccaaagtcctgggattatagaggtgagccaccatactcagcctgtattttttttaaatgcaagtaaacatgtaaatttattttccttgttaatgttctatttgtttaaaaagtatatgcataactccaaaacttgcagctggaataagtcagagaggactcaactttaaaatacatattcctaaaactgacattaatttggttctgttttagtcaccataatacatttattttaaaatttcaaatagcatttaagatattttttaatcaaaagggagtgtatttttttttaatttgagaaataccaataggcagacatatctaaacaaaaatagttcttactgatacaaagaaataaatgactgggttcaccctggtttaggtattttgacattaacatctgaatagcacttttcctcatgagacttctttgattcagcctctccttgatttcacatttgtacttatagatttatcattgtcttctgctgattaataataccagtaggacaagagcttttaactggcttcagtaagttcatgaaccacctgaaattgtttgaaaatttttggaattaagtgttattgggctacaaagtgtcaattttggaaaaactgcatccaaatatcataagttagagagtgtagtgttaggcatcataaggccttacatgcctatgtgtgttatatccacaaactttcaccatctcttcccataagataaagaaagatttttaaaaatgaattagacatgggttatctataatacttataccccaaagcttgatgacatgttatatttgtgaatagagtggcttttagatcaccagttacaaaactctaaggaagagattcaaattaaaatgttacggtaacaactttttaaactgaaaatatgaaaatcagaggtctactttacataagggagcttaaagactacaaataacagtagtcataacaaaatgtctcctataataaagtaaaaaggacaaaggctaggatttttaagcacatttatgtattatacatcttagagtttattaaatgctgacatattatacaagggatttacaggccaaagtcatgtcatgtaagaaatagtagaagaactgaaaatgtttatcttggaagagaaatactccgaataaatatgagcagtcttcaaatacctcatgtggaaagaggaacaatttattctgtgtaattcctaaggacagaaccagaaccagcgcatgtaaattacagggaaacaaatgtcagctcaataaaatagacttaggaagaaatatgcacaccgtacaccacctagcaaggattgtggatcacttagcagggttggcataaagggaagttctggactgaatttagactagttcaagacttctttcaaattcataattcaaagtccatcaattagaaataagcttatggccgggtgcagtggctcacgcctgtaatcccaacactttgggaagccaagacaggcagaccgtctgaggtcaggagttcgagaccagcctggccaacatggtgaagccccatctctactaaaaatacaaaaattagccaagcgtggtggcaggcacctgtaatcccagctacttgggaggctgaggcagaagaatcacttgaacccgggaggtggatgttgcagtgagctgagatcacgccactgcactccagcctgggtgacagagcaagactttgtctcaaaaaaaaaaaaaaaaaaaaaaaaaaagaaataagcttattacaaaataagcctttcttaaatatattttctaaacaaaattggtaatataattgtagaaaatgctatcattcttcctttaaagtcaattaccatttatcaaccaaccttgagtaaatttaaccttaaatatcatgtcaacaatatatatattaaacagaataataatctttatgcaaatattcctgagtgtctagctttataaagcaaaacatactgagagaccacattgactataaacaaatattattcagatcaaaaatgaaagaaagacaaatattttgataggccactcagaaaaatctcaaatcctggcttcactcaatagtatacactacacaagctaatatgaatcacatttaagtacaatgaacttcattacctctgagctagcatattgtgactgcaattttttgcattcatctttgagtttttcagattctcgctcacgttccaaggtcatgttatccattagtgtttgaacttggaccagttctttctttagcacggcaacatcttctataccaggtctctgaagctgtgaaacaacacattttaattaaaaattaaagtgaaaaactaaaataatacacatttttagaatcatttcactacaaaggaatcaaaagggaaacaatcatcaatatcaatttttagacttcaaacattgaacactgatatcttctcccacaataagccacttcctcttcccatcctacctcatatttaatagtattaatactcaaggtgctgtatagtaaattcacaattatctttactactttatttgttttccttcccttcacaaactacatctattggtcataacagtgacttgaaaatgctacattccttctttttctatcctacaaaactggtaataaaaatgaaggagcaaatgaaagcatagagtttgctccaggttggatgtagttaatttatatatttattgagagctaaataaaggaaagaaagtcaaggacagatccaagattattaagtcttgggagagtattagagatgtatggttccaataacagaaatacagtaatgaggaaacatgattactttgattttatacttgttgaatttgaaattaaagctagaaattcaacacaaagtaccctaaaagcagatggatttataaaacaaacatgcaagagaagaccaggatcagagatgcagatatgaaaactactaaaatgacagatgatatttagatagaaacaacaaaaatgttaaggtagtaagttacgtatcataacattccatttttattttaaaaatcatatacagaatatatatgcaggtggtagaatatagggaattgcttatttcctgatttcactcaaattatatttttaaacattttccttcagggtatgtattttatttttaatttagaaaggtataagagtacatctcaataaataattcctaaattaccagttccgtcttcagatcttgaattacagttgcctctttgtttaattcttctgtcagacgtgtcactttttgttcagcagcttctcgaagactcctttcttcatcatactttgactttatatctaattaaagatagttatataaatattagtttaaggggaggacagttttataagtttccatatattactctgcatatctgtatatcactctaattcaaattcacattccttagataaccataaatatatacagtaaatttatacttctaattacatgaaatgaacttaaaattaactgtctacataaattccactcaacattaagttaataattagcattttaatgtacttaatcacatattttacctaaaagcacatgttaaaaacatatatatgtaatagtataaccaagtgttacatttatactacattatttacttcacttctttaaaatgttcctttttaatctttaagcatgccacagaagaaaatgtatcttctctaaatttcaagaagaatctacaaagaaacaccagtcctttgaaggcaggcagctagaggacaaacaaaataatttacatagcaactctgaaatcattaaattccattaatcaccattggaagtctatcacaaatgctttaacacactaaaatactatatttattgctagggtatataatggcaaaaaggtaatgagattgatttattggctaaaaaattctaactcaatttacctgcaatttcagtagcaagttgggctgctttctgttcaaataagtctttcatttgcttaatattaaaattttctgtttgggcttcttctaattgctgttccaaagactgtagttctacaaaaaagtgtcgcagttattcaaataccatgttaattacatatgctaaattgttattacttatatttattacagttgtaaagatgatcaacttaagtttattatccaattacaagtagtattttgacacttcaagaaattaagtatatctgcttcacttaaggtacaaatcataatttacaaacatacactacaaatgaaatgaatatttagaatcactgctaaataatctataaatattttattacaagttattttgatttcacatttcacagttattttcccatatccatcaaatgaccaaaaaggaatacaccccttatcttttttttaagagatggggtctcgctatgttacggaggctgatcttaaattcctgggttcaagccatcctcccctatcagtatcccaaagtgttgggattataggcatgagccaccaagcctggctcaaaaaggaaaacattctgctcctctgataaaattagttataaagcgggatgttggaaatggttaagatctcaaggccttttaattcattaaagtatgcagtcaactcctaatacttcatcataaagaaaataaactatcttactcttaatatagacttaaaatttcattaaacaaccatattaatgtaatattccagaagtttcttacttcaaaatataatgaactaaaaaaactaaacttttagttaactgattaaattatgaagttcacatgtaactctctacacctagaatatgaccattatcttcactgttttagagtcataaagcataaccatgaaacaaaattcatttggcaggcatcaaagaaaaagaaaggaaaacaaataagaagaaaaagaaaactgacaaaatatctgctttaagtaaagttacctgctgatgaatcagtcaccaacccatcaggtttggcctcctcaattaaaacaaaagacataaacaaatgaattaaaaggaaaagataatactgttaaaatggtcaatgttaaaaaatctctgaaagtcactttctttcaggtaagtagtaagattttggtgaaaatttaaatttggtggtttccattcttccagatctgtaagagaccagcaggcagactagcctaatgatctaacttcagtttattagttctaacatagatttttttgtatgttaatatatatgaagttattatggtcatcttaaattccatgaattcagtaataaataaatagcacaattattgtaattataaatatagattctaaaacaaatacttaagtcaactggcaacattcaatcgtattagtatgtagctttgaaataacttctaacactaacatagtttgctacatggatgctacatattttgctgtcataagaacttggagtgttatccccctccgctcaagcatgtaatacctgttagaccccatatgtgagaacttggaatgaacttctcctctcttcagtagtattacatcagaccttatcataccgcagatctgagctactgacctcaactactggacttcaaaatacatattaaccaaagagtttgaaagatactttgaaagcttaggccatggcaggctgcactttttcagctgctttctttgagactggcagctcatgctgcaatagggccatatcctattggccttagatctttgagtctcggcagccaacacctacatctcctctagcagcaggagatccccattgtctgggatctccactgttttggatgccatctctccagagagactgctcataaaaaaaggtacacctcaacccttttagactttacttttcacaaaagcctgcttccatcctgagaaagtgactagactttaataattttggaactcacccactatatggttaatatacctcatctattgatattccctgtaagatttgttcatgttatttctctcccttttaagcactgtgaaccgaagaaaatctctctttggcaataaaccatgcaattcatgaaatcatacttcaaatcatgcttcttattacaatcaaacagaacacctataatagttgaacatttgcattagttaaaacatgctatcaagctatcactactaaaacttgcattagttaaaacatcctatcacggccgggcgcggtggctcacgcctgtaatcccagcactttgggaggccgagacggacggatcacgaggtcaggagatcgagaccatcctggctaatatggtgaaaccccgtctctactaaaaatacaaaaaattagccggcctgatggcggacgtgcctgtagtcccagctactaggaaggctgaggcaggagaatgctgtgaacatgggaggcggagcttgcagtgagccgagatcgcgcgccactgcactccagcctgggtgacagagcgagactctgtctcaaaaaaaaaaaaaaaaaaaatgctatcaaactatcactactaaaaaaattggctttataagcataaatttttaattcaggacaagtcaactttaaaagaagcagaaataacagattccataaggcttaatttgtcacatgtattaggaacaaaataatatactaccttggcattatttttatattttaaagaattatacccatctgaaagagtttaataaggcatttcctagtatatctgactttttgtttctctatacattgaactaagacatactgattgctaagaaccttaagtatttaaaatatattttccccaaaaggtaaatttcctgccaaggtaacttacatcttgcactgtggaaaagttatttaagtgtattaaatgtgaaatagtcatctcaaatgcagtaaacaatttccactctgctttcagatacagaaaagaatacagcccatactcaattaattattaatggcatctatataaaacatgagtaaatgagttataagtaatttggattactaaaaactcctttaatgttaacagaatcaccaattagaaaagctgagtagtaataagactgattatcttgtcatttatttatttgtttttgtctttttcagtccaactgccaattcttggtgcaaaggctttaaaaagcaaacaagcctcactgaaagtcacaatatgccaagataacatgcaaagggattattaattactttacaaaaatattagaactattgctgaagggtaactacttttattcttacaaatgatgactatggtaaaattatttggtaaaacttcgttaatctttgattcttcctataatttcagaataaaatcaatataatttcagcataaaaatcataattaaggcatttacttagaaaatacactaaactatatagaatctaagacatcaaaaaaatcctattcaaagagaaccacttttgatactgcagtgattttcttctgtttttctctatgtattatttttatgtaaagtcatacagaatatgagtgtgtgtgcatgtatgtacaaatacacattttttagttttttaaaaacttaacattgttaatagaacaggtttcccagttttcaatcttcactaacataatacataatattactagctatttatagctagtaatatctctttccctaccaatatacactttagtcattatcaatttgtcagaaacttaaatgctttgaagactcactactgtttgaacctattttttttaaccatttaggtatattacaaaacattaggataatacagcctggtataaaaaaaaacaacatatagatacctgattcttttttttttttttttttttttgaggcagagtcttgctctgttgcccaggctggagagcagtggtgagatcacagctcaccacagccctgaaatccagaggtcaagtgaatctcccatctcagcctctcaagtagctgggaccacaggcacatggcaccacactcagctaatttttaaattttttgtagagacaggggtctccctgtgttgcccaggctggtctcgaactcctggctcaagcaactctctcgcctcagcctcccaaagtgctgggattacaggcgtgggcccatccagtaactcatttttaatggaacaccttttaaaaaattacatcttcactcctcatacatttgtttgcattcatcagaattcaacacagagaaacaaattaggaagttatttatatcaggccgccacctgcttgcaaaaaggtattaagtttagttttcaacaataaaaataaacaactaataaacatgctttaagtagttaaaagcaattacttgctgctgcagcccttgatatttttctaattccttctttaattcttccgagtaccatttttcttcctaataaaaaagatttttaattagtaaatttaaaaagaggtattatctgaaacactgaaaataaaaaggtataacaatttttattcttaccttaagtgaagcctgtaggtcttggacctcttgtctgagcagtgttacatcatctctaaataaaaatgggaggaaggaattaatagtcaatgtcctttaattaacaaactggtcttaagaaatcatggctagtaattgtatattaatattatagttttttcaattcaaaaaaaaactacggaagattttatctataatagcatatatataaatccctcagaaaaacgattttattcctaaagcttactgtttataaatggaaaaaacattttctcatggaaataatcatataactgactgttaagtgcccaagccaagaggcaaaatgtctcccattaatttactaacaataagcatcaatggcttcctattgtagttagcataaaatctaaactcattaacatggactacaaaatatacataatctagtcattgccttatcactctccccttcattcatttagctctatcaacattggcttccatctttcatactgagaaaaagccctggttcactctgcaccaccattggttacgccctgatactgcgcactgagtagaatgccgtctgcaacttgcgcatttcgcagctgccatcttgccgctgctccttctcaacgccacttccactcactgccaccaacaccaacatgaacgggagctcaacagcttccactaggtgttcattgagaagggcacattcctcttcacctcagagttggtgggggaaggcccacccagataagatctgtgaccagatcagtgaggctgtccttgatgcccaccttcaacaaaatcctgatgccaaagtagcttgtgaaactgttgctaaaactggaatgatccttcttgcacgtgaaattacatccagagctgctgttgactaacagaaaatgcttcgtgaagctattaaacacattggatatgatgattcttccaaagggtttgactacaagacttgtaatgtgctggtagccttggagcaacagtcaccagatatttctgaaggtgttcatcttgacagaaatgaagaagacattggtgttggagaccagggcttgatgtttggctacgccactgatgaaactgaggagtgtatgtaggcctttaaccattgtcttagcatacaagcttaaagccaaactggcagaactacgccataatggcactttgcctgggttatgccctgattctacaactcaagttactgtgcactatatgcaggattgaggtgctatgcttcccatcagagtccacacaattgttatatctgtttggcatgatgaagaggttcgtcttggtgagatgagggatgccctaaaggagaaagtcatcaaagccattgtgcctgcaaaataccttgatgaggatacaatctaccacctatagccaagtggcagacttgttattggtgtgcctcggggtgatgctggtttgtatgactggacagaaaaccattatggacacttacagaggttggggtgttcatggaggaggtgcctttgaggaaaggattatactaagatcaaccgttcagctgcctatgctgctcattcagtggcaaaatcccttgttaaaggaggtctgtgcagaacggttcttgttcaggtctcttattctattggagtttctcatccattatctatctctgttttccattatagtacctctcagaagagtgagagggagctactagagattataaagaagaattttgatctccaccctagggtcattgtcagggatctggatctgaagaagccaatttatcagaggactgcagcctatggccactttggtagggacagcttcccatgggaagtgcccaaaaagcttaaatattgaaagttttcatcttttttccccatacttgttggcaaaggcaacagagaagccttcaagctctgagggaaagggccttccttcctaaattttcctgtcctgtttcagcacctgatcagttgtagtcactctagtcaatgacatgaattttagcttttgtgggtaagttgggcttgctattctgtccgtaggtgttttgtttatcaataatgaatttagtgagcataggtgatccatgtaactgcctagaaacaacactgtagtaaataatcttcggtgttttgttgggcttgctattctgtccctaggtgttttgtttaccattgtaatgaatttactgagcacaggtgatccatgtaactgcctagaaacaacactgtagtaaataatgctttgaaattgaacatttgtgccctacccaacgctccaaagtcctaattgcgttgactttcccacaccagatgctgaaaatgtccacataaagtacttgtagttccgcttatagcctctgcctggcaatgccacagccctgtcagcatgaatttgtaatatcttgagctctattatgaatgtgaagccttccccttatcctccctgtaacttgatccatttctaattatgagctctttgtcagggtgtgttccctatctgatcagtcttgtatgtaacgcaagttcccagttggagctctagcctgacatcaaaaaaaggcagttaccattaaaccatctccctggtgcttacgctcttaattgccacctctttaacagcaccaaatcaaaatctctccactttcagctgtattttggaggacatacacgcaaggttttaatttagtaaaccaatcctatgcatggtttcagcactagccacacctcaccaactcctagctctagaaaaaaaggcacctggcatctttgtgatgccatacagggaagtcacaggccagtacctgagggtctgaaggttgcacactttagtaccagataacgtttttttttctttataagaaagcctgagtactccacactgcacaataatgcctcccagggttttagttttgttttattttcaaaaccagatccaatgagctttctcaacagctggtgtagctacagagaagtcagcttccttcagaaagcagtgtttttggcggggaggaggaaatcccttcatacttgaacattttctaattgcttatttattgtattctggggtatggccttaagtacagtgaagctatcacctcaaatggcagctttaaaaaaattttttttctctcaataccatgattaccatgattcctttaacatgtttccagcattcctaggtaggccaaggtgtcctacagaaaaaccttgggtttgacctacagggggtttggctggtgttaacagaagggagggcagagctggtgtggctggccatggagaaagctgacttagctggtgtgatacagagaagccagcttgtttacatgcttattccatgactgcttgccctaagcagaaagtgcctttcaggatctatttttggaggttcattatatatgtctggttctcaattccaacagtttaatgaagatctaaataacatgctaggttctaccttaaaaaaaaaaaagaagacaaagaagaagaggaggaggaggaagaggaagaagaaaaagaggagcagcagcagctctgtaaataggggggaaatacacacaacacacacaaaacactgcttatttctgttcctttgggtatgacatgctctttcctgtctcagaagcttctcacattctgttcccctcacctaagggtcaaactgacaaagaatggtgaactgaccattctaagcccttctgcaggagagagatttcatgagaaaacatcattataaagaattattattctggccgggcacggtggctcacacctgtaatcccagcactttggaaggccgaggcgggcagatcacctgaggtcaggagttcgagaccagcctgaccaacatggagaaaccccatctctactaaaaatacaaaattagccgggcgtggtggcgcatgcctgtattcccagctactcaggaggctgaagcaggagaatcgcttggacccaggaggtatcggttgcggtgagccgagattgtgccattgcactccagcctgggcaacaagtacaaaactcagtctcaaaaaaaaattattattctggatgtcaggaacatatcttcccctgctggattcaaattcatcctacagatatactcaaacaagtacaaatggtatctccaaaggaactttgtgatgtcataagtatgcaaaacatgagaaataacctgaatagtcatcaaccaaagaatgagaaaattccatgctatcattaaaaagataagatagctctatctaccttgatatgaaagaatccataagatacagagagaaacaaaagatacagaacaacgtagaattgctatcttttatataattacatatatttatatatttatttatatgtacatagatataagcatatgaatatataagcatagaatatctctggaagaatacgtaagaaattgatgaaaaaaagaggctagggaaaaaggggtggcaagcgctcaattttcaccataaacttttttgaaccatctgaattttgtactatgtacatctacatatgtacatttaaagatctagcctaaaaaagctcactaatgcatcaagcttcaaatatttgattgatgttgatgaaattcgcatataagctgatgaacagaaggctttaaagcaaaaaggtttcatgacccacctgagtcatgtggacttttgatctaaaagacatagcctgctcatagtcacatgtcatccacagtgttatagtggagtagaatgtaattgtcagaaactgaggtgtaggaaaatgggaagaagagatacaatacaataaaaacggaaacgcatgcagtaacttccgtaagcaatgagaagcctgcaaaaattactacttagagcaatgccaatcaaatttgcattttaagaatattattctggccaggcgcagtgactcaggcctgcaatcctaacactttggcaggttgaggtgggagaattccttgaggacttcttgaggttcttgaacaacatagtgagacactgtcccaaaaagaaaaaaaaagtaaaaattagccaggcatgttggtccatgcctgtagtcccagttacttgggaggctgaggcacgaggattacttgagaccaggagttggaggctacagtaagctatgactataccagcctggaaaacagagcaagatcctatctctaaaaaaaaaagaaaaaagaatattattctggcagcaatatggagaattggaggagtacaagactaaagatagagagccaactataaatatgaaaaaacatttctgagtgagatttaaggcctaaaataaactataacagtaaaaatgtaaaagaatatatgctgttaaggaaacagaattaactaaactttatgataaatcagatgcgggtaggaggagcagatgtgtaaaaatgatcacacctactttcctggctttactaactgggtggacagataatgacaccattctccagaagaagtaatagtagacaagcagtaggtttagaagaaaacagaaaaaactctgttttcaaaatgtcaatgatgaggtgcctccagaacatctgagggaagatacctaataggcaagttgggagataattctaggttggagatatggtttaggaggaagttatggatgtagatattaccctaggtagatcatacagagaaagagcagcatacaaaacagatcaagaaaaaattatcacaatggtatgtcatctcagaagagtagaaggaaggagaactggcacagccaaattttgcagtggttgttgcagatactctacagagatgactacaatcaagttcttcctttcctatactaatccactaaaagacaaagtttatcttcaggcctcatgaatctgacttggcactatgactactttatccaatagaatggcagaagtgatgctctgacacttttgaatcaagcctaaagaagattggcagcttctgcttctttcctcttggaacatactaccttagaacgaactaccagcttttgaggaagtccaagcagccacataaagaggcccacatgaaagagaattgaagcctttggcataaagccccagatgagctcccagctggcatccaacacagacttccagccatgaatgtgaggccattttgaaccttctggtcttcctacaaccccagtctccctcacttaaagcaaaagaatcatgcagtcaattcaaagaatcatgagaattcataaactgttatagttttaaaccactatgttctttgggtagattgtcagacagtaatagataatcaaaacagaggtcaagcaaaataagaactgaaaataatccaggttactgttggtcttcagagccatagccagagaatggtagggcagaagtcaggcttcaattaactaaaacactaaatgaaaagttaagaagaacaagggtagaccgtggatgcttttatgttaaaagttcatatactggacacagtctaattcatagttgaaacacaactctattaaattgatattaaatataagaacatttataatataatttaactacatgtttttaatgtatttcctaacaaatgacaaaagaatagtagccaaaattattaattcacacataaaaatacccgagagcattagcagtcatattaaaaaggaagatccattcttcccaaaagcactggttttcccacatattttaatacagtaaaatggccatgttttatagatctacattatctatcaaccacaaagtttatatggttatcatattttcctttatgtagtattctttgtgttacagcagattaatcaaccagtaagtttttttttaggaaagcataaaaatacttttttacaagtacaatgaagtgaaacttttatgccctcagtggggataaaagacaagagttctctccaatagcagaagaaatgcaaagttataccattgaatgctattctaagtagttatattttagtttacttttacttcttaaaatggccaagaaaaattaccaggaaacacaatgtgtacgtatgcttattgctatactggtgattataaatggaaatttttaaattttaaattaaaaattaaattttaattgttggctaaatttattattttaacaacttactataaagtcatctaagcaaatcgtatcatcttatattacacacaatatgctaaatataatttaatcttcttttgctaactcacaatcttcattaaaaacataacctatgtaccgtattgtacttgctggcatagatagttactggtcaaggattgaatagtttttaacaatagtggaggaaggatatgctaaatgatgacagatttaaattaaataatacaaaaaggttactattttcataagctaattaatcatgattaaacgacgataccacatgcatattccataacattatacttcaaaattatcataccgtaccgcttcaaagcaagattagactctcctccatgacctgagtcattaccagcatcatgaacagcttcataatgtttgaaaagttcatcagcagatccaagagatttcatacactggggacatatgaaaccctatagaaaggggcagaaaaaagtttcaaaatagtatttaatattgtgaaataacaatttgcatattattaaatatcaccaaatgtctgaatcataccaatggtgccattaggtaaattttatcttatggtattaatcccaaattctagtatcatgcaaagatacttcattgtctattctagttgaagtttacaaaatacaaagaaagcccttgcaaccatcttttatttttaggtcagataaattaatagctggagtacccaagtctaatctgaaaagttagttctaatatagattagttgagaagatttgccatcatatccttcctttctctagctatcctcattagtaaaataatatctgttccaatctacttcataggaatgctatgaaaaaaaaaaaaagaagatgaaccactgagggggaaaaaaagtaattcataatcaccacagagtttggatatctacaatgataacaagttttctagtcagtaaatgtccttgctaacctacagctaacacagtaaaggcctaaaattaatgtgtagccccataaaatataaaaaacaaacataactacataactaatctcaaaattattatatggttaaaactaccaactagagtactatgttaaagatgctgataaagatccatgttttacaaattttaggttgcaattcattaatgaattatgaaatcaacttactgggttgcaacttttatttttttattttattttattttattttattttattttattttattttattttgagaatgagtctcgctccgtcacccaggctgaagtgcaatggtgcaatcttggctcactgcaaacctccacctcctgggttcaagcgattttccctgcctcagcctcccgaggagctgggattacaggcacccgccaccacgcccagctaatatttgtgtgtttttagtagagatggggtttcgccatgttggcccggtggtctcgaactcctgacctcaggtgatccacccgcctcggcctcccaaagcattgggattacaggcatgagccaccatgcccagccgggtgtggtggcacacacgtgtagtcccagctactcaggaggctgaagtaggagaattgcttgaacctgggaggtggaggttgcagtgagccaagatcatgtcactgtactccagcctgggtgacagagcaagactccttctcaaaaaaaaaaaaaaaaaaaaaaaagaatatttgtagtcattcattaaatcaaagatttttttaaaatagtaattagcaaaatcatgataaagttattacacatacaattctgctaattaaaggtagcaagaaataaacttgttttgcttccatcaagtacaccacaattctaaaattcccctctattagagatacaaaaataaaatggaatgtgtgtggcagtggtgcttcggcactgtaagcaacaagtaaatatattataactttgaaggttctatggaaagtaagttttattagaatgtacagcttttacatataagaatggtcatcctctcttgattctataaaaaaaaaaaaatacaattccctttaaagatcactgttccccagggctctctcattgacctcctcctcttctgactcagcattctcccaggtatataacaatgcaatggttttagctatcactgacatgctgatgactcccaaatccatctatctagccaataactcactccagaattcttctggatctttaacaacatatatctctacctgcatcccacaggcatctcaaatacaacaaatgcaagactcattttccaaacctccttttctcatcaacgcccacctttcacctaaactagaaacctaaaaatttggctaaactactcactactctccctctcactcatttctaataaaacattaagcataaacatttctcctttccatcttctcatctccatcctcattgcagctgctcgtgttcggatactcagtatctcttgtccacactctgcaataacattagaaacagtgctcctatatccagtcttccctcttcctaattaatcttccacagagctgccagaggaatctttctaaaacagattcttcaatatccttcagcaaactttatcatcaatatggcatacaaggttctgcataaccattcccctaacaacctatgcagtctgatctccagacactccctcaccatacttcaacaatactaaaatacctgcgtttccctgagcacgccatcatacttcaaatttctgtgcctttgcgtatactgctttttccctccaggagcaccctcattagcttgtcaagttcctatactcactgtaatacacagcatattggatttttttcatccatatttccataatggccacaggtggtactttaaacatactatatttttctatattgtatatttattcactgaaatatgaatgaacatggcagtgcaaaaattggccaaaaaaaagaagatctttaatagcttacagattataaaatcttctaagggagaaaatgagctaagcaataagtactctgagcacgtaaaaactaaaaataaataaataaaaaaactgctccttgaatgctgatgccaaaaaatgtacatcctcatttattatttgtgcacattatgtggcagaatcaaggctcactgtttattggggatactgatatgtagacaaatattaccatacaatgctatataatacaattatatataaagaattacaggaacacaggagaagtatccaactccacctgtggcagcagttaatactttacaaaaatacatatacacatacatattatatatgtgtctcatctccatcctcattgcagctgcatagtgtatgtgtgtgtgagagagagagagagacacagtcactggaattcagtacgaaagaataaataggagtttacctggcagagagaaaagcattctaagcaaatggaggagcataaacaaaggtgcaggaaacactatgaatagtcatgttacatttaggaaacagaaggcttctaggtgtgttctgatcacagagccagaatgaagggcaggggcacaacaggtgataaatgcaataatctcctatgaaactcctgaaatgagcaaacggtagtattgaggatgtgcctctggacatcagaatacagtaatgccattaggctccagagatatggtactcaacattgtcttctgaatgaatgaatgctcccagtcaggatgttagtctagctgctgttattctccttttcttcaaaaccatctgttggcattcttagatctcctacccactgttgtacaacactagtagatatgcctttagtgcaacagtacatgtacccatataatgtttagcctgtcatttctcttttgtgtctcaacttctgctaataactagaaagcaaatgaaaaagtgttcctcggagaagctacatccctattacacgatttaatcttcacaactgtggctttttgactattggctccactttcaggtttgggctccagatacctaagtgtgccagaaagctaatgatcacactgaggtatgccataccttcttacaacttccaaaaattaccagattaataccctgaaataaatgattcattcctaatgagaaatttcagaaatcagtaacatacatttcattatagaaatattccacataagtgaattttccatgtgattaagatttccttgtttaaataaaacttaaatttggggacatttctaataaaaataaatctttctaaaatacatataattccgcaccttctcaaatagatgatattaaacctttgtctaatacctccaagacataaatatttatcactgaaaagatgtcttctaccctattaattctggcaagcctctttaattcttatatccacattttatagtttgcctgctctgtatttcaacagtcattactaaaaattcttagcatactagctctgggaatgctaacttgcaataaatgggatgggtagattaaaaaaaaaagtttattaaaacccatcattcatttaaaataaaagtataatgagtttagaatgagtgcctcagggatgtcccatgaacagatcgcatgacctttagttcatggactttgaaaaccaatttgatataagagactcctctatttttttctaaatgatgtccaaggggatcgaggttgctagatagataaattccagagaaaggctgttagctaacaataacacactaaaactagccagctacatttatttcccttagtcatttcaaatttgtcaccaacttccaaaaaacacaatttacttaagatttaaaacaatatattcaatacttccagagtttggttatctgtaatcctttctcatatccactgcaactaagaacttaccttaactggaacttaaggtactcctgttgtaccaagtatccttttagttaaaagaaaaagccctggccgggcgcagttgttcacgcccataatcccagcactttgggaggccaaggcaggccgatgacttgaggccaggagttctagactaccctagccaacatggtgaaaccccatctctacttaaaaaaaaaaaaaaatacaaaaaattagctgggcatgctgatgcacccttgtagtcccagctactcgggaggctgaggcagaactgtttgaacctgggaggtggaggttgcagtgagccaaaattgcaccactgcactccagcctgggtgacacagtgagattctgcctcaaaaaaaaaaaaaaaaaaaaaaaaaaaaaaaaaaaaggaaagcccttattttaagtgcagagtaggtgagattattacttttgattttggctagtccatcaagaagaaaagttgacccacaaggtccagaaggataacatgtgataaaatgctaaccagattttcaagaatcttttatgcctccagctttgcttgcactgcttcagccagtttaactggtatcatcctacatgcacccattttctccaccacagttaaaatctctggtttaactgtcctcctataaagtttttcctgagttcctcttatgctgaattagccactgcactttttgcaaataatacctatcatagaaacctcctggggtagagattgtaccttattcacctattatctccctcacctgccaaaatatctgccacataaaaggtactccattaatgtgtcaaataactaaatgttgttaagaatcctttcttatatacataattacctcatagaaaaaagtaatttttggtctttctggtgcaaaaggttgcattattttataagatttataaaatattttttaaaagctatgtttcctttgtttttggaataccatagtgattttcaaagaaaacacattatcaggatcatctgagaaattcttttcagcctgaaaatgggcagcgcttcccctaacttgctcccctcctcagcctttgttacgtgcagcctcagatactgggaaatactgagaaatattttcggactgatccactgttacttatgagagtatgtcattctgtcaccttcctcaagtctaggggtgttaaaacaaaaattgagacagtctgagattcaagttctaacgctgtatattttcctgaatagggacaataactgtttatatgcaaagtctttttccttttttttttttggcggtggtggggcagggacgggacagagtctcactctgttgcccaggctggagtgcacaggcatgatctcggctcactacaacccctgcctcccatgttcaagcgattcttgtgcctcagccttccctgtagctagaattacaggcacatgccaccacacccagctagtttttgtatttttagtagagacagggtttcaccatgttggccaggctggtctcaaactcctgacctcagtggtcaggctggtctcaaactcctgacctcaagtgatctgcccacctcagcctcccaaagtgctaggattacaggcgtgagccacagtgcccagcctcaaagtcctttttctaagtaagagcaaagtattttatactaaagcattttaatacatccattaatgaaacattaacaaaataataaaaatataacttaccaatgttggaataatattcacttaatattttgatttcatggcaaaattgatacaaaatattaacttaaatttctgtatttatttacaaattcacaaaaagacagctgcaaacaggaagagaaaccacgcagacttcccaagagcctcttttccttattgaaacttcctttaagcatgcataattaaagcaatccatattcccttgtagcataaaaagttaagcaacaccgaggcaaggaaaaaccagctattttgagcaacccaaaaccaagctgctaaaacaaaatatacaggacccacagtaacactggagtcattaagaagttcctgtcctcttgtttcattttcatcgtgcactttctggtaatgctccaataaatcaatagcagttatacatcttttcatacataaggggcagatgaaaccctgtgaaataacaacttttagaaaaatatacagaaaaatatttttataaaacaagacaatgcaaatagaaataacaagaaaataactagtgtatctcttctggtatacgtaaggaaaattttcaagtggtaactgtacaaaaggtgaaaatctatccaaagtaggacttctaaaattagttcccatccttatgctataaatttgcattggttcaattccttttcattatggtatccagttgcttcagttagaatattattttgtttatgacacttttaaaaaattctttctgcttatgatactttgtccttacctatgtaagacctattatcggcaagttagcttttattttatttatttatttatgagacagtttcactctgttgcccaagctgtagtgcaatggtgccatctcagctcactgccatctccgcctccggggttcaaggggttcttgtgcctcagcctcccgagtagctgggactacaggcgcgtaccaccaggcccagctaatttttttttttttttttttgagacggagtctcactctgtcgcccaggctggagtgcagtggcacgatcttggctcactgcaacctcctcctcccaggttcaagcaattctcctgcctcggcctcctgagtagctgagactacaggcatgtgccaccacacctggccaatttttgtatttttagtagaaatggggtttcaccatgttggccaggctggtctccaactcctaacctgagaagatctgtctgcctcggcctcccaaggtactgggattacaggcgtgggccaccacgcccagccgagatcaagaaattactggcaagtataacaaatacttttatgtcatataatgtgttcaacaaagaagttctctttgaaagtaatttaatgaaagtaatttttagtctttactatattccactaggttgagatcccattcttccccacacccataattcccagcagatgattcttccttgtaattttctgagccaaataaaaccatcttcaaacagtattttaaattacatatacctaacaatatctatattttaaaatatgggctgttatactgatgtatgtatggcttgaggttttgtcaaataagaataataggatgaggggctgggcatggtggctcatgcctgcatccccagcactttgggaggccaaggcaggcagatcacttgaggtcaggagttcgagaccagtctggccaacatggtgaaaccccatctctcctaaaaatacaaaaattagccaggcatggtggtgtgcacctgtaatcccagctactagggaggctcaggccagagaatggcttgaacccgggaggggggaggttgcagtgagccaagatcacaccactgcactccagcctgggtgacagagtcagactctgtctcaaacaaaaaaaagaataataggatgagagactagaattgaaagcatcagggagaaagtaaataaaatgaagacagcaataagcatgaaatgttataacatcatgagtgtcagtgtcaaaaatagatgtggacttgggtcttgggtctcaaccaatgcctgattatatgaccttaaggaaatcactttgctttgcttaaatgtccttatctataaaatggggctaatactagcacctattcttctagagtttttgtgtatataaaatactaaatacagtgcttgagatattgtaagtgctcaacgaatatgaattgtcattagatgtacgcttaaagatgaaagggaaagactgagagactagatgaaaagatagcaattaaaaacctagattactcagcaaggccaaggaaatgaagtaatgagaatatgaagaagaaagtttgtgaaaggatagacaattatagtaaagaatggggagatatgactttaatatttcaggtgaaactattgtgcctgatgatacagtagaaggtactgccatggaattaagtagcaagaaaagagatacgaaagatcattgacattgacaacattaaggaactgggaggttaaaatgttccttgagttatcaaagtcacttagaatagcaaggagagagaggaagactgaaaacagatgccagatgggaagcaagacagggtagcaattaagagctaggcttgggcttgaatcctggattcatatcactcttagtagctatgagaccttcaattgcctcatctgttaagtggaataacaataacacctacttcatatgaatctcatgacaattaaataagataatacatgcaatgcatttatcattgtacctggtacaaagaaaacattcagtaaatgttagctatcattactttaattattccttttgttaataacctttaaaggagattatccaggggatgaaaatgaggaatatgagttcatctttttttttaactgatgaaagagttgtcttccagatgaccacagtctcaagtgctagaactacagaacaattcttctttaaaagatgcttcagcccagcacagtggctcacacctgtaatgccagcactttgggaggctaaagcaggcagatcgcttgagcctaggaatttgagacctgccttggcaacatggcaaattcccatctctacaaaaaatacaaaaaaaaaaaatttagccaggcatggtggcatgcacctatagtcccaggtacttaggaggttgaggcgggaggatcacttgagcccaggaggtccgggctgcggtagccatgttcacaccactgcactccagcccaggcaatagagtgagaccctgtctcaaaaaagaaagagaaaaaagaaaaaaagaaaaagaaaatatgcttcatttgttttgtattgtttgagacagagtctcgctctgtcacccaggctggagtgcagtggcacaatctcggctcactgcaacctctgcctcccaggttcaagcgattctcctgcctcagcctcccgagtagctgggattacaggcgcttgccgccaggcctggctaatttttgtatttttagtagagacggggtttcaccatgttggccaagctggtctcgaactcctgacctcaggtgatccgcctgcctcagcctcccaaagtgctgggattacaggcgtgagccacagtgcccagctgttttgttattgccaccatagctttaggctgcctttcactttactcttgtttttcactgttaagtttccatatacagtcattcattcaaaaagtatttacttgctggtattctaccatgcagtagggtaactgtggttaacagtgaaatattgtatatcacaaaatagctaaaagacagccttttgaatgctctcaccacaaagaaatgatacatgaataaggtgatggatacactacactgatcggattattatacaacatacatatgtattgaacatcaaaatgtaacccacaaataggtgtaattaaaatgtgtcaatttaaaaagtaaataaatttttttaagtaatatacgattttttaaaaatcacatgggcatgtgattactatgttctagctgttgtggtatggtgctaagaatacaatgataaataagacaaggtcttcaccctcaagaagcttacagcctctctgaaaaagttacccaaaaaaatgacattttaggccagacacagtggctcatgcctataatcctagcactttgagaggctgaggcaggcggatcacaaggtcaagagatcaagactatcctggccaatggtctattaaaaatacaaaaattagctgggcatggtggcacgcgcctgtggtctcagctactcgggaggctaaggcaggagaatctcttgaacccaggaggcagagattgcagtgagctgagattgcaccactgcactccagactgggcgacagagtgatactctgtctcaaaaaagaaaaacttacattttatgccccactaatcagaaaatcctattaaatccacattgaaaatgcatccagaatctcagcacctctactgttaccactctgctccaagtcaccatcacattgtacacagatcattacaacagcctcctaacactctttgctcctaccctcaccccactaacacacagcagctagagtgtatcccataaaaatgcaaatcaaatcttgtcgtttccttgcttaaaattatccgatagctttctacgacagtaacagttaaaaactaaagtctgtataatagtctataaggccctacaagaggcagacccgatcgctgacccaatctcccccttgctcactatgctacagctacaatagcctcctggttgctttttcaacatgacaggcatattcccaccttagagacctgctgttccacagacctggaaaaatacttgccccagaaatccacgtgactcatttcctcacctccttcagttctttttgtgttatcccctcctcagagaagtcttccctgataactatttaaaattgcagccaccaagaacactttatatgcctcctttcctgctttatttttttcaataacaccaactgtctaacttgatacattttttatttatttatttttgagacagggtctcactctatcatcccagctggaatgcagtggcagaatcatgattaacttgcggcctcgaactgctgggctcaagcgatcctcccaccttagcctcccgagtagctgagaatacaggtgcatgccaccactcctggctaattttcttttttattttttgtagagatggcatctccctatgttgtccaggctggtcttaggcgatcctcccaccacagcctcccaaagtgctgagattacaggcgtgagccaccatgcctggccaatacatgtttagtatgtttttatttttgcctatttccacccacttgaatgtaagctccaccaggataaatactttttagtttatcctaacaaatgggtaaaagggagctctttaacccatcccaccacgtgaggacacagggataagaccctatctatgaaccgggaaatgggccctcatcagacatcaaatctgccagcaccttgatcttggacttctcatactctagaactatgagaaataaatttctgcagtttataagctaccaagtctgtggtattttataatagcagtctgaacttactaagataagcaggtgaggtacagagattagcttatggaaaagcccaagaaaagaaaaaacttggcacactataaaaacagagaattcgatatgcccggatcagagtatcaagaagactatgagaagaaatgaagctatagaggtaaaaagaaagctgatcaccaaaaaaaaaaaaaaaagataaataaacaacaacaaaaaaacttctagaacaagctaaagaatttagactttattctaaggacaattaattgaaagccattaacctgggtgttgttttttttttttgtttttgagacagagtcttgctttatcacctagactggtgtgcagtggcacgaactcagctcactgcaacctctgcctcccaggcacaagaaattctcgtgcctcagcctcccgagtagctgggattacaggcatgtgctgtcatgtccagctaaattttttttcttttttcttttttcttttttttttttttttgtatttttagtagagacagggtttctccatgttggccaggctggtctcaaactcctggcctcaactgatccgccagcctgggcatccaagtgctgagatttcaggcatgagccaccattcctggcctaacctgggttttaaccaggaaaatggcatcataaaatcctagcgatattttaaaagaatagattcaattggaagagagaggagataggaggtgggtaacatcagataaaaggaggacagttacaataatatgtgagggttaatgattgatggtagtctgtgttaaggcagtaacagaatggattaaaattattgcttaagcaatttcaatagaaaaggttttctgagaaggtgataattgaactaaaattaaaataattttttttttttgagacaaagtcttgctctgtcacccaggcgggagtgcagtggtgcgatcttggctcactgcaacctccaccttctgggttcaagtgattctcctgcttcagcctcctgagtagctgggactacaggtgcgtgccaccacaccctttagtagagatggggtttcaccatgttggtcaggctggtctcgaactcctgatctcgtgatcttggcctcccaaagtgtttggattatagccatgagccaccacgcctggcctaagaaatgagatttgataggtaggtggaggccacaaatgcagggccttatagaccatgataagatataatggaatttattttgcataataggaagccaatgaattttcttttttcttttcttgctgggaagcatagcctccagcagaagctggaagcaggcatttcctaaagccaatgaagattttaattcagggaatggcctgatctgattccagtccttgtggttgctctttggagaagtgacctaaaatgataaggataatacacccttatgatcatctaggtgaccagcagaaacagaaagaagaagataagaccaggcacagtggctcacacttgtaatcctaacacttcaggaggccaaggtgggaggattgcttgaagccaggagcttgagaccagctggggcaacatagcaagacccctcgctacaagaaaattaaaaattaaatttccatacagctacctttggaaaaaacaaaaacaaaaaacaaaaaaggtgggggaacggactgaagatatatctgggggctaaaatgaataggacttatcatgtactgaatatggtggatgaggaaaaggaagaatcaagtttactctgaaatcctgagcttcaatatctgagattttctacaattttcagctttctgagacagctaaaagaatagcaagttgaatgttggggtaggaaagactggagggcaagaatttagcttaaacaataaatttaggacaaatattaaatttaaaatgcatattaaagtcctaagcttccaccttaagaatctagaaaaaagatgagcaaactaaatccaaagtaagtagatggaggaaattaaatataaaagcagaaaccaataaaagaggaaagcaaaacacagagaaaattaacaaagtcaaaagttggctaccttaaaaattaataaatggataaactaataggaataattaggaaagaaagaaaaggataaaatattttatctcttaccaaaatcatgggatatcactacagatgctatagacatttatgccaataaattcaacacattagatgaaacaacagattccttaaaaacacaattcaccaaaactgactcaaaaagaaacagagaatctgagtaataatcaatacacttcccaaaaagaaagctccaagcccagatggttttactagtgaattctagcaaacattcaaggtatacctccctaatttatgaggccaggaaaacccagataccaaaacctgatacaaacatttcaaaaaagaaaattacagactgatatccctcatgaccaaatgaaaaggtcccccaaaaatacataaacaaatgaaatctagcagtatacaggctgagcacccattatctgaaatgcttgagacacttttggattctggattttttttttttttttgtattttggaatatttacatgatacttaccagttggacatcctaatccaaaaaaatccaaaatctgaaatgaacatcatttcggcactcaagtttggaattttgcagcatttcggattttgaattttcagattagggatgctccacctgtattaaaatagtaacaacacagcaagaccaagtggagcttatcctagaaacaagagtagatcaacattcaaaaatcaatgtaaatcttcacagtaacggaaagagaaaatcatattatcatctcaatagatgtgggaaaagcatttggcaatattcaaaattcattcaaagggaagggggaggggaaaagaagggagagagggagggagggaaggggaaaagctctcagaaaactagaaagcatccttaagctgatcagaaaaaaacccatggctaccatcattctcagtggtaaaaaccttaaatgctattccctaagttcacaaagtaaaatacttactctccccaattctatttaatatttgacccaaattaaggcccaatattgtgtgctgccttgacatctggtgaaagtgggagggcctcaaatggcctaaccagaagtttgcctccccattctcctcccacagataaggctgcctactcaaacagcccttctgatcacagggaccaggcacagtccctgcttatccctacgtagtgggtttcccatgtcctggtcccctgccagcccacagacttatccaaacaatccaatcatatccttctttaggaaccagaaggcaccccagactcttgatactaccaagcctgcctcctacagcccctggttgttcattttgttcccaaatgtaatctacatgtagccatgcatggcatgtagtgtcctactcccctaggctgtaaacataaaacaaactgctgttgatctcaactgtccagtgtcacgtgttacatgttcagccattcccataacctggggcaaaatccctccttcactacacagtaaataggaggcaatgaaaacactggcaaatgcaaatgacttgcacccagtataaaggagtctcacaattcaataataaaaagacaatccaatgtttttgtttttttttgagttgtggtctcactctgtcactctaactggagtgcagtagtgcaatctcggctcaccgcagcctccacctcacaggagcaagcgattctcctgcctcaacctttcaagtagctgggattacacgcacacgccacagtgcctggctaattttttttgttgttgttggagggggcggagtctcactctgtcgcccaagctggagtatagtcatgcaatctcggctcactgtaagctccacctcccaagttctcaccactctcctgcctcagcctcgcgagtagctgggactacaggcacccaccaccatgctcggctaatttttttgtatttttagtagagacggggtttcacagtgttagccaggatggtctcgatctcctgacctcgtgatcagcccgcctcggcctcccaaagtgctgggattacaagcgtgagctaccacacctggcttaatttttaaaataggcatttccaattccagaaaaaatggcatagatgcacttttccttattccttctgccaagtacagctaaaattcatggacattacatataaaacaaatgtaagaagactctgaaagatacagaggggaaggcagaccagttagtgatctcaggagacaaggaatgacagactgatgagttctttgcctcatatattctgaaatgaatactagagaagccagcaatctggaaacaccagactatgctaacaagaaaagcctgctctctctaggcacatgatcagggatgaggtagtcctcccactgctaaatctgactggctttttagaaaacgggctcagtgtagtagatcatgcctgtaatcccagcactttgggaagccgaggcgggtggactgtttgagcccaggaattcaagactggcctgggcaacatggcaagaccccatctctatgaaaaaaaaagaacaaaaattatcagggccatggtgatgtgtgcctatggtccccagctacctactctactcgggaggcagtggtaggaagatcacttgagcccgggagatcgagcagtgatcacaccaccacaatcagcctgggcaacagagtgagatggagaggaggaggggagggaaagaaggaacggagggaaggaaaggaaaaggaagaaagggaaagaaaggcgatgcagtactgagatactacaacatctggaggtcagttgaagaggtaggaaaaacaccagaagagaggtatcagagaagcacaagaaagactgcgttattagacagcaagagtcgactggactaaatgcgtctaagaagtaaagtaagatgaggacaaagaagtacagatgagaattagtaaaagacaggccattagtgagtagtttcagtggaaaaactgaggatggaagccagcttggaataggataaacaataaacaaagacatttacttctagcaatatggtgtactaaacagtctgaactgtcctgatgaaaacaatgaaatgatataaaatatcacttattacattatgtattacatatattatatatgttattacagctgaccctcgaacaccgcaagtttgaacagtgtgggtccacttacacgtggattttcttccacctctgcctcctctgagacagcaagaccaactccatttcttcctcctcctcctcctcatcctactcaacataaagacaaaaatgaagacctttatgaccttccacttaaagaatagtaaatatattttctctttgttatgacgattttccttttcttttttggctctatggaatctttctagtcatatgatttttcttttttttttgttgagacaaagtctcactctgttgcccaggctggagtgcagtggagtgatctcagctcactgcaacctctgcctcctgagttcaagtgattctcctgcctcagcctcctgagtagctgggattacagtcacgtgccaccatgactggctaatttttgtatttttagtagaaacatggtttcatcacgttggccaggctggtctcaaactcctgacctcaggtgatctgcccgcctcggcctcccaaagtgcaggattacaggcatgagtcaccgtacctggcatctttttttttttttccacttttattttagattcagagggtgtatgtgcaggtttgttacctgggtatattgcatgatgctgagctttggggtacaaatgatcttgtcacccaggtactaagtatagtacccaacagtcggattttcaaccactgcccacccccttcccttctcattctagtagtctccagtttctgttgttgccatctttatgtccatgagtacccaatgtttagctcccatttataagtgagaacaagcagtatctggttttctgttcctgtgttaatttgcttgggataatagcctctagctgcatcagtattcctacaaagaatatgattttgttatttttatgcctgtgtggtattctgtggtatatatgtaccatttcttttttttatccaatccaccattgatgggcacatagtccgattccatttatttgctattgtgaatagtgctgtaatgaacatacaaatgcgcatgtctttttggtagaacagtttgttttgttcagatatatactcagtaatggattactgggttgaatggtagtcctgttttaagttctttaaatctcgaaactgctttccacagtggctgaactaatttacattcccaccagcaatgtataagcattctcttttctctgcagcctcaccaacatttgttttttaatattttaataacagccattctaactggtgtgagatggtatctcattgcggttttgatttgcatttctctgatgattagagatatggaccattttgtcacgtttcttggccatttgtatgtcttctgagaagtgtctgttcgtgtcttttgaccattttttaatggggctttttgcttgttcaattgtttaagtttcttacagattctggatattagacctttgatatctgcaaacttggctgcacagtttgcaaatattttctcccattctgcaggctatctcttaactctgtcgatagtttctttcactgtgcagaggctctttaattagtccggcttgtcaatttttgattttgttgcaattgcttttgaggacttagttataaattctctcccgacactaatgtccagaatgatgtttcctaggttttcttctaaaattcttatagtttaaggtcttacatttaaatctttaatctattttgagctaaattttttatatggtgaaaggtagggaatccagtttcatttttctgcataagccacatgattttcttaataatattttcttttctctatcttactttatcgtaagaatacagtgagacacgttcatcagcttgttcttttctgcccgcggacgccactgaagaagcatcgttaaagtctctcttctcccttccgtcatgtctaagtcagagtctcctaaagagcccgaacagctgaggaagctcttcattggagggttgagctttaaaacaaccgatgagagcctgaggagccattttgagcaatggggaacgctcacggactgtgtggtaatgagagatccaaacacagagcactccaggggctttgggttcatcacacatgccactgtggaggaggtggatgcagccatgaatgcaaggccacataaggtggatggaagagttgtggaaccaaagagagctgtctcaagagaagattctcaaagaccaggtgcccacttaactatgaaaaagatatttgttggtggcattaaacaatgaagaacaacacctaagagattattttgaacagtatggaaaaattgaagtgactcaaatcatgactcactgaggcagtgccaagaaaaggggctttgcctttgtaacctttgacgaccatgactccgtggataagactgtcattcagaaataccatactgtgaatggccacaactgtgaagttaggaaagccctgtcaaagcaagagatggctagggctttatccagccaaagaggctgaagtggttctagaaactttggcggtggtcgtggaggtggttttggcaggaatgacaacactggtagtggaggaaacttcagtggtggtggtggatatggtggcagtggggatggctataatggatttggtaatgatggaagcaattttggaggtggtggaagctacaatgattttggcaattacaacaatcagtcttcaaattttggacccatgaagggaggaaactttggaggcagaagccctggcccctatggtggtggaggccaatactttgccaaaccatgaaaccaaggtggctatggtggttccagtagcagcagtagctatggcaatggcagaagattttaattaggaaacaaagcttagcaggagaggagagccagagaagtgacagggaagctacaggttacaacagattgtgaactcagccaagcacagtggtggcagggcctagctgctacaaagaagacctgttttagacaaatactcatgggtatgggcaaaaaactcgaggactgtatttgtgactaattgtataacaagtcattttagtttctgttctgtggaaagtgtaaagcattccaacaaagggtttcaatgtagatttttttttttttttgcaaacatgctgttgattgctaaatgtaagtctgatcatgatgcagaataaatgtctttttttaatgtgcaaagaaaaaagaatactgtatataatatatatataacatgcaaaatatgtgtgaatcaactgtttatattataggtaaggcttctggtcaacaataggctattagtagttaaatttttggggagtcaaaagttatacatgaatttcagctgcacaggaggttggcactcaaattgttcaagggtcaactacacgctataaaatataaaatattatataaatagaaccaaagttagctttcaccctgaatatttctttaatgtcctggagaccatgatatttccaatttaacttagaagctgttaaaggcacaatgttaaaacctacagcttgtccaaagtaggaagccaaagtcaatgtaaaggtaaaaaggaaacaaacctcagagagacagagacagagaccaaccaagaccttgtctgtaccttagtattggtggcatatggaaaaaacaatttcccctgagaatccataaccactaatagccctcaattagattagcagtcagaatgtatgctattgtataatctgaagaatttcaagctcagaacttaatttacggcagtccccagttaacagcacctctctaatgttccccagttaacggcacctctctaatgttcccatccactaagtggaagtggatcatgacaaagtttttcatccttgttgtctctgagtaggctgaaaagcaagagaaagaagtggaatgggtcttgctgtctcagaggtggcagaggtggaagaaaattcacatataagtggacctgcgcagttcaaacctgtgttgttcaagtgtcggctgtaataacatatatgtaatacataatgctgagcaaatcctcgctgcaagaacatcgacatagcccacaaagagtttccactagaaaagttccaaggaacataaattcacaatcgaaaaaaattcacaaaatacacaagagaaaaagccacaagccattacgagtgacatccaacagaaagaactggcaacagagtcaaacctataaagtttcaaatactataatgctataaacattaccagacagaaaatatagaataatcatatttgaatgttttaataaataaaagggaagcttgaaaattaaagcaaagaacaaggaactaagaaaaagaaagatcaaatttgaaaaaaaaaaaaaacaatcagaactagctggacatggtggcacatgcctataatctcagctactcaagaggctgaggtgggaggaatgcttgagcccagaagttcaaggctgcagtaaaagctatgattgcaccactgcactccagtctgggtgacagagcaagatcctgtggaaaaaaagaagaggcgaggagaggggaggggaggggaggggaggggtggagagaggagaagggaagagaaaggaacgccaggaggggactggaggggagaggaggggaaaggaggggaggagaggggaggggaggggaagggaagagaaaggaagggatgggaggggagggagaggaggggagggaaggggaagggaggggagagaagggaggggaggggagagaagggaagggaggggaggaaagggaaagagagaggaggggagggggaagggggaaggggagaagggggaaagggaggaagaaaggaaggaaggaaagaaggaaggaaggaaaaaagaaaaagaaaagccagtcacggtggctcacgcctgtaatcccaacactttgggaggccgaagcgggcggatcacaaggtcaggagatcgagaccatcctggctaacatggtgaaaccctgtctctactaaaaatacaaaaaattagccgggtgtggtggcaggcgcctgtagtcccagctactcgggaggctgagacaggagaatggcatgagcctgggaggaggagtttgcagtgagccgagatccgcaccactgcactccagcctgggcaacagagcgggactccatctcaacaaacaaacaaacaaacaaacaaacaaaaacaaagaaaaaaagaaagaacttctaggaatgaaaaaaagacatttaaaatgaaaattaatggcatattaaacagcaggtattctccatagctgaggaaagatttaattaattggataattcattttttaatccaaaatgaaaaacaaaaaaaaaggatataaaatataaaacaggccaggcacagtggctcatggctgtaatcccaacattttgggaggccaaggcaggaggatcacttgaggtcaggaagtcaagaccagcctgcaaccagagtcacagatggagaccccatctcaaaaactaaaacttaaaaatttaaaaaataaaacagggaggggtgcagtggctcacatctataattccagcactttgggaagctgaggcaggaagactgtttaaagccaggagttcaagatcagcctaagctacataatgagagcccatctctaccaaaaacaacaacaacaacaacaacaaaaagccaggcatggtgatgtgcacctatagtcccactactggagacgtcagattgggagaattgcttgagcccaggagtttgaggtgcagtgaactatgaccacgctccagcccaggcaatagagcaagaccttgtctcaaaaaataaaaataaaaaaaatacctatgatagaataaatgataaagggagaaattttaacatacaggaagcccccaacttagaatagtttgacttaaaatttttgactttatgactgatttatcaagatgtaaccccatcataaatcgaagagcatctgtatatctaatctaggtttcagatggcaatatcagaaaaaaattgaggcaatagtcaaagataatcaccgagaattttccaaaacacttcaaatacacattggtgtgtacagaaagcccaatgagtctcaagcaggattaaacacacacacacataacaggaaatgaaagaaagagactagaacagattaatttattggctgattaattataaaaaacaaccacaggagtagagaaaaggatcccttcaatagaaccaaatagactaaaagcagtcttctcaacagtaacaatgtgacccagaaaaaagacagagatggaagttttcaatgtgctgacaaaaaaaaaggtctgtatgtagaattttatgctcagcaaaatcgtgtttcaagaacgagcatgaaataacattttagactgaaactgagagtctagcaaatcagtcctcattttaaaaaaatcctaaatgatgttctataaaacgaataaaataggccgggcgcagtggcttacgcctgtaatgccagcactttgggaggccgaagcaagtggaccacaaggtcaggagatcaagaccatcctggctaacatgaaaccccatctctactaaaaatacaaaaaattagccgggtgtggtggcgggtgcctgtagtcccagctactcgggaggctgaggcaggagaatggcgtgaacccgggaggcagagcttacagtgagccgagatcgcgccactgcacttcagcctgggcgacagagccagactccatctaaaaaaacaaacaaacaaacaaaaaaaaaaacccaagaaaacaattgtaagtggaaggctgaagatgcaataaggaatggtaaacaactacactggtaaatacatggataaatctaaaaataataataacctctaatttgtgaagataaaagaaaataagataaatctaaactaatgaaccacaatataagttaggaagtagtgatccatatcaaagcattcaaaaatcctcgaaacggaaggaaagaaaagtatgttagacattatgtatgttacaaaagaaacaaaaatgggccaggcatggtgactcacacctataatcccggcactttgggaggccaaggcagatggatcacttgaggtcagaagttcgagactagcctggtcaacatggtgaaaccctgtctctactaaaaatacaaaaaaattcgcagggtgtggtggcacgtgcctgtaatcccaactacttaggaggctgaggtgggagaatcatttgatcctgggaggtggagattgcagtgacccaagatcatgtcactgcactccaaggcaacaaagcaagactctgtctcaaaaacattaaaaaaaaaaaaaacactaaatgaacagaatatagtgcataatatccaaactagtagcagtacccaggactaaacccagcaatgtactccaccaccatgtgaaggttgcttaccaaagggccagcaaataaggagaatgaacagctagagaggtaagaaaaaaaccagaagtgtgtggtattacagaagcacagaaaagggtgtgtagtaaggaagttaaatccaaactaaggcaaaaagagaaaaagaaacagaagagcaggacaaagagaaagtacataaagagtaataaaaataaatcaaaatataaccaaaataattcaaaggggtttagcggttttcccagttaaaagacaagtgttaacgctctttgcaaaaaaaaaaaaaagaacaaaccaaaaaaaaacccccacctaaaacaaaaggaacaagaaaatacgaaaatgaaaagaaagataaagtccgggagcagtgactcatgcctctaatcccaacactttgggaagctgaggcaggcagatcacccgaggtcaggtgtttgagaccaggctggccaacatggcaaaaccccgtctctactaaaaacaaaacaaaacaaaacaaaaaaattagccaggtgtggtagcatgcacctgtaatcccagttactcaggaggctgaggcaggagaatcattcgaacctgggaggcagaggttacagtgagccaagattgtgccactgcactccagtctgggcaatagagtgagactctgtctcaaaaaaaagaaagaaagaagaagatacacaaaatactaatcaaaacaaagctggggttattccactactattaaacaccaattcatcaaaaagatataacagatctaagtagataaaatatgaagccagtgactgtaaacagcatattagagaagtttggctctgaaggaaagcaaataacacatggtacctgaagacgggatttcaagtcaaagaaagagtttttggtcttggttttattcatttttgattttttggtgttcttttcttatttgttttcatatgaatcatattgaacaaatttgtatgttattgggaattatatgaagtagaggtaaaaagtgaagtagcaggagggagagaggataaattaaaaatgaaaaagaatggaatccacagaacaagagaaaggactgaaattttataaaaaggactttttttcagtgtaataaagtaagaggaaacaggtatggtataggtatgataaaataagaacatttatctaatggttcctattttctcagttatatatacggtgactgagagaaggttaaaaagagacagatttcaaaacaaagaaggtacaaaataactatctcagaaagtaggaagttaatcctactaatatgatattaacagtattgccaggcactgctcaataccaatacccattggaattgttttttggtgttgttctgattgaggtcaactaaattattactagattcctttcagttcatcatattatgaacacagtttagaacatttttcttaaagacatttactgaaacttgttcttaataaagtccagctgatagttttcctcccctctcgcaaatctgtaaaatcttactatggttaaaatacatacacatggagacaaaaaataaacacatggtcagagagagacaaaacagaatgatgaatggacagaaagaggacatatccagaaacgtatgcacaatacacagactcatcaaccaagaggtggagaagaggatagcagagaaaaaaagactgggtaaggactacagctaggccttcaaaggggcaactgacaaaaactatcagagcaaaatttgagcatcttcatctcttcgtggcagtattatgggtgagtgttatgttcttcacattccttatctcctttttctataatcatccaatattacttatttattaaaaataatattaatgcaactaaagctgacttttcaaatttttggaatttttttacttatttacaataatttcttcatttttaatataatgtatttatatttaatataatgtctttaatatcaaagacaaaagtccttacaaagtcatacatgaagacagtaaataatatgtaaattttatagataacccaatttttccttagtccaataacagttcatgacagtacacacacataaatagatactaattaacctgtaattctttataaacagacgttttaaaatcttcagtgagatgacattagcattaaagacaaattggcaatattatttttcagagtcttaatgtacactttctcagtctcacaactaggcacaggcatatagctacaagtatgtttcaaaagtcacattccaacttttacaagaaaaacttgtgagaacttttcctatacaaatcaccaatcgttacaccaaatatttgctcattttcccttaatattgaattttattgccaagttattattttcatacctctgaagagctttcattattgacgtccactgtgtttataggagttgctgatgaatctaaatcagaaccttgagagccaactctcccaggagtctggaacacaaacagtagggaggaaaaaaaaacaaagcagacattaacaatatattcatcggccatttaataatctaaaccttttcacataagaaaagtagatgtctttacaataataacagtactaacagtatcatttatggaagagtgtacctaatgctgtatcaaaatctctatatatgcatttctctcattttaagtcactttaaacaaaatgtatacaacactttacaaagtcttcaagtcaccttcacaaaacatcatatttaatcaaaatgacatctcttaagacaggtaagatggatgttatctctgtagagaagaaaacagatttaaagcaggaagtgacttgttcaccattgtactcttttgttttggttgttttttgagttggggtcttgctctgtcacccaggctggagtgcagtggtacaatcttggctcactgcaacctccacctcccaggctcaagcgatcctcctatctcagctacccaagtagctgggaccacaggtgcacaccaccacacccagctaatttgttgtatttttggtagagacgaagtttcaccatgttgcccaagatggtctcaaactcctgagctcaaacgatctgcccacctccgcctcccaaagtgctggggttacaggtgtgagccataacgctcagtccaccattgtactgtcagcaaaaatcagaaagtcctcaagatgcaagttcaaggaagaagaaaaaaaatcagaaagttctcaagatccaagttaaagcaaaaaaaatcagaagatgcagaactaaaatgcagatcttctgattcctttgacaatgctttctcttttctttttttttttgaaacaagagtcttgctctgtcatccaggctggtctcactctgtcatccaggctggagcatagtggcacgatcttggctcattgcaatctccacctcctgggttcaagcaattctcctgcctcagactcctgagtagctgggactacaggcacatgccaccatgtccagctaatttttttttgagtagctgggactacaggcacatgccaccatgtgcagctaaattttttttgtatttttagtggaaacggggtttcaccatgttggccaggctgttctcgaactcctgacctcaagtgatccccccaccttggcctcccaaagtgctgtgattacaggcatgagccacagcgcccagccggcaatagtctcttttctacacaaactaaaactacagtgattcaagtggtgcaaaaaagaccaatgcagcccaagttatcaagtccccatcacctaccactcaaaccaatcattaccatccagctccaatacttgatatgacaccatcagagacacattttggagggttaaaggtcttttccccctgtaccatttatcacttagcattatcattcattaaaatctaggtgttacttttatatcaaattgctttttggatgaatctgaaacctagtaaaacactgggtaaaaagagatttagagcacaaaaactgactcaataatactcatcaaaaatatatatggtatatgctagcattatccacactttacaaatgagggaaccaaggcatagagactaagtaaattgcccaaggtcagatgggtaataaatgaaagaagggattttaattagagcagtgtggctcttaatcactaaccaatactgcttctctgttagacatctccactgaaatgcccctcaatcacccaagattcaaaacacctcactacatatttgcctcaacatgtgaacatcctgtacatcactactaaatgttcaacctaaatccaaataaggatgaattcataatgctatattcatcaaaatgattataaaaactatatacaatggaaaaatatacacagtatgatttaaattatatataaaaactactgatataagaaaaaagattaaaaagaaatattccaaaattcaaataatgatttctgtagcaagacaggaatcttcatttttatttttttcagttttcattttgctactttttttttcagaattttagatccatacttgaattgcttttatcttgaaaaaaatgttttatgttaaagataagcaaacctccagtttaatagccagcattcctttttttttcctcatgcagatactttgcacatttatttacaggcatatctcattttattgtgtgtctctttattgcactttgcagatgtggcgctttttagatattgaaagtttgtgtcaactctgccatcaagcaagtctattcctgccatttcttcaaaagcatgtgctcactttgtatctctgtgtcacattttggtaattatcataatatttcaagcttttttattattatcatatctgttatggtgacctgtgatcaatgatctttgaagttactactgcaattgttttgaggcactacaacccatacccatataagatggccaacttaattgataaatgttgtgtgtgttctgactgctccactcactggccatttcccagtctctctcccttctccttgagcctccctattccttgagacacaaccatattaaaattaggccaattaataaccctataatggcctctaagtgttcaagtgaaaagaagagctgctcatttctcactttaaatcaaaagctagaaatgattaagcttaatgaggaaggcatgtggaaagctgaaacagactaaaagctaggcctttgtgccaaacagccaaatgtgaatgcaaagaaaaagttcctggggaaattaaaagtgctactccagtgaacacacaaatgataagagcacaaattgctgagaatgttttagtgacatggatataagttcaaaccagccattaacgttcccttaaaccaaagcctaattcagagaaaggcccttcaattgtacgaaggctgacagagatgaggaagctgcagaagaaatgtttgaaggtagcagaggttggttcatgggatttaaggaaagaagctgtctccataacataataatgcaaagtgaagcagcaagtgatcatggagaagctgcagcaagttatccagaagatctagctaagataattgatgaagatatctatattaagtaacagattttcaattcagaaaaaaacagccttctattggaagatgtcatctgtaactactatagctagagaagagaaatcaatactgggcttccaagcttcgaattccaagcttcaaagaacagggtaattcttgttaggggttaatgcagctgatgacttttaagttcaagccaatgatcatttataccgttctgaaattcctaggacccttaagaattacgctaatgctactctgcgctctatacatagaacaagaaagcctaattaatagcacatctgtttaccacatggatcactgaattttttttttttttttttttttttttttttttttttttttgagacggagtctcactctgtcgcccaggctggagtgcagtggcccgatctcagctcactgcaagctccgcctcccaagtacatgccattctcccgcctcagtctcctgcctcagagtagctgggactacaggtgcctgccaccaaggccgcctaattgtttttttgtatttttagtagagacagggtttcaccgtgttagccaggatggtctcgatctcctgacctcatgatccacccgcctcagcctcccaaagtgcagggattacaggtgtgagccactgtgcctggctggatgactgaatattttaagcccactattaagagctgccactggaaaaaaaaaaaaaaatcctttcaaaaatatcactgttcattgacaattcacctggtcacccaagagctctcctggaggcatacaaggagtttaatgttgttttcatgcctattaatataacatccattccgcagcctatggatcaaggagtaattttgactttcaagtcttattatttaagaaatatattttgtaaggctataactaccatagatagtgactcctctgacagatctgggcagagtgtgtggaaaaccttctaaaaaggtcaccattctagatgtgattaagaacatttgtgattcatgggaggaagtcaaaatatcaacactaacaagagtttagaagttgattccaaccttcataatgactgtgaggggttcaagactccagtagaacagatacggtggaatcagcaagacaactagaattaaaagtggagcctgaagatgcgactgataattttcttttttttttttttcttgagacggacttttgctctgtcaccaggctggagtgcagtggtgtgatctcagctcactgcaacctccacctcccaggttcaagcgattctcctgcctcagcctcccgagtagctgggactacaggtacgtgccaccacgcccagctaatttttgtatttttagtagagacagggtttcaccatgttggccaggatggtctcgatctcttcacctcgtgatccacccacttcggcctcccaaagtgccgggattacaggtgtgagccatcgcgcctggcatgactgataattttcacaataaaactttaatggaggaggaatggcttcttagggatgagcaaagaaggtggttccttgagatgaaatctgctactggagaagatgctgtgaacactgttgaaatgacaacaaagaatttagaatattccataaatttagttgataaagcatcagcagcttttcggaggattgactcaagttttgaaggaagttctactgtgggtaagatgctatcaaacagcatgctacagggaaatctttcatgaaaagaagagttaatcaaagcaaaacagcaaacttcattgttgttttattttaagaaatgccacaactccagcctgaccaacatggtgaaactccgtcactactaaaaatacaaaaattagccaggcgtggtggtgcgtgcctgtaatcccagctactcaggagggaggcaggagaatcgcttgaatccgggaggtggaggttgcagtgagccaagatcgcaccactgaaagaaaagaaaaaaagaaaaaaaaagaaattgacacagctatcccaaccttcagaaacctccaccctggtcagtcagcagctatcagtatagaggcaaaaccttccacaagcaaaaagattatgactagctgggcaagatggcccacatttgtaatcctagtgctttgggaggccaaagaaggaggatcgcttgaggctaggcatttgagaccactctgggcaacataatgagaccccatctctaccaaaaaaatacaaaaatcagcaaggcgtggtggcgttcacctgtagtcccagctaccagtgaggcaggagaatagggtctggaggcaaggaaactaaggctgtttcatggcaacttcctagaactaaattgaaaggaaaaccctaactttccacacctaagtaacaaaaggaccacaggctactccctttgacctttcctttgaccttttctgcacagatgggaaattggctatccacaacaaatcagactgattgtgggcaagtcttcatttgcatagaagtataactgtgtagctttaccctaggctctgattggttgccttttgcaaccaatcagatgtttgcacaggagtgtgacctttgtaactttacttcagcctctggttggctgttttctgcaaccaatcagactgaatgtgggttaccacttcatttacatgaggtgagcgtgaagtggctaatcagaaacgtctagggggtatttggacccaagaagatgctgtatccaggcccttgagctgctgctcaggcccactcccacactgtggagtgtactttcgtttccaataaatctctgctttcgttcttttgttgcttcattctttctttgctttgctgggcgttttgtccaattctttattcaaaacgccaagaatctggacaacttgcagtcacgaccctctaccagtgacaataggaaggctgaggcaggaggatcacttaagcccaggaattcaaaaatgcagcgagctatgatcacaccattgcattatagaccggatgacagagcgagactctgtctcatcaaagaaaaaagattacaaatcactgaaggctcaaacgattgttggcattttacagcaataaaatattttttaattaaagtatctattagacataatgctattgcacacttaatagactacagtatgccgtgaatataatttttatatgcactgtgaaaccaaagaatttatgtgactcgttttattgcgatacttgttttattgcagtgatctagaaccaagcccgcaatatctccaagatatgcctatatacaagtatgcctatatacttgtataatttttatataaatcaggaaactagaacaagtacaaaataacaaccagtaattaaagctacagagaaattcccaaactcttctcaaacatacttcctcaaagaagggtataagattaaacttttattttatattctggatagagtattaacctagcatgccatgacaaaggggaaataaaatgatcttgaaccttttttaaagtacttatgttctttaggattctcagaagaactcagggttctgtgaggttctgtcaactaaagaatgacaaagaaggaacattatggctgggtgaaatggctcacgcctgtaatctcagcactttgggaggctgaggtgggtggatcacttcaggttaggagtttgagaccagcctggccaatatggtgaaacctcatctctactaaaaatacaaaaattagctgggcatggtggtgcacacctgtaatcccagctattcgggaggctgaggcaggagaattgcttggacctgggagacagaagttgcagtgagccgagatcgtgccaccgcactccagcctgggtgacagagcgagactccatctcaaaaaaaaaaaagaagaaggaacattacttgtgtaactatgtcttcttttttttttcctttttttcccttttttttttttttttttttttttttttagagacaggggtctcagaatgttgcccaggctggtcttgaactcctaggctcaagtgatccttctcccacttcatcctcccaaagtgctgagattacaggcatgagccactgcatccagcctatgtttcaataaagatggctagagaacatcagaggcacacttcagaaagagacaggtatcttactcatgagtgaaaaaaaaaaaaaaaaccacaaacattgtttagagatggaggaggcaataactgtatcctgtccaagaatagtagcaaccaccacaccaaggcttatccaaaacaggtagaaagtggcagaatttcaataaagtactaaagatgaagaatgcaaaatgaatctctggccaaaggcaaaaaaaaaaaaaaaatgagaggagctggatatgaggggtctccatttggttgtcgataccaggagacagtacccactacccgaaatgatgaaattgtaaggctttcatcctcagagaagtcagagaaggttaagccaactgaatacatgagtgaaataaacatgaattttagataccaccaatctagatcaaatctcacttcagcctaacttcaatttgctacaggctttagagaggctgcactttattgccaggtcttggagcctgagcactacctcctgcctcagcgtggtcgctgacccttcttctgggaggtttccactttctagacaagcagacaaagcttgtgaaataatcaaagcagtgatgccaaggatgtcatggcagaaggcctgggttcctgagtcactgagagctcagagggctggatttgacattcctgatgcattacacaggcacattcatcctgctgacactgtaatctgtcctcattgggaaagttaggatcatcttcctgggcactgaatagggtcagcttttaatctggtctcttcactttgtagtgggacaaaaggtgttggaagaattaggggagagggtgcagtgggcctctactttctccttcctcttgctcgttctcattttctttgtccttacaatcttcctaaaatgcctatgcttttttggaagttgatctagctttcttttctggactggaggcacagcaggatattgtgaaacctcagccacatgactcttgggtgtctcctccaatggctctgataatgattccaaacttctcttcagagggtgaacttccattctcccttgggtggaatttatcttccacatcttgagtatttggtgatgaacgttcaagtctttagtgacatgtttgggagactggagattcctaaagtctgtcactgaggactttttttttaaaacctactatgctgatcctagccagctttgcagaaacaaggaatcacaacaaaagggaccaaaagtcaaatgatatttttaaaatggtagttagcaccctgactgtttccaatgacgtatccttagctatcactgatacaggagatatactcatttcagatttctcccctcgacttatctaaaggcattcaatggccttcagaaataaagtcctcaagttgttcttagcctagggaatctcagatttcctagtatagtatggaagagcaggcctcagtctctacagtccctttaaactttcccaaaatctaacattctaaaactgtctaaatttatccagagtatgtctttactgtgtgtttttttttttacatttaatgcccacaaaattttcttgttttaatatcagctacagttctgcaaacaccaaagcaaaattctttcccaaaataatataattgagacatgaatttataaataaataaaagccagctctggatttaatgatacactcatggatgtggcaaaaagtaaatggcgaaaatgttttaaaagagcatttaaatttttttttgtagttgttttttttttttgtcttgttttatttttttgaggcacagtctcactctgtcacccaggctggggtacaatggtgtgatcttggctcactgcaacctctgcctcccaggttcaagtgattatcctgcctcagcctccccagtagctggaattacaggtgcccgccaccacgtccagctaatttttgtatttttagtagagacagggtttcaccatgttggccaggctggtctctaaatcctgacctcaactgatccgcccacctcagcctcccaaagtgctgggattacaggcgcgagccaacacgtccagcctaaactggatatttaatataaagaaccgttctataaaactagaaattcatttttgattcattaacatttcaataacttcacactacgatggtattaagaacaatgaaagacactggaaacaggaagttatacttccaaagaactgtattttcctcatttctgtttcctttatttttccagatgccagatggcttttcaccaaggttttccttgactgagccgaagtaagcaattcaaagaaatattgtacttttttttatttttgtaaagatgaggtctctgtatgttgcctaggctcatctcaaacctatgggctccagtgattctcctgcctcaccctcccaaagtgctgggattacaggtgtgagccaccatggccacctgaaataaggtacttctacataaacctattatcatcaccaaaaataccctttctcaaatttgcctacaataatcctagtaaatatacctaagtaaagcccaagaggcatggggagtaaacagagaaaaaaacaaggaaaccctcacaagtcaggggtttttgatgtccatattttaaatatactcctcatgattgctgttaaattatctaagaacttcttgtttttttttttttgagacggagtttcactcttgttgcccaagcgggagtgcaatggcattatcttggctcactgcaacctctgcctcccaggttcaggcgattctcctgcctcagcctcccaagtagctgggactacaggtgcacgccaccatgcccagctaattttttgtatttttagtagaaacggggtttttccatgttggtcaatctggtcacaaactcctgacatcagatgatccgcccacctcagcctcctaaggtgctgggattacaggcatgagccaccgcacccagccttcattcttattctatttttaagccactaaaattcctttatttcaaggagaagcccaaaaacaataacactaaccctaaataaagcatataaagcattctaactttttcacttataaaagttttattttgcaaaaagaatgggattggaatgatttatgctaaaaatttaaagtgataggctgggcacaatggttcacatctgtaatcccaccactttgggaggtccaggtgggaggatcacttgagcccaggaagtcaacgctgcagtgaactgtgattatgccactttactccaccctgggcaacagagtaagaccttgtctccacaaaaaaaagaatttcaaatattattaagatggaaccaatcttaaaaacaaggtacacaatggaccaaaaataaaatggaaacatagagtatccaggattctggaacctaaaacaggtagaggcagctaagttcagtaataagaaccaaaaacgccctggatgcgcaaggtaacaagaagccaggcccactgtgagaacttagtaagcggggcaaggcaactatcccttgcaatgaatagaaactctttaaaaagctgtaaatccggccgggtgcgatggctcacgcctgtaatcccagaagtttgggaggccaaagtgggcataacacgaggtcaggagttcgagaccagcctggccaacagggtgaaaccccgtctctactaaaaacacaaaaattagctgggtgtggtggcgggcgcttgtaatccaagctactcaggacgctgaggcagtagaatcatttgaacctgggaggcagaggttgtagtgagtcaagattgtgccactgcactccagcctgggcaacagggcgaaattctgtcttaaaaaaaaaaaaaaaaaaggctgtaaatcctgccacacactgtttaggcccaaagtttgagcagagcttttccaggtagagatgagagggcattccaaccaaagcattatttgtaacagcttataaatcataagcaacctatatgttcaaaatgaagaaactgttaactaaactacgacgtaactgttcaacagtcttttttttttttttttgagacggagtctcgctctgtcacccaggctggagtgcagcggcgcgatcttgacttactgcaagctccgcctcccgggttcacaccattctcctgcctcagcctcccaagtagctggggttacaggcacccgccaccacacccggctaattttttttgtattttttagtagagacagggtttcaccgtgttagccaggatggtctcaatctcctgacctcgtgatccgcccacctcggcctcccaaagtgctgggattacaggcatgagccaccgcgcccggcctgttcaacagtcttgacaattaatgggataagtgtgtaggttataaaagcatgaaggttatgtagaaaaatgagaatgcagtcggaagcggtagctcacgcctgtaatcccagcactttgggaggctgaggcaggcagatcacctgaggtcgggagtttgagaccagcctgaccaacaaggagaaaccccatctccactaaaaatataaaaattagccaggcgtggtggcacgtgcctgtagtcccagctactcgagaggctgaggcaggagaatcacttgaacccaggaggcgaaggttgtggtgagctgagatagcaccattacactccagcctgggcaacaaaagcaaaactccatctcaaaaaaaaaagaaaaatgagaatgcatatgatatatgatacatctattgtgagaaattaaaaaaagaaaaaacaaaaagaaagaaaagaatgtatatgatataaatcctgaatttgtcaaagaggtaaatacaacatttgtatatattatgacttcaattacataaaaatacatacacataaagagattaaaaggtaatcatataagaccaatgagttttatgttaggatgatttttttgttgctacttttccccctcatattactgaatagatgagatttgtgttaagatgattttattaaccacccacctacttccacccataattttttgttagtgttgtcatattactttttaaagttttctgatttttttttttttgagacggagtttctctcttgctgcccagactggagtgcaatggtgcaatctcagctcaccacaacccccgcctcccgggttcaagcgattctcctgcctcagcctcctgagtagctgggattacaggcatgcaccaccaccccggctaattttgtatttttagtagagacggggtttctccatgttggtcaggctggtcttgaactcctgacctcaggtgatctgccagcctcagcctcccaaagtgctgggattacaggcgtgagccaccatgcctggccaaaagttttccgatttttaaaaaaccatttggccttgacaaaaagatccagagaattctaattatcaaacactcaccattaatgtttaagtagctacaaccaaacagaccaactaaaggaaaaccagctacaacaaaactatttctctattcactatacttctgaacaaatgtttgagttttccacaccaattctctgcagccaccaactgtatgtcccacaatttaattgaattctgacactatctggaattagcacagacctcacagactaagggatcagtcccttaagactgccctccccttctaacaccaatagcaaataaaaggtccccaggttacccacacttttgtctactttggctacatgtcgggaaccctcacaactcccctcctcaggtttgataatttgctatagcagctcaaagaactcagggaaacattttacttatgtttactctaaaagatatcttaaaggatacaaataaacagccagatgaaacagtatgtaagggaaggtctgcagggctcccaagcacaggagcttctgtccccatgaatttagagatacatcaccctcccagcacatgaatgcattcgacaaccaggaagatctccaaaatcactgtttaaagtttttacagaggttccattatgtaagcatgattgactaagtcattggccattggtgattaactcaatctctagcccctctctatgcctgaaggtcagagggtagggtcgaaagttccatagccttaatcttgtggctagtgtctatggcaacaagtccccaacctgaagctatctaggggcccatcaatatcaccttattagcataaactcaggtattgccaaaaggtacttattatgaatgacaaatgacattcctttcacctccatcactcaaggaattccaagttttaggagctccatgccagaaacaagaaaaaagaccaaatatatatttcttattataacaatattacatcaatatttgaaattatgaaaaaaatacatagtattccaagtatttacttcaaataagaacagatgttggctgggtgtggtagctcacacctgtaatcccaacaatgggaggccaaggcgtgcggatcatttgaggtcaggagttaaagaccagcctggccaacatggtgaaaccccatctctactaaaaatacacacacacacacacacacaaagctgagcgtggtggcacacacctgtaatcccctggggagcccagggcaggagaatcgcttgaacccgggagaccgaggttgcagtgagccgacatcacgccactgcactccagcttaggtgacagagagactctgtctcaaaaaaaaaagaacagatgtctgcaataaacaggatatcctagactgctggtaataaaaacaaattcatactacaagatcagtataaaaccgcattaatctctgcaaaaaactatcaaagaagcaaacacaaatttgagaaagaacagcactttactgggagaaaaaatgttattgtttacttatgcaatatcttaaaaagaaatatcactgtcacagaagttttaacaacctaaaacttttttgaaataaatgatttatctattgcagactagttgtttactgagtataatttagacatatatatatatatatttttaataggcaaaatctcactctgtgacccaggctgaagtgcagtggcacaatcatggctcatcgtagcctcaaatttcctgggctcaagccatcctcccgcctcagcctactgagtagctaggactacagatgagtgccaccacacctggctaattttcttttcttttcttttcttttttttttttttctgagacagggtcttactctgtcacctaggctggagtgcagtggtgtaatctcggctcattgcaacctctgcctcctgggttcaagatatcctcccacctcagcatcctgagtagctgggactataggcacatgccaccacacctgactaatttttgtattttttttatagagacggggttttgccatgttgcccaggctggtctcaaattcttaggcgcaagcaatccacctgcctcagcctctcaaagggctgagattacaggcatgagtcatcatgcctggccctggctaattttctttaagcaaaattctttctaaaactggaaaggatacaagtattagaaattaaataatatacaactcaaaaccttggggatttataagctatctataaggatttcttataaaatgtaactttaggggccgggtgcagtggctcacgcctgtaattccagcactctgggaggccgaggcgggcggatcacgaggtcaggagatcgagaccatcctggctaacacggtgaaaccccgtctctactaaaaacacaaaaaaggttagccgggcatagtggcgggcgcctgtagtcccagctactggggaggctgaggcaggagaatggcatgaacccaggaggtggagcttgcagtgagccaagattgcgccactgcactccagcctgggtgacagagctagactctgtctcaaaataaaaaaaaaattaaataaaatgtaactttcaacactgattttgttactctatttcatctgcatcccaccataaaaacaaattagaaagattttcacaaaaagtttgaaaagccatttactatatgcagaccttaagaacaatgctttaaatacattatgcaagccttatactaaatggatagacaaagggctctcactaacccttttctactattaagagctaaaaacgtaacatatagataaagcgagaagttatctttgcaaataacaaatactatttcatgaaaaaaaattcatgtaaagtaattgaggggttcccagggagttttcatacttgacctcttagcttatcacatactctttaggtaaattcatttactcccttaattttcattaacaccattgctgaaaataataaaacactaactttaatccagacctttgctgagtttccaattcatattttcctgtcctgccaaatatatctaattgaatgccttgagagcaccacaaagtcagcttattcaaaaccaaattcatttatctttgctcaaagctttcacccatctacattctccatctcagattatagaaccatcacacactcattttgcctaaatccaaggcatcactcttacttgtctctattccttaaccttcacatccaatcaccaagttaattcaactgcccacttaaattttgaatctatccccctttctccatctccttggccactaccttaattcatgttgcaatcatctctcacctggacgataaaagagacctaatatagcactctatacctctacatccacatttgtagttgtttactaagaaatcaagcaatggatttctcaaagcattgtaaccaaaccaaactcttcattcatctcaacactttaccatcctaggaaaaagtttactttcctcactatgttctccagcttagtcaataatatcctcatttatcaagaacttcagttaaaacctaaatgaactattaaccaggcatggtgatgggcacctgttatcccagctacttgggaggctgaggcaggagaatcacttgaacccaggaggcggaagttgcagtgcactgagatcacaccactgcgctccagcctgggtgacagagtgagactgtctccaaacaaacaaacaaacaaaaattaaaacctaaatgaactaaaacagatatttgcacaccaatgttcatagcagcattattcacaatagctaaaacatgtaaataatccaatgtctgtcaacggatgaatggataaacaaaaggtagtatatacatccacaatgaaatattattcagcctttaaaaggaagaaaattctgataacatgctgcaacatgaagctagaaataattatgctaagtgaaataaaccagacacaaaaggatcactatcgtataattccacttatatgaggtacctagaacagttaaattcatagtgacaggaagtggaattgtggttacagtgggttcaggggaggggaggaatgaagagttattgttttatgagtatggagtttagttgtaatgattgtacaacaacgtgaatacatttcatgccactggattatacacttaaaaatggtaaaaattgtatcttttaaattacgtatattttgtcataatttaaaaaaaatttttttaaaacctaaataagtattatattgcaggcattaccatacagacaaaataattattttaagtatttaagaatgcagagtttctactacatatccttttgggatatagcacaaagccaaaaaaaattgctaaaaaaagaaacagtaaaattaattcaataatcttagccataatattcatattgttaattttaaagctatttatgtatattttagcaaaaaacatttgctaatgttaagaaccaagatattcagtataagaaaaaatgatataaatacagaatcaaataagtaaaaaaccattttatatcttaaatttgaattatcatttgggtttttgtttcatttttttcctgagacagagtctggctctctcacccaagctggagtgcagtggtacaatctcagttcactgcaacctccgcctcccaagttctagcaattctcctgcctcagcctcctgagtagctaggattacaggcgtgcaccaccacacccagctaattagtaaagatggggtttcgccgtgttagccaggatggtcttgaactcctgacttgtgatctgcctgcctcggcctcccaaagtgctgggattacaggcatgagccaccgcgcccagccctgtttcttaacaataattcttatcattcaaaagcttaaaagcaaagacaacccaaaagcaaagcgcaccctacgtgcttatactatggtctctaaccatcactccccactcaaaggaaccagaattttctagagaaatggctgattccagacatgggagagggaatttacaagataaatctgaaacatattattgtgccaaaaagcaaggaagctttttgaacacaaataaggtcctgtcaaaatgacaaacgtcaccttgaaggtactcccagtagctaaagctgagatcattttcacatcagcaaaacacattgactgtaattgactgaaacatgctaaacatatgtaaatccgtgagttcataatataaaaatccatgagttagtcaactaatctttgacaatggaacaaaggcaataaaatgagaaaagatagctgttatcgcttgaatgtccccaccaaaactcatgttgaaatttaattgcaaatgtaatggtattgagaagtgaggcctttaaaaggtgactaggtcatgggagttccaccctcatgaatggattgccattattgtgaacatggatcagttatcatgggaatggctttgttataaagacaagcttgtggccgagcatggtggctgacacctgtaatcccagcactttgggaggccgaggtaggaggatcacttgagctcaggagcccaagaccagcctgggcaacatggtgagaccccgccttaataaatttaggttgggcacagtggctcacgcctgtaatcccagcactttgggagaccgagaagggtagatcaccggaggtcaggagtttgagaccagcctggtcaatgtggagaaaccttgtctctgctaaaaatacaaaaattagccaggtgtggtagcagccacctgtaatcccagctacttgagaggctgaggcagaagaatcacttgaacccaaaaggtggaggttgcagtgagccaagatcacgccactgcactccagcctcggcaacagagcaagattccatctcaaaaataaataaattaattaaattttaattttaaaaaattaactcaaggtcaggcgcggtggctcacacctataatcccagcactttgggaggccgagatgggcagatcacgaggtcaggagttcaagaccagcctgaccgacatggtgaaacccatctctactaaaaatacaaaaattagccgggcatggtggtgcgcacctgtaatcccagctacccaggaagctgaggcaggagaatcgcttgaactcgggaggcggaggttgcagtgagccaagatcatgccactgcactacagcctgggcgacagagcaagactccatctcaaaaaaaaataaataaataaactcaaaatggatcacaaacctaaatgtaaaacacaaaactataaaccctagaagataacataggagaaattactgtggtttgtccattatttttttaggtagaacaccaaaggcgcaatccatgaaagaaagaattaataagctggacttcattaaaatttaaaatgtcagctcttcaaaagacattgtcaagagtaaaaagacaagtcacagactggagaaaaatatttacaaaagacaaacctgataatggactattatccaaaatatacaaacaactctttaaattcaacagtaaaaaaataaacaatctaatttaaaaataaggcaaagaccttaatagacaggcatcttacaaaagaagatatacagatggcaaatatgcatatgaaaagttgctccacagcatacaccatcagggtaatgcaaattaaaacaatgggataccacaacacagctagtagaatggccaaaatccagaacactaccaccatcaaatgctgacaaggatgtggagaaataggaacaggaattcattgctggtggaaatacaaaatgttacagctactttggaagacagtttggtagttccttacaaaactaaacatactcttactatacaattcagtaatcacactccttggtatttacccaaatgagctaaaaacttctgtccacaccaaaacgtggacatagaagtttaaagtagctttattcataatagctaaagcttgtaattgaccaagatgtcccccagcgggtgaatcaataacttactagtacacccagacaatattctccagcgttaaaaagaaatgagctattaagccatgaagacaatgaagaaacttaaacatatattactaagtgaaatacaaagtgaaaggagccaatctgaaaatgctacatactgtaagattccaattatatggatttctggaaaaggcaaaactatgaaaaaagtgaaaagatcaatgtttgccaagagttaaggggaagggaaggatgaataggcaaaacacagtggatttgtacagaagtgaaagtactctgtatggtattataacggtagatactaaaaatttgtcccaaaatctacagaatgtacaacaccaagagtgaaccctactgtaaactgcagactctaaatgataatgatatgtcaacataggttcacgaatcataacaaatgtaccactctagtggggaatgttgataatgggggagtctatgcatgtgtaggggcaggaagtacatgggaaatctctgtaaccttcactcaattttattgtaaacctacaactgctctaaaaagtaacttgtttttcaaatctatgaatttccttttctcaagaaagagaaaatcaaaagaaaactaagaaaacctcagtgatcactgctggagtagctagtgtaccaactcttattctaacacttagtaatcaatgaaaaacaattaagtctttatcctgccttccaagtatgcactgaaatttgggataaccaaatagccctggttgatatcgaaaagttctttacagaaaaaatttcagttaatatatgtagaagcaatgaaagatttagaagatcattttgcaaatactgctgaaatctaacccaaatgacatcataaaatcttctttgaatgttcttactcaaataagaagtctttccatcctttaaactcgactacgtcccttatttatatttcctcttgcagcacttactcataatacaaggaagaacaaagtggtgtcagtggtagtttgttatggtaattaccatcaatgaatcaggcctatgttttcatgcccttgtaattctcttatgtaatcctcccctacataaactctgggctggccatgagacttgccttgactaatggtagtagcaaatgagacacaagcagagacttgaaaggcgtctgtctgcacaatgggatttgttctcttgttgctggaaactcctctgccaccacataaacccagactagccttagacacatgtggcccaatggataaaaccagcaatatgactgaaggtaccttagatcatccattctgttttccaccttattttctttttatagatttagtgggtacaagtgcagttttgttagatgggcatattgtatagtggtgaagtctcggcttttagtgtacccaccaccctaataatgtcactgtacagaataggtaatttttcatccctcactctcctcccaccctcaccctttccccatttccatctttacgtctatctgtatccattgtctagctcccacttataagtgagaacatgcagtatttcactttgtttctgagtgatttcacttaggataacggcctccagttccatccctgttgctacaaaagacatgatctcattcttttttatggctgagcagtattccatggtatacagaaaccacattttctttatccaatcatctgttgatggacacttaggttgattccaagactttgctgtggtgcaaagtgccatgataaatagccatgtgcagctgtcttttttatacagtgatttgttttcctttggatatatacccagtactgggactgctggattgaactgtagttctgtttttagctctttgagaaatctccatactgttttccacagaggctgtactaatttacattcccatcaacaatgtatgggcattcccttttctccacatcctcaccaacatgttgttggttttgttttttaattttttgtaacagccattctgactggtgtaagatggtatctcaatgcatttttaatttgcatttctctgattagcaatgttgagcattttctcatgtttgttggtcacttgtatgtcctcttttgagaaatatctgctaatgtcctttgcttactttctgatggacttgtttttttcttgttgcgttccatgtagattccggatgttagtcctttgtcagatgaatagtttgcaagcattttctcccattctgtaggttgtctgttgattatttctttggctgtacagacaatttttactttaattcccattttttttctatttttgtttgtgtatttgcttttgaggtctcagtcataaattcttcgcccaggctaatgtccagagagattttcctaggttttcttccagggtttttacttccaggttttttgtttgtttgttagtttgtttttgaggcagagtcttgctctgtcacccgggctggagtgcagtggcgcgatgtcagctcactgcaacctccacctcccaggctaaagcaattctcctgcctcagcctcccaagtagctgggattacaggcatgtgccaccacatctgactaatttttgtctttttagtagagacatggtttcactatgttggccaggctggtcttcaactcatgacctcaggtgatccgcccgcctaggcctcccaaagtgctgggagccatcacacttggcctagtttgaggtcttacatctaagtctttaatccttcagttaatttgagttatctttcgtatatggtgaacaatatgggtccagcttcattcttctgcatatggctaattttctatttattgaataaagtatcctttttctatttattgaataaagtatcctttccccgctgcatttccctacccccaccacaccctcaggtctccccttaccactcacccaccagcccatgcccccatggcctctgcccctgcctttgcttgcctctagccctgcactcagatcccaggcccataatcagaaaccacagtgcatatttttgtcaacttcatcgaatatcaattagtataagtatgtggctttatttctgggttctctcttctgttccattgacctgtgactatttttataccagtaccatgtttactgtagccttgtagcataacgtgaagtcaggtaatctgatgcctcccactttgttctgcttaggattgctttggttattcgctctcttttttggttccacacgaattttagaattgttttttctaattctatgaaaaacaatgttggtaatctgacagaaattgcattgaggctgggtacactggctcacacctgtaatcccagcactttggaggctgatgtgagagaatcacttgaggccaagagtttaagaccatcccctgggcaacataacaagaccttgtctctacaattttttttttttttttgagaaggagtctcgctctgtaacccaggctggagtgcagtgatgtgagctcagctcactgcaacctccacctccagagttcgagcaactctcccacttcagcctcccaagtaactggaagaaaaggcgtgcatccccacgaccaactaatttttgtcttttcagtacagatggggttttgccacattggccaggctggtcttgaactcttgacctcaggtgatccacctgcctcggcttcccaaagtgctgggattataggtgtgagccaccgcacctggccaagctttgtaaatttacttaacttctctaagcatgaaattcccatttgtaaagtgaaactaataatgtcagcctcacagaattgttgcaaagattaaataataaatataaaatgtttaaattagtgtctggcattatggtagatacactataaatagacacatattattattaagtacatctctctacacaaaaaagacctagaatcaaaatttaaaagctgtccaggcacagtggtttgtgcatgtaatcccagcactttgggatgccaaggtgagagcatcacttgagccaaggagttcaagactagcctggataacaaagtgagaccccgtctctacaaaaaatacaaaaaagtagccaggtgtgctggtgtgggcctgtaatcccagctactagggaggctaagccaggaggactgcttaagcctggaaaggctgaggttgcagtgagccgtgatcatgctacttgcactctagcctggacaacagggcaagaacctgtcttaaaaacaaaacaaaacaaaacaaaaacaaaaaaagctggaaggtactcagaaatcatttggtccaattgcagtgacttcatacatgaagaaactaaaagaaagaatagctggcttgcctgacaacgctctgctatctaatggtagagttgcaattaacacttaggtttctgggatctcaactgatattttccctacaatctcaaaatgtttcttgttcatctctctgataacaattaagcctaacttttctaatctcaatttcttcattgataaactctaaggacaggatgaattcacaggatcttccaactccaaaattctcattctatgattgatttggagccataaattggctgacctaaaaggatgtcaaacatatttccagtatctgtatatgcttagttttcttatggtcatatttaaaattctaaaacttaagttattagttacatgaaaataatttgtctctcacaagcagccaagtcagtaagagactgagactatcagaactcattatagataagttcctagtacctaaattgagtttacatatatcatacaattaacttaatattaagtgaaatattaagtgaatataagtattattaagtgaaataataaaagttttaaaaatacccaccatatgattaaaattgacctacatatgttaggcaagtttaaagtatagggtgttttgattcatcaaatatgaatagacagctacaaaaacataccaaaataagggttaacagtctgctttaaagaagaagccacttttcattttatttaagtcttaaactcacttaagggaacagggaaaggtactgacaataaaatttcttgaacagagatctgtggatcatgctcaaaatcatggactgtgaaacaaacttaaaaatctgggccgggcgcggtggctcatgcctgtaatcccagcactttgggtggctgaggtgggcagatcatgaggtcaggagttcaagaccagcctgatcgaaatagtgaaaccccgtctctactaaaaatacaaaaattagctgggcgcagtaccacacacctgtaatcccagctactggggaggctgaggcagaataatcgcttgaacctgggaggcggaggttgcagtgagccatcatcaaagaccaaaagtagataaaaccacaaagatggggaaaaaacagaacagaaaaactggaagctctaaaaatcagagcgcctctcctcctccaaaggaacgcagctcctcaccagcaacagaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaacgcagaagcctcaggagccgacgcgatcaactggaagaaagggtgtcagcaatggaagatgaaatgaatgaaatgaagtgagaagggaagtttagagaaaaaagaataaaaagaaatgagcaaagcctccaagaaatatgggactatgtgaaaagaccaaatctacatctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaaggtcagccagagagaaaggtcgggttatcctcaaagggaagcccatcagactaacagcggatctctcggcagaaaccctacaagccagaagagagtgggggccaatattcaacattcttaaagaaaagaattttcaacccaaaatttcatatccagccaagctaagcttcataagtgaaggagaaataaaatactttacagacaagcaaatgctgagagattttgtcaccaccagacctgccctaaaagagctcctgaaggaagcgctaaacatggaaaggaacaaccagtaccagccattgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatgaaactagaactcaggattaagaatctcactcaaagccgctcaactacatggaaactgaacaacctgctcctgaatgactactgggtacataacgaaatgaaggcagaaataaacatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaagacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaatgaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggatctgaaattgtggcaataatcaatagcttaccaaccaaaaagggtccaggaccagatggattcacagccaaattctaccagaggtacaaggaggaactggtaccattccttctgaaactattccaatcaatagaaaaagagggaatcctccctaactcattttatgaggccagcatcatcctgataccaaagctgggcagagacacaaccaaaaaagagaattttagaccaatatccttgatgaacattgatgcaaaaatcctcaataaaatactggcaaactgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaagcctttgacaaaattcaacaacccttcatgctaaaaactctcaataaattagctattgatgggacgtatttcaaaataataagagctatatatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaacaaaagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatattgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactatctgacttcaaactttactacaaggctacagtaaccaaaacagcatggtactggtaccaaaacagagatatagataaatggaacagaacagagccctcagaaataacgccgcatacctacaactgtctgatctttgacaaacctgagaaaaacaagaaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatatccaaaacaccaaaagcaatggcaacaaaagacaaaattgacaaatgggatctaattaaactcaagagcttctgcacagcaaaagaaactaccatcagagtgaacaggcaacctacaaaatgggagaaaattttcgcaacctactcatctgacaaagggctaatatccagaatctacaatgaactcaaccaaatttacaagaaaaaaacaaacaaccccatcaaaaagtgggcgaaggacatgaacaaacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacgagaggtgctggagaggatgtggagaaataggaacacttttacattgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaatcatcattctcagtaaactatcacaagaacaaaaaaccaaacaccgcatattctcactcataggtgggaattgaacaatgagatcacatggacacaggaaggggaatatcacactctggggactgtggtggggttgggggaggggggagggatagcattgggagatatacctaatgctagatgacgagttagtgggtgcagcgcaccagcatggcacatgtatacatatgtaactaacctgcacattttgcacatgtaccctaaaacttaaagtataataaaaaaaaagaaaaaaaaaaaaaaaaaagaatcgcttgaatccaggaggcagaggttgcagtgagccgagatcacaccactgtactccagcctggcgacagagcaagactctgtctcaaaaaaaaaaaaaaaaaaaagaaaaaaagaaaagaaagctattagaagatggtcagagaatgacagattacattaatgcatttaatatttcaataatttccatgtagtctgtactccctgtttctattcccttacttcctagtcattcatttccccctgtgactctcttgaaactgaaataggtatgacccaattgtcacattcagcggccacttctcagtccttatttgactcaacttctcttcaacatttacacatacccaacacctggcctctacttgtcttctgagtgctggacctgtattttctcctgcctactgaacatctccacttgggaagtccagacctctagttcacatttatcttcttccccaacattttcttcctcctctacccttaatcttacatctattccaccaccctcacagctacccaaactactcacaagtcaacaagttctagcaattctatccctcttattgaaaatcaatttattctttctccatccccaaaactgctgcctgaattcaaactttcgttatccctagactgagggccagaggtccagaaattctgattcaattgagaaactcaaaaatctggtttgtttttaagaattccaaatgactccaatatgcaacgattttaagaacgacaacaactttctagctgatctctccctaatgaagtcatcctctctacagggccaacaagtagtcaatatatactactgaaaaaccaccaggcatcaagcaccacgttagacctaaacataacaaagaaagacaacaaaatctctaccctggcggggtgcggtggctcacgcctgtaatcccagcactttgggaagccgaggcgggcggatcgcctgaggtcaggagtttgagaccagcctggccaacatagtgaaaccccatctctactaaaaatacaaaaaaaaaattagctgggagtggtggcgggcacctgtaatcccagctactcaggaggctgaggcaggagaattgcttgaacccgggaggcagaggttgcagtgagctgagattgcaccattacacttcagcctggccaacaagagcaaaactccacctcaaaaataaaataaaataaaataaaataaaataaaataaagattacctgggagaaatatttttggagggtttttccttattacagatttgataactttaaaattctctggccgggcgcggtggctcacgcctgtaatcccagcactttgggaggctgaggcaggcagatcacgaggtcaggagatcgagaccatcctggctaacacagtgaaaccctgtctctactaaaaatacaaaaaaattagccaggcacggtggtgggcgcctgtagtcccagctactcgggaggctgaggcaggagaatggcgtgaacccgggaggcggagcttgtagtgagccgagattgcgccactgcactccagcctgggcgacagagcgagactccgtctcaaaacaaaaaaaaaaattttctgtggctccttactgtctacagtataaggtccaaaacccttcaagctacctgttgcaaacatcccatccacatccagaaatacgcacaatccccctactctatactaaactatatcatgctcttggatttgtctggttcctatctctaaaatgcccttctgtcctttttccctccttgcctgagtcactgccatcctctgcaaagacttccacaatctctattccttgccctcccctaccacaccccctctccaccacatagttactttttcttttgtgcttacaaacttttcctctgtgtatctattacacttatcacattgttttgtaattatttatctgtctcctccattaaaactcagcaggttttttttttactctcaagagtgttttgcacagtagttagcacaaaataaatattcggtagtacataaaatgaatgtacctatgttctaagtcctcatctacctcatctacaaaaaaaaaaaaaaaaaatggagattagaaaaataaaggaagtgataagaaaagtgttccttaaagaaatttggagtttataattataataacactgaaacaccattttaaaaaaatcagccaggtgtggtagttcacacctataatcccagctattcctgaggctgaggcaggagggccacttgagcccaggaggcaggggctgcagtgaacgtgacggtgtcactgtgtcactgcactccatcctggctgacagagcaagaccctgtttcaaaaaagaaaaaaataagaaaagaaagttaaacaccaaaaacaacaacaaaacaccaacattagcagcagctaacatttaagactttttttttttttttttttttttgggatggagttttgcttgttgcccaggctggagagtgcaatggcacaatctcggctcactgcaatctcagcctcccaggttcaagcagttcccctgcctcagcttccctaatagctgggattacaggtgcccgccaccacgcccagctaattttttctatttttagtagagacggggtttcactatgttggccaggctggtctcaaactcctgacctcaggtgatccacccacctcagcctcccaaagtgctgggattacaggcatgagccaccgcgcctggctgagacttttatacatattagttatctagttctcaactttataaggaggctagtattattacaactattttactgagacacagagaagtaacttctccaaaactacacagatagtaaatgaaacaggatacaaacccaggtagtctggcatcagagttcatgttcttaactactaaattacattatttctttagctcaagcaaaaggccactggaattagagaagaaaattgagtactagccctggttcttttcatttcttaacgtcttctttattcttagttctagtcctggttctttaatatcttaatctcttctttattcctaacatgctaaaaaaaaaaaaaaaaaaaaaaaaaactactcaaaaagaaaatcattccattagctgtcactttttaaaattcacttcaataaattagcaatactttcatcaaacttagatgggcaactaatctgggaagccttcccaacatctaaaaccagggccctcttgctgggtgttcttggggcatcctgagtttgtccttcctagaactcattcaagagtatagttgtatgaatctctgaacaattcctctctcttccactggacgctaaactccacaaaaaattcatgactactttacccatcattgtctgcacagcacacagttggcccacaaaagatgtctcaaaaaaaaaaaaaaaaacactaatcacagtttttttgttttgttttgttttgtttttaacacagggtctcactctgttgctggagtgcagtggcacgatcttggctcactgcaacctctgcctcccaggttcaagcaattctcccacctcagtctcccaagtagttgggactacaggcgtgcaccacgatgcccggctaatttttgtattttttggtagtgacggggtttcaccacattgaccaagctggtctcgaactcctgatctcagtgatctgcacgcctcggcttcccaaagtgatggaattacaggcatgagccactaagccagcccacagtaagttataatacttaagaaagaaatggcaacaaggtttacaagctgcctaaggtactaaacgttgattaaatttctaaccatcaagtactttaaattcatgtttttctttgaaggactattaagtaaaatattcaatacatacatattggagctacttcactttggttttgttttgaggtttttttgtttttgttttccagcttctttcaagcctcagagaaacaccttagtaagctaatgaaaaaggaggagcaggaggagggacaaaagcaggagaaccagaaaccaaatttccgtaaagtatcctgagacttattgatgatgttcaaacactttgagttctaattgatggtaagcagtttgtctgtttcttcttttaaaaaatgctatttaaaggaaactattcagaagaaaataagaatagttaaaatgaaaagttcatctaaaaacaaaatgctaaaggaatgccacataattttttttttttttttagacggagttccggtcttgttgctcaggctggagtgcaatggagcaatctcagctcactgcaatctccacctcccgggttcaagtgattctcctacctcagcctcctgagtcgctgggattataggcatgcaccaccactcccggctaattttgtatttttagtagagtcagggtttctccatgttggtcaggctggtctcgaactcccgacctcaggtgatccgcccgtctcggcctcccaaagtgctgggattacaggaatgagccactgcacccagccaaggaatgccacataatttcaaagcacagagtccatttcaaataaatctctaaattaacaatagctttaatcttatagcttaatatctgtgctgagaaataagattagcagggaggggtaaaataggttgccatgttacacaatttaaagattcaagttatacttgttggtaaataccacttgtagagttaataaaatatatattctaccttctaaactagtaaatcaccagatttaagacatttatcaaaatgtccctattaaatactcagcattaacactgacccaactacaagataaaagctgaactccttcaaagggactcttacgtcctctcacaatttggtctctagccaccacggtagcttcatctcttactaattgctacagaccatctcacttcctaagcttcattgttcacactcctcacagtactacctgcgccttttatgactccatctctttgcatttgctgttccctctgcctgacatgcccttccctcttctgagctgtgaatatgcccccgtccctgaagcttttcctaattgccctcacctcccacagagtgcctcctgggtcctctgtcctcttcattattctattacatagcactgtcattacttttaaatgttcacctcccaaacagcctgtgagttctaaagggaggacccacagcttaatcaactgtttcctaccccttagcatgaagcctggcatttactgaaactcaatataaatacactgaataaaagaaaattaagtacttaactgtgagaaacacttcaaactttcctactaaagagttaatgcatttaacacagtgattctcaaccagaggcaattttgcccctaggggacatttggtaaaatctggagctatttttggttgtcacaagggggaagggatataggggaatgctactggcatctagtgggggtagatgccagggatgctgctaacatcttacaaggcacagggcagcctcccacaacgcagaattatccagtcacaaatgccaatagcgccgacgttaagaaactcagttgtcaactgacttattcagaagtgatgattcaatatcacatctctgcaataaccacaatcaatttcacttttgtagtttcaacagaagcttctttaacagttgataggtatgcaccaacattaaaaatgatcttcatataatctcgatgtttaactttaaaccaagattactagaaagcatcccatatttctgaaaaccaatctataactacagctgagctacccttaaaccagtaaacacttttatttgtaaacttcaaagcaaaccacaggcaaactaattttcacttgcagaactatgacagaaacacaatctgaaacatgaggtaatcagttcctccaggtctgataaaagaaaaatctcctaaagcctgaaagtaaatcatgcacagatgtctttactgctgaactaaggaagtgatggggaaagtaaaggacatgcccttgttactgccaaaatcatcgcttaccgggatttcaaaattcacaaaacactgcaaaatacaattaaatgtcaacacaggttgtcagataaagaagttaactatttctccctctaataactgaccaagtttcacatgacttcattctttcaggagaaagctaggcagaagcaagagcactcccttcctatctactggatgactcaactctcttccgcacattcctcggctgaatcctacaaattcactaatttcttttgtcctttgaactagttatcctactccctcggtaaagaactaataggctcggcacctacttttcaatcatttacattttgttacaccctatcagcctcaaaaagaaaagaaaaaagctataccaaaaaaaaaaaacaaatttaagttgacaggtacaataactcttacaggaaaagagatgtgaattatgttattctagtaactgattcttaaatgatacacctacagttttctaatgctctaatctttctatcctcaaggttttccagatttcagagacagcacaggcagaaactaagtgtatataccacttgatcaagcttactgcggatttattcttggatagctaaaataaggtagtggggcttgcacagaaaacatatttttaattaaaaaaaaagtttccaacagtgagtaacatcttccttctcggctgactgtgccagtgtcagtcccacgcctgggcccaggctaggccggggctcaccacaccaccctccactgtggtccaaaggagaaagcagggccgtgtgtggcaggtgcgcatcgtgtcaaattggggggcacggggagtgcggcgggtggggaaaggcgaagcaagccgcccgaatctcccatggggcgttctccagcccggcaggcggcggctggcccgtcccacgggcaccaactctccattttcactcccactcagggttcccgggaggaacgcgccggcaccacaccctccagctcgcagcccgctcgcacacacggagccccgcgccggagcgggcgccaggcctggacgcgcggggccaccagggctctgcctgccgccccgccgcgccggccccacccgccctccccgcccccgggccgggcgaccgaggcctaagcgcctgccgggctgtggggcctagggaaggaaggagcccgcgctgaggaggggcgcccgcgccgcggccccgagctccggctgtcccgctcacgtgctgccagaaagacggtttcactctcttaccctctgtaaaatcctccttaacatggtttaaccaccacccggcgccgccgcggtgactctccagaccctgcgcggggccactcactactcggggtgcgcgggcgggagggactgggccgggaggggaccgggaaggaggtcggggcgaggcggtggcgacggccgctcgggcggccccgacttccccacaggcggcgagagggagcacgcgagagagagcgagcgaacgactaggcagcctgcgagcgcctccagcccgcccgccgggcagcccccgtaactgacagat

SEQ ID NO: 303 - DNA, 373979 bp, Homo sapiens
  source 1..373979: mol_type = genomic DNA
ggtgcatgcaagcgatactgcagggccagaatcagaatcatcagcacgtagcaactgattggatttctggagcaagaaagaagagttgaagataatgttgaactttctcattgggagattttactaacattattgagcaattactgcatgatggatgttacgctaagagcattctacaattattatacctcttacgtctcccagtagttctgttaagtaagtactattgtttttgttttagagacagagtcggctctgccactcaggctgtagtccagtggtgcaatctcagcttaccatagcctcgggctcaagcgatcctcccacctcagctccccaagtagctgtggtcccagctggctccatatgaaaagcctcttgcttccttaattactaaccaatggtaatagtttttttcttttttgtttttttcaagagacaaggtcttgctctgtcacccaggctggagtgcagtggtggtaacatagctcactgcagccttgaactcctgggctcaagggatcctcccacctccgcctcctgagtagctgggactacaggcatatgccaccatgcccagctaattttcaaatattttgtagagaccagggtcttgctaattgcccaggctggtcttgaactcttacctcaagcaatactcctgcctcagcctcccaaagtgctagtacttcaggtgtgagccaccacccccggtgaccaacagtaattctacacttcaatctcttgcatccttacccttatcttgtgtccttatgatcatcataaatagctcatttggccgggcacagtggctcatcctgggcagcacatgaaacctcatctgtacaaaaaaatataaaaattagccaggtgtggtggcacatgactgtgggcccagctacttgggaggctgaggcaggagaattgcttgaggctgggaggtcaaggctgcagtgagccgagatcatgcttctgtactccagcctgggtgagagagcgagaccctgtctccaaaataaaataaaataaaataaaagctaatttgtctcaggctttgaattaatctgcattagctcatgtaattgttgcaataactctatgtggtaggtactctcagccctgttatacaatgggtttgaaatgactactgatatacagaggtttgaaatgatgttacttgcccaagtctcatggtgaatggaggagcaaggaatggaactcagctcatttaacaccaaaggtctgaccaccacacagcactgccctctttagccaaactaatgtttttgtctttcttacttttgacccattttattccacctttctgaggtattttcagcattttcattaagctaatgaatacaacaattatttaagcagctaatccttaaatatgcttctataaaatgtccttttagtttcattttctccttatcactccccaaacccaccagacctacacttcatattttcccaaacgtgtatacacaaggcattcacctgcttttatatgatgtcctttcctgttcatctcaacctggtaaggttaagaaggaaaatgattttacatatcagaggggagagtgctacaaaagaatatgagacacagacaattttgtaaaaaaaaaaaaaaacaactttgtatgagataccttatgtacatacacagaacagttaaatcctgggcaacatgaaaaaacctcgtctctacaaaaaaatacaaaaattagctgggcatggtggcacaggcctgtagtcccagctacttgggaggctgaggcgggaggattgattgagtcctggaggtcgaggctgcagtgagccatgattgacagagtgagaccctgtatcagaataaataaataaataaataaataagaatataataagccaaaagtgaagtacagtgaatgactaagtgttctaaagaaaaataaaagcaacagtccatggaagaggtagaccttaaggatgagtgggatttgatgggaaaagggtggaagctagagtgaagacagaaatcaacatctcattactgacagctatttatcaagcacctccatgtgtttggccattaaattaaagttttgaggatagagatggaaaagctgcttgctgtctttctcccaaatactctgtgtttgggaaaggcttaaacagatagcaaaatacacagtgacacaaagaggcacacaatacaccgagcaagagtttcaggcattctgaaaatgcaggggacatatcccagtaagaatggtaagccctgggacagagggtgagcggtttacatggatcaaagggctcgctcatgataacaacagccttctctaagccaggcactgaatactgtggatacaaagagcccagagtcatcaagaggaaccaggaactctaacatgatgtgtggagcaggctatgcaaagaggggtacctctcccagtcagaggcatcagagaaggcttcctggtggaggtgagtaggaatcacgtgcaatcgtgcaggcgaggcggggagaggacacttctgagcaaagaaactggttagaaaatgtactggtgtgtagggagaaagagggcctccaggtcactcagggttgctatgagagcacgaagtttaaggccaggagcagtgagatgacatggaagagagaggtggtgactggctgccttagggagcctgggcttgatattgagccaggaaaatgttttaagcatcctttaggttagggagctgtatgaattagattcaggttgagccaaggttttagcaagcttcaaatgccaaactgagcaaatcttccctcactgtgagtttgctgtgatcactgttcttatggttcagagaataactgtgctgtagatattaggctcaattcaaagtggagctgctgaaaaatttattagtgctggagtgcataggatgctgttcatgcatgactagcatttcaaagggctgtagattaaaagtgagaggtctctgaagtccaatttcaaaacccagagcctctccgccacttatctcctacttcgcaccaatcctggaatgagtctatagaccactgtaacttctccttctcaacttccacatcttttcttctctttctattagcaacctttatattccctttgggtgttttctttttctttcttttaccacttatgatgcccacatggtcatactatgggaaatgcagagctgaatcccattagagtccattgagagcctgctgtgctccaggcattgtttggggcattttaaaacattatctcatttaattatcctagcaacagtaaaaggcgggtgtcattttacatgaagaattcgtggcacagacaggataaattacttgcccaaattcacacaactagtaatggacagaggtttttcacataagctttttggatgtgaattggaacacactcgtctctgtgaattcccaaagctcttgggataacaatacaaaactttgtcatgacctacaagggtttggatggcgatttctccgctctctcaccctacaaccaaacccagacaattggcatccagggcccaaggtcctggccactctggcatactgtctctgggtttcgaaacagttcatttaggatcctttatatacaacgagttacaaatcatattctgtgagtttctgatctaagttaacagttctttcttaccaaggagacgatgaacacacacacagacaagaaagagctgcagggaagtaacaataacctccaacaggttcttagttggaacggacccatcacaacagacaaacaggagaaaaacagaagtttattaatatggatattttatacacgcatgggggacatccagagaatgagttttcaaagaggtggctttaagttccagtttatatatagcatcttcaacaaagaacaatagatttttagacaagtggcaagacaacaagaaaggactttttgagtttctgtgagcaggctggcaactcaaggaaaagcaaacaaacagcagataaacgctagttaggaaagcctgccaatgcaaattcctctggttccgactctaggctgatgagggtctaaagctgtcttcagtggttaaacttttcttgagggaaaaggcgggggttggtggccaggatattttttgcctttgtaaatctatgtcctccttttggacaaattgaggcagagacctctcctgtacctgtttcttcttgagcatcttcagctcaacaatccttcatattttggggaagatattctggtctcccacagagcctttcaaagaaggttcagctctggtctgggttcctcgtctctcactattatctgagtttgtgtctcccaccctcctctgagtccatactggtctgtggaagaaggctgcttccctgaataaaggccctaatgttctatttgcacaaagctcagtctttctctatgctgaacttggctttattactaagtggctgtgagattttcatgttgtcaactctcctatctcagtttcagtttcctcatctgtgcaaaatcagtcatccccaaagtgttgcccagatcaaaaattttagaattctatgaagagctttacccactagtagaagagagaattaatacattcatcaacgaggaccccatttgcactattgtccagtataattatttaaactttctatctttgtggcatttatgattacttattgtaaatgaaactggtgtgaaggacacacatttttaatgcctttaattgtcatccaaaggcgctttccagctgaaaaattccatgattctaaatgtgtatcatcaatttcatgtcaggcaggatcagaggcttggtcaatattattttttccacagtgaaattgtgtaaggcaggagatcctacttaagctaacatatgtgtatccttcacaatggaagaataaataaaagtataagttgtggatttgctaatagtttcttcctgctaaaaatattaacctcttctattccttaacaataacttaacacatgtagttttagcttaaaattttggggaacttttggtgtcttgaagtattttctgcaaatttatttctcatctccaaattctatgtcccttttctgaatgttcttgatgctacattttcatgtattcatcaacttgagatgtttggctccttttttttgtttgtttgtttttgagacaaggtctcactctgtcacccaggctggaatgcagtggcatgatcatagctcaccacagcctcgacttccctaccttaggtgatcctcccacctcagcctcctaagtagctggaactacaggcacgggccacaatgcccagctaatttttgtattttttgtacaggcggtgttttggcatgttgcccaggctggtcttgaactcctgggctcaagtgatcctcctgcctcggcctcccaaagagctgggattacaggcgtgagcgaccacacgtgaccttttctactgttctctgagctccccaacattttcatatttgccaaatcactgttatgtacagagaaatctccatcaactatttcattatttgaaagaagcgacgccaataaagaatttactctctgtttacttggacataaagagctactccaaattaagacctgacattttctcatctccttctttgcaataaaaataaaattgaaattaaactgggataagtgcaacacattgtatctaagcagccattgtcaaactgtttctaaatatcaacagtaaaagctctaatctgagtcaattttggaatgcacatatattccaaagggaaatgaattttcaaaatggtataggactcaacatcgcatattttagtcttcaggccaagcaggaaaatactaacaagctacttcttccaattttgctattaatgcaaattgatgtaaaactacctgctatgggcgaaacactcagcctctgcaaatggtctcattctgaaactgtcagtgtcagagaaatggtgtttcccttccgcagctcattgaaatggagatggcatggaatggagtaaagggatggggatctgctttctaatcaggcaaaattagattcatttgaattggtgcatggactgaaatgaagggaaaatccaaccagtgcctatttttacctccttagacagcctttgagcagctaggcatagtaaaaccatacatgctaaaatttcccacattgatacagaattcatgaggaaattattttcacactttaatggaatgggtctattgcttacattatacaatgtaagggaaaaaattactaaactcagaagcacatttccatatttctcatcaacttagtttctttgatacaaacataagaagctaccccaactattacagagcacattttgcaaatttcactaatgcatcgtactcatgtgacatcaaaagcaaaaatatcaaagcaaacacacagacaacaaatgaaagcaaacctttatagtgtatcattcagtgaaaaatacatgttctaaagagttgtgatatatgatactacggaactataatatattccagtttctacaatttcagttcttttcagatttggtgtttataaaataacctagtaaagaagtggtaggagaaagtgaaattttacacagtggattatgtgaaacacaaactaatgaaaccagccaaagtttctgagttctttttttttcccagccttcccccagccaaatgagtttttaattcatataggatttttaaaaatcatttatttaattctcctatattttagaataatagcgttcctaggttagtagttttcagactttaagttttcaggacagcaaaatttcccaaggcagtagaaagagctaacatagagttgccaaactgttaattttgccaataacaacaataacaaaaagctaccattgccatcatttcagacaggaaaggatatttccacaccaaaaatgtaggaagttcataatgtcagaatacaaaagagctcttcccaagaaatacaatttgttaaccgtagataattttaaaggatatacttatagttttatatacatttagaaacatttataacattaaaatttattttatactacaacaaatattatgttcccttggtacaatttttttttaatttgatagcactatatgtatttcatactctggtatttgatagcacccatgatgaagggctctaaggtgtcatttgttttggtgttatatttttatcagtgccatcatgaaaaattctgttttacagatatgagcaaaaataaaaacaatagtcttaatagtgttttgttttttgtttttgagatggagtttcactcttgttgcccagtctggagtgatggtacgatttggactcactgcaaactctgcctcctgggttcaagcgattctcctgcctcagcctccagagtaggtggattacaggtgcccgccaccatgcccagctaattttttgtatttttagtagaggcggggttccgctatgttggtcaggctggtgtcaacctctttagcttgggtgactcatccacctcggcctcccaaatatgctgggattacaagcatgagccaccatgcccggcctaatgccgtttcaattattctgacatagtctaggcaaatcaatatgctcaggaacagtagctcccacattctcaagtccttccttttaccttgcttacaatgggcaggtagaaaggccggttgagccaggccaggtgggtggctgggactccgcaggaagtaagctcaggactctcctcagttattgcccctcactttcagggcagaaccatatggtctccttgccttacagagagaagctgggaatttttacaataggtgttctgtgggccagtaaaaactctggcccttcccggcatttgggaaccattgaaatgggtcctttagtctttgaattcctgaattttgtgtaatccagaggagcctgagactctgcgtggctatgggttgaatccacagccatcaaaaagcaccttcccactggtaagttaaacacagtacaaaaagcactggttctagggacagaaaagttgtgttcaagtctctatttaacatagacagttgactcttgaacaatgtggaagttaggggtgttgacccttccaggagttgaaaatccaagtataacttttgactccccaccaaaacttaattattgatagcctgctgttaaccagaagccttactgttaacataaatagtcaattaacacatattttgtatatgtattatatattgtattcttacaaataaagtaagctagagaaaagaaaatgttattaagaaaatcataaggatgagaaaatatatttactactcattaagtggataatcacaaaggtctcatcctcatcatcttcacattgaataggatgaagaagaggaggaagagaaggggttggtcttgctgtttcaggggcagcagaggtggaagaaaatctgagtttaagtagactcacacagttcaaacccatattgtttaagagttaactgtacttgatttcataatgttttctaatgtttttctcatgttcagatgggggttgtggggaggaagaccacacagataaagtgcagtcaagaattcttgatagaatttgggaggccgaggcgggtggatcacgaggtcaggagattgagaccatcctggcaaacacagtgaaacaccgtctctactaaaaatacaaaaaattagccagatgcagtggtgggagcctgtagtcccagctactcaggaggctgagacaggggaatggcatgaacctgggaggcggaggttgcaatgagcggagatcgctccactgtactccagcctgggcgacagagcgagactccatctcaaaaagaaataaaaaataaaaaagaattcttgatagaattctcatcatattctatcaaggttacatagtatcaatagaacatcactattgatatcaaccttgctcaactggttgaaatagtgtttgtcacatttcttcattgtgaagttacttttccctctttccacactactcttcagaaggaagtcacttaaagaatgggaagctatgttccacctccttcagggtacagtaccctcataaattgtttgaaattcatttacatggaagatttgtctattctcctccatctatttatttatttgacaatttatttatatcaatatgttgtcattagttttcatttcaactgttctaatatgtgtatagtaatggtcttaatttgcatttcccttaatggctagtgatattgaacatatcttcaaatgcttgtttgccatctttgtatcctctctggtgaactctctggatgtcttttgccaactttcaactagattctttttaatgttgaggttcagagttctttatatattccagatactagtcctttgtcagatgtgtgatttgcaaatatttctcccagtctttagcttgtctttttatcttcaacagggtcttttgcagagtaaaacttttaaatttttgataaagtccaatttattatttttctaacggtttgtgcttttggtatcacattcaagaacactttaccaagcccaaggtcccaaagactcttctatgttatcttccaaaagcttcatagttttgcattttacatttacctctataattcataatcagttaatttttgtataaggtatgagatttagatgaagatttatttttgtctatgaatatctaatgagccaagaataattttaaggaagtgatatcaatggaaatgaactctaaaccagatgggaagaaaatgaagatggggccaggtgtaatggctcatgcttgtaatcctagcactttgggaggccaagtcggggggatccctcaagcccagaagttcaagaccaacctgggcatcaaagtgagaccccatctatacaaaacaaaaaattagcctagtgtgatggtgcagagtactgtggtcccagctactctggaggctgaggtgggaggatccgaggcagaggctgcagtgagctgtgatcatgccaccacattccagcctaggcaacagagggagaccctgcctccaaaaaataaataataagtaaagatagaaggctaacagataattcttaagtgtcagagtccatgcttaaggtaaaataaatgtagctacgggctgggcttggtggctcatgcctgtaatcccagcactttgggaggccaaggtgggtggatcacctgaggtcaggagttcgagaccagcctggccaacatgggaaaaccccatctctactgaaaatacaaaaactagccaggcatggtggtgcgcacctgtaatcccagctactaaggaggctgaggcaggagaatcgcttgaaccagggaggcggaggttgcagtgagccgagattgcaccactgcactccagcctgggtgacagagcgagactccatctcaaaaaaaaaaaaaaaaaaaaaagtaactacaaagccagtcagccaaagactaagaaatagatagtagttggaaatttcagaaagaaagcaggtactggtggtgtaaataaaaagcccagtagtggccaagggggtgactggctgagatgaggtggagtggggtaaagaagttaaggaactgagatatcagggtgtagagaggcagcctgtgaaagctgaggtcagagaatgatgcaggagtgggtggagagaaagcacattggtcaggggctcaagtgtttttgaatgagcaggaatgagcggaggtcaaggagatgactggtccaagatggggggaaaggagcaagaggagacagtgtcaggagggagggagagaaatgctttgcagtcaacagtgaggagccagggggatgctttttctacttcttggccttagggtgcaagggggatgagaaagaaaaaacaaaacaaaacaaaaaactatcctgtccttgaagaggcagtggggaaggaaatggcctcagaagtcttccaatgtccgttagagcaaacaggtgaaaggaatatttggagaaaatgctgcatgagatgatcccaggacaagaggcaggagggcagtttcaggaactcagaaataccaggaataggaagaaggctttgagtcacactggagagcagagcccaagtgacagagctgcccttggttatcatgaaattctgagggatacgtcgttgttagactgggcctgaaagtcaagagtggaagttctaagagtcctcagagaaaaagagggtgagctgatgttcaggcctctaactgagataattatgtgaaagcactttgcttatttatttatttgtttatttgttttgagacagggtctcgctctgttgcccaggctggattgcagtggcatgatctcggctcactgcagcctccggctccccagttccagtgattatcctgcctcagcctcccaagcagctgggattacaggcatgcgccaccacacagctaattttttgtatttttagtagagattgggtttcactacgttggccaggctggcctcaaactcctgacctcaggcgatctgcctatctcaacctcccaaagtgctaggattataggcctgagccactccactgcctaagcacttcatttataaagctgtgtcttaaaaagctggaaatcactagctattgttaggtggtgaaaggcattacacaaagcaaattaatatgtttgatacttgttgtccagaaattatatatttatgattatatctacacacacgataatattaaaaaatatccattgttgctgggagcagtggctcactgctatagtcccagctattctggaggctgaggatggagaattgcttgagtcccggagttggaggttacagtgagctatgatcatgtcactgcactccagttggggtgacagaacaagaccctgtctctaaaaaataaaaataaaaaaatccattggcctagacataacaatttcatggttagttatatagacaaatatataaatacacacatacacgttagccaaaaatggtaagttcaagcagctgtaaaataaaatgcaatcggacattttacagcttgtattttaaggtcctggctcagttcaatctgtcttctcactggttcctgcttctctcttctttgttctacttctatttctcaccatgttttgacaggtgaggttgttcatgcaaagggatccaacaaaaatacaggaatgccacctttgcctcctcaaccaggacagagcaaccctccctttcctccttgcaacaaagcaggcaaaacacacattctcctaccgccccaccatgaagctgaggcacgaatggcagtgatgctattgttttgcttgcagggagggaattttcatgcaatcaataagtcacctgccctctttgcccaggatcagctctccacccaaacccctgtgagcttcagtggtagaatacttcaagcttcagccagcacaaacatgtcacagcaagagggacagcgattgtatttgcacacacaatttgtttaagtacaggctttatttgatccttaaaaaaaaagaacagctttggtattacattacaaccaaaggaatttagcctttaacctgcagtttccctattctcagtgatataaaacctttttctgataagaggtgaggcccagtgaaattttattcttttccctctttcccggaggtgaggtaatgaactaacaacttaattagaccctgttttataccaactaaaataatagaagggagtctttggtaacatggcaaaaaaaaaaaaaaacaaaaaaaaaaccccaggaacatcaggcatcataatacagagaatatatgattagaattaatcaggatatggaaagatatgtttatcctgtagatacttcaccctgaagccataccatttttatttcccctccattgggcataatggaagggacttgaaccctctgcaatggactgaatatgcattcccctgaaattcatatgttggagttctaattcccaaggtgatgatattaggaatggggcctctgggaggtcgttagagttagatgaagtccggagggtggaaccttcatcatgggattagtgccccatataacaggcctcagagagatcccctgcttcttctagcatgtgaggttacagtgagaaaacgactggctatgaggaagcaggccctcaccagacactaaatctgtcaataccttaattttggacttcccagcctccagaactgtgagaaataaatttctgtgtttataatctacccagtctatggcattttgtgataacagcctgaagggactatgacattattccccactgcccagctccactgagagcttgagagctaggactctagaggacacccgagagagagaggctggctggagaacaaagggagataggcttttttttttttttttttttttttttaacaaaggccttcttgttgctcacaaaggaggaggattctcatagactaatttccaccaatggaaaaaaataagagcagctttgccccatcctctgaacccagtgtctctccaatcatcacacagcaaggttttttgtttttgtttttgtttttcaggtaatggtctgtgtatttgttttctatgctgtgtgacaaactaccacacgcttaacagcttaaagcaacacatgcttattatctcacatgctctttgagtcaggagcctgaacacagctctgctgggttctgtccttagggtctcacctggtggcaatcaaggtgttggtcaaggttgggttctcatcagaggcttgaccaggtaaagatctctgtgcatactccctcaggttgttgaatttatttctttgccattgtagggttcatggcaactcaattcttcaaagtcagcaacagagagagaaagagagagagagagagagactctacctgggtctactaagaaaacagagttctacatgaacaaacatgatcttgggaatgacaccccattacctttgccatattccactggttacaggcaagtcacaggtcctgcctacactcaagagggcagaaacttcaggagatagagatcctgggtaccaccataaagtccatctgtgtctctctagtctagaaatttaagggtatagccaaggagttctagaagcaacatttgtagaagaatcataaaacgagggtagatattttaagtctacacacatattcacacaccctaacctacaaataaaataaaggtaggagtttttcttggtggtcaatggcatgagatattgtagtcatgcagtgtggctttgcatctctgatctataatttattggttgcttaactttactaagcctcagttcccatctttaaaatgggaatcatggtacttatctttgaagctgttatgaaaattaaattagataaagtagacaaaacacttagcacaatgtctggcataaaagtgctcaaaaaatgattgctattgtatccgggtaagatcctgaggtgcctcaaacaaagtagaattttatttttttagttttatatacttaattaactaactaatttttggagacaagatctccaaaagtcactcaagctggagagcagtagtgcgattatggctcactgcagcctgtagctcctgggctcaagctatcttcccacctcagcctcctgcatagctgagactacaggcatgtaccaccatgctaacttttttttttttagtagagctggggtctcaatatgttgcccaggctggtctcaaactcctcggctcaacccatactctcaccttggcctcccaaagtgctgagattacaggggtgagttactgcacccagcccaaggtatgatgttctctagacacagataacttaatcttcaaggttgggttccttctgagatctaagaggtttgacaccattttggctccatgcttccctcaaaaccatggtctttttaacctcctgagtggctctaccaggatctcagcctaccttttcctgtatcttcatcaatggaaccggtaaacttttgcaatgctgagttcaaagtccctgcagaccttcacacttcataactggaatgccctggaggaggctggcctctttcctacccacctatgcctccacccatcctgtccttaggcagacacctacgggtcctagctgactgtcttagcacaagcttcctatatgctagacctgcttagaccttggaacctggctcctgagatggattcactcaattattcactcactaaacacctaggtgacacttaccaagtgccagacacagagctagtttgaaagagagagaagagtgatgaagacagaaccctctcttcaagcaggccattggccaatggagaggcagacacacaccaacagagtaaagccaacacttgactttggacaggaatatatcggacatcttacaccaatccctcagcctgtgaaaatgcaatgatcagccgggccccttgctttctcccatgtctcagttccatcaagattcatgctttctgtacggtctcacaccacttgtgcatttccaacttctactacagttttatgcctcacgtgataagcagtttttgtgctagctgtttagtaaatgtttagtacttactaaaacatttcatacaccatgttttcctttctccgcagaacgtgtgtgatggacttatggactcattcactgcatcgatcttgggcactgcccagcttcatgttccactctcccgtttatcccaaattgctgaggatttcctaagaaccatcactttccagagctcattattttctgttatttgcctcagcagcacaagctgttttcacaaagaaataaagggtcttctattccagaagagttcttctatgcatgtaggtgagcagacagtgcagagccatgctgaggtgtgtgtgccttgctgtcactgtctctcctccgggaggaacactaggctcctgtacaccaggcttcccacagcccaggaggaacacatccacgccttgccagtcatttgcatcttagtaagactaaaactaataaaactaacaataaaacttaaaatagattgaaggattacagtatgccaagcatatatgtattgtgttatttggccctcacagtcaccttttgagctaggcaccagtaccagctttaagagctcaggaagctgaggtgtcaagattttaagtcatttgctcaaggtcacacagctaggaagtgtagtgggagagtcagtcccccatttgtccaatgcagtgctgtcgcccaagtgtgaagagggatgtgcgggtctgagaacaaagttagcctgcttagtactttgtccaaggtcagccctggctccaagcccaagaaacaaggcaggatcagcagccacaaagtccaacagtcagccaggctcccatactgcaggggtctctatcacagcccagctctggatatgggcaaatgaaagctagcagcagagtacccaggctacctctgcacagggagtgactgcggaacttcaagaacaaaagagaggcaaaagatgtggggtggcctgtctgggagggactagggaacagggacaccttgcagataactctcaggactgaggagtaaatatcttttattaaacaaagcttataattctgactctaagcctggcgttcctaacaatggcagggactgatggctgtgaaaggcactaatcagacacagtagattcgtgtttacactgggaagggccgctgatcccgcataggcctttgaagccacccgtgctcacacagattgtaatgcactatgaagtcatgtcttcaaataaaagggaggagttgaaatagacctgtctagccagttatttctctaaggcacttcaaagaaacattttctttgatcgttttgactttccatctataagaaatgtgaacatattactcatagaaattgctgagagacctcaggctgatgggggcttcagtttgacccatcgccagtgaaatgggaaggataaggtagggaagggcacactggttcttaaaacttccaccaggaagtgacacacatcccccactccctcacatttcactggccaaagcaagtcacctggcttatctaacttcaaggggagcagagaaacaccatcccaccacatgctgagagggagggtgggcagatactcatgacccccagtaaacagcactgatgactaacacaaaggccaagtgataaggaggttgtttttaggaggtcaaatgaaggagtatattcttcaagaaaataaggcactgatgagctttgttacatctccacagtaatttctaaaatggaatttccccatgaaggcctttaatatgagcattacaattgtttaagaaaacaaagtgtcctgatttgactaaattatcaaggaaaaatgtggaaattacaaaactgggaccaaagcaattttcccatgtgtaactggaggatgaaacaatccgtctctcattctggattgttggtgggaaaatccactataggactctacaaaggaaaactaccaaaacttggatggcaccttaaaccttttctccctggaacttgcctattatctcgctttttctctcagcagtttcaacgcattttacatgtatcaccacgtctggagtttcagataacctgacgatgactatttatatttcactcacgtgttccttcattcaacaaacatttattttgaggatctactacacgcagcattcttctctagacactagggatacaaagataagacatggttctacctgtaaggtacttattaacaaatttagttgagggaagaaagaacatgaatcagaaaattatagaatattgcaaaagtacaggctggtctcaaggtagtgagatatcttaattgatttttcagtcagctgcagatcgaattattcgtcctactcttcccttctcattaccgtacttgactagactttaagaaaaaaaaaagtaggccaggctcggtggctcacacctgtaatccctgcactttgggtggctgaggtgggcggatcacctgaggtcaggagttcgagaccagccgggccaacatggtgaaaccccgtctctactaaaaatacacacacacaaaaaaaaattagctgggcatggtggtgggtgcctgtaatctcagctactcaggaggctggggcaggagaattgcttgaatctgggaggtggaggttgcagtaagcccagattgcacctctgcactccagcctgggtgacagagtgagactctgtctcaaaaaaaaaaaaaaaaaaaaaaaaaaaaggtgccagctattatgggagagctgaaatgatatttataaggacatcaccttccttgcaagggagtagtgtccgtgtaggggtcactcagtacacagggacatggcttgaggcagtgcaggtgtgcattgcacaatatcaaggcacactcatccccttacaggcttcttagatttatgcagatgtcacttaggtgtcttgaaccacgagtactcctatctgtgccaccatttgaactgcgaacaggacagccagcaacgaaccaacccttagttctctgaaatatgttcatcatatgcttactcttatttttattagtatgatataatgataatctctaacttgctgaacaattttttttaataatcatcgattatacatccagtctgactaagactgttctaaccacattggaagtccgagataaagatatgccacagtccttgacctcaaaaagctttaaaactagatggggaagagagacaaaagcacataaatcagttcgaggataattaaatgctaacttgtgtaacactaagtttaaatacaatctgagttatgaagaccaagacatcagccttagatgggacttcatctggagcttaaaggacatggaatatttgggtaggccaggggaaagaaaatgatgagaatgtatgactctatcgatctttggccattacttcctgggcaaaacacctcaaagctcacgccttgctgatggagagtagcagctgcccctgttgtcacagcaaagagggtggcacagctgataaagggtagggaactctgcccatcactctctgacctgctctaactcctttcagcacatcaagttaccctgtgccattgtcccaggttccttccgtgtagagcaagtccttccttctgctattaccttgcagcagttaagagcacacgctagttcactaattctccaagtgtggtccccaaccagcaacatgagcattactggggaacttgttagaaatgcaaatccttgacccctgccccagacctagtgactcagatagtctgggggttaggtccagcaatgtgtggtttcccagtccctccaggagattccggtgcacacatgtttgagaaccactgggctcagcagacaccctggcttcaactcctggctctgttggcactcatcaactccgtgcctcagacagatggttaatcctgctaaatctcaaaaggatataatagtagcacccatccccatggggctattgtgaagaaaaaataagttaatgcataatgcaaggcccttagcctaattaatccttgataattggtaagcactcagtgacttagtacaattatcgcctgataagatttccctttactttttttttttttttcatccaggctggaatgcagtggcacaatcatggctcactgtagcctcgacctcctgggctcaagtgattctcccacctcagcctcctgagtagctgggactacaggtatacgccaccaagcctggttaattttttgtattttttgtagagatagggtttcaccatgttgcccaggctcacttcgaactcctgggctcaagcaatccatctgcctcagcctcccaaaggggtggaattacaggtgtgagccactgggcctgactcgttttcttaccataacatggttgggaaatcttatctaaagatatgtttctcaacatatctaaagatgtatttcattgctccttctcttctccttcaccactgtcatctccaatagccccattctcaccactctttggcttactagtctttttttcaatagcataagatttaccattttaatcaatttaagtgtacagttcaatgacattaagtacattcacattgttgtgttatcgtcaccaccatcgatccccagaacttttttttttatctttccagactaaaactctgcactcattaagcagaaattcccatggccccttccccttctcatccctggaaaccagcagtcttctttctgtctgtctctgggaatttgactactctagatacttcataaaagtaaaatcatacagtatttatcctttgtgattggcttatttcattagcataatatcctcaagtttcatccatggtgtagcacaggtcagaatttttatcctttttaaggctaatattccattgcgtgcatagtacacatttgtttctccattcatctacacatggacacttggggtgcttccatcttttggctgttatgaacagtgctcctgcaaatataggagtacaaatgtctcttggactctctgcttgtaatttttttttttttttttttttttgagacagtctcactttgttgcccaggctggaatgcagtggtgtgatcttggctcattgcaacctctgcctcctgagttcaagtgattctcctgcctcagcctcctgagtagctgggattacaggtgcctgccaccataccaggctaatttttgtatttttaatagagatggggtttcactgtgttgaccaagctggtcttgaactcctgacctcaagtgatccacctgccttggcctcccaaagtgctgggattacaagtgtgagccactgcatccggcctctgcttgtaattcttttgggtttatacccagaagtcgattgctggtggtttactaatcttgatagcccccatctttaagagaagccttagtttcctgtctcctctgtcaaggtggcttagcctccactaccagagagcagtacatcctccttctgcatctaggagaatgttataggagtatcttgtattcttcaaaaacttgaaactgggtgagtaaagggccagttttcctctaaaacatacttaggcccctctaaccctagacttcatttcatcagagtaaatggtttttattgtctgtctacaaatacaaactcctcaaagagaaaactttattttctgccattccactggtgacaaggacctgagaataaaggaggattatagggcagactgtctgctatgataacttatttttcttccagttgtttccaaccaaacatacagtattattaactttgactgtggtcgtcattttggcttcaggcttaatctattttgactaggaatattgtcctcggaaacactacaatttcctgaagagactgcaaatcagcagtcttgactaaactcatacatggccgttatctttcctctgcttgaaagatgtacaaagacagtatgtcattgtgagccaggaggttttctttatttagcgtctgccttctggctcagctataaggtaaggcaattaggtacccaacatttataacagacatgtttaacttccctgatatgtcctgcagaagttaagcaaacacaaagataatagattttaactagcagttaggaagtttagacttcaaacctttgagactgtataaaatatgatggcgagacaatggacaatgtattcatttactacttaaaaccatcttgaactgaaatatttaaggtagaatcatttctacctgtgaggtccacaagaaatgtgtactaaacatcttttaatgcaagactttgatgttgagcatggtcaagaataagcaaaacaaatgtgatccctctaggaggcagtgttgtgtagtggagatatcttgattcaggttggctatgttgctgttagcctccacctcatactggttatatgaccttgagcaaattacttaagttcttcatatctcagtttcttcacctgaaaagtgtagatactattagcacaggaaggccatttcctgtcatttaagggtaactggtatctggaaattcccacattgattgattgattgagacagggtcttgctctgttacccaggctggagtacagtggtgcaatcatatcttgctgcaactcaaactcctgagtttaagggatcctcccacctcagcctcctgaatagctgggacttcaggtgagcgccatcatcccttactaattgtttcttactttttttagagacgaggtctccttatgttacccaggctggtctctaacacttggcctcaagccatcctccagtcttggcctcccaaagtgctgtgattccaggaatgagccactgcacctggcctctagggctacttaaaataaatgcaccaaaatatcatttggaaaaagtaggtgttattgggacattttcttgaaaaatgaactaaaaattacaccaattataaaactgtcttacatttaaccaaatttagtttaaaatttcaactgtacagttattctcagaaaaaaattcaacaaataaattagtttggagcaataatctattgctttggtattggattctcccttttgaagcacttgtcactgttcccatcattgttttcttcaattgttaacaggttgagtcatgtcaaatccttgtttgccattggcttgcaagtagttctagtagctctcctccatcactttcatcaacttcatgaaattctaaatgtttagcaaattgtgctttttccctttgcagtccttctgctttatattttcaatgtagagtatcatgttgtaaatatctgacaattaatgagactatggccaacaagggtgactggcccactggtcagaaaatatgatggatcaaacaggaatagacatttgaatggagactgattttaataaagggccagctcatgacaatttttactttcccaacacctattaactacagagacgtggaaaatgagtactcagatagcataaacgctccatttctcattaaattgtcaaatgccatggctcagcacagtgtcacatgagtaacatgtgtgccttagctgttaatattctcattatttatttaagaggacccacatgttcacaaaggagttgaaggcatttaaatacaaattgtatataagctaagaagaatattttccttaaatcactccacttttccatcaataaacaccatgattagagaacaaaggaatccctcactcttaaacctgcctctattccttattcccctttccccttattttgtcttatcttctctcggcaacacttattgccatctgacagactgaaagtttatatataaatacatgtgtgtgtgttttcatctttctcctgccactagaatctaaatttcagagtgcaaggatttcctttgttcatttatttgtccctagcaccaagaacaagatctggcagatggtgcgtgttcagtaagatttgttgaataaatgatgaatggaagactcctcattccagggcccaagtgcccagggaccatcacagcaattccatggctagggatcccaatgcactatgtcctgaaagagtctctgatgtgaataggaaacacaatcagtggatactgtgcaaatcctaagaagaaaagacagcacagagattccaagaagcacacggtagattgaaaggctgtgcacagttactgcaaactcagccctgatttgtggttgaactaggctccattctaattcaattcaattcagaaggaatagaagggtcttctgtggggcaaaggaagcaagttggaattctcccttccacaaagaaaaagatatgtgtttttgcatcatggtgtagtggaaagaactacctgtacagatcagaaaactggtgtgctgatctcagctctgacgtgacttgggtctgtaactcagcaaaatcacttcaagctttcagggctctacagcttcatctgtatgaccagagggtgtgactagatcagcatttcctaaagcacgatccttggaacaactggcactctagacctgcactcacaggtagtcgctagacacatttagctattgagcacttgaaatgtggccagggtcacattttaaaatataaaaactaaaacaacatacaaggaaaatttaaagtgtctcactaataatttttatgttgattaatgttggaataataatcattttgtagattgggttaaatacattattaaatttgggatagaaggggaggctgggcatgttggcggaaaggggtatatggggactgtcagtactttctattcaattttgcagaaaattgaacctagaaccaaaaaatgaagcctatttataaataaataaaatttatataaaaagttaggtttacgtgtttctttttactttttaaatgcggctactaaaacattgaaaattacatatgtagttacagatacagttggcagaatatttcaacttgacatatatttctattgctgttctataatctgaaagaagaaaaaatgtttctctaaccaaacactgtacatcatatcccccacatttcaccacccctctcccttgtcatcacgctcattattaaggtgtgaatatcgacatggatatagggtgtggaaaggtagacaatggagatttggaggggcgatgggatgggagaggggtggatgatgagagattacttaatgtgtataatacatgttatttgggtgatagatgccctagaagccttgacttcaccactatgcgatctatgcatgtcacaaaattacactcataccccataaatttatgcaaaaaaatacccaaagtgtgtttaatacacagtatggagaaacatgtttgattggcattttctagatgcatttgataatggaatctattttccactgaccatctattcatacccttcagttctgaggaagatattctggaaatgtcagatctagattctctgtaaagtctttttggagtccaataatttgtgacattaggattctaaggatgtggaaggaggccatgagtgagagtctaacatgcctgttcagatagggagagttttaaggagaaatcatgttcttcaccaacacctcacaggagaggtagcagctaactgaatgctgaaagggaagaaaattgggagaccagagcctggaatcaagggactggggaggagagccaagctcaggcccagggggtctcctaagagaagtaaacctggctctctactgtgtgggatgctgatgcttgagaaaccagcaccacaggaaatgtcaaagtcctggatagaagttggaaatggaaaacatgaagttccagcagcagcagcagtatgagcaactagagggctgcagaaatcccaccgttgaaagaactccttccatgtcagtgggtcaaacccagccagggaggctaggctgctccacacttccaccctctcacccccagggctccagagagcagatgaggagaaacccgtaaggatttatctagccagataaagcactgaagccacagcctgtggcctctgaccgagatttctacgtgagtgataggaaacctatttctgtgcctgacatttctgcctgtttccagacagggtgtcccaactcaagtgctatgtggcttaggatttctggggttccattatgaattgaagtttctctgggatgaacctcaaaaattttcctaccgtattgcttcctaacttctccttggtcctctgaaactgccaaagtcttgctttgtagaattactttctgtaagctccaagtgtgtatttattttgaattaacattgtttacagctttattgaagaataatttatatacaataaacttcaccaacttaaagtgtgaatggattttagtaaatgaaaatagtcatgccaccaccaccacaatcacattttggaacactgccataaccccgaaattgtcctcaggcccctttgcattcaactcctgtccatatccccagccccaggaaaaaaacaatctatttattgtccctttagttttgtctttttaggattttcattaaatattttgagacagccaggtgggaagggatccccagagagactccaaccggcctgctccccgggaggagtgcgcactggggtggagccttgggaagttcgtgccatttgcagggggaggagcctggcctttcttcttcctgggtggaacccgggattcaatctgtgaggcggaagcctttactagcaggactctcactctgctgagggtccctgtttgccctttttttccttttcacccaataaattccatttttctcacccttcaaagtgtctgtgggcctaatatttcatggccgtgtgacaatgacccggctcttagctgaactaaggagaaagccctacaacgatttcaggtaaatggaatcatacagtactatacatggtattttgtttttggcttctttcacttagcctggtgcctttaaaattcatccacattgttgcatcagtactctatagaggaggaaaaataatttttcctctacctttcatgagttcttaattggaacagacccttgtaacaaaaaacagattaataagagaaaaacaaacagaagattaatcacatgtataccttatgcatatgtggaagatactcagggaagagtgaataaaatcgccagagtagatctcaaaagcttgcttacacttgagactacagtcatgtaccatgtcccctgaaataaagaaagaagggtgtgggaaatgcctagttatggggaactggccaggaaaagccccataaacgaggtttagatttgttgtacagatttaagcctatgccttctccattggcaagagtgtctagtgatctaccatcctttcctcctggtacagagagggagacaatcttacaaatggagagttcctttatagatgtacatttctcttacaaaagggtaacctctactctcattttcagagcttctcctgtgtctgctgtttcccagaagaatcacctcaaataatccttatgccaaaaaagcatattttgaggtggtatattctggtctcctacagtcatattttgggggtattgtgccctgtagccccatcaactccattccttttagttgttaatatttaactgtatatcaccattttctttttatctatatatcagttgatggccattcagattgtttccagttcggtgttattatggaatgatgttatgaacattcatgtatgtctttcagtgggcatattttctcatttctcttgggtaatacctaagagtggaattactgggcggtaagtgtatgtttaacattttaagaagcttctttttttgaaacatctgtattgttttccattgccaacagcagcgtatgagatttctagttgctctatagcctcaccaacacttattattgccagtatttttaaccttagctattctagtgtgggtgtagtggtctcccattgtggttttaagttgcagttctgtaattactaatgatgctaagcattttttcatgtgattttttgacagttcatgtattttcttttgtgcattgtctattcaaatatttttctcattatattattggattgttttcttaagttgtaagagaaattaatgttatctggatacaaatcctttgttagatatatattttacaaatattttctcttaatggcttagcttttcattttctgaattgtgtcttttgacaagctaatgttttaactctttatgaagcccaatttatcaatttctcttttacagttcatgctttttgtaatctattacataagaaacttgccctaatccaaggttacgaagattttttactatatgttattctacaaggtttatagtattggctctgagatttaggtctactctctgttttgagtgaaatttgtgtatgctgtgaggaaaaggtcaaggtacctttcttaatatagagatccagttattccagtataatttattgatggctgttcttttcttaccttggcactttatcaaaactcaattgactatgttagtgtaggtctatttctggactctcaactctgctgcattaatccacatacctgtccttatgccactaccacactgtcctgattttctagcttttctagtaagtcctaaaatcagatagtataattccattaactttgttctttttaaaaattgttttgggtattctagttcctttgcagatgctgcattttaaataatgctttaatgattgggaaatatagcatatctaatactatacccattttatttatttatttatttattattttttttttgagacaaaatgtcactctgttgcccaggctggagtacagtggcaccatcttggctcaccgcagcctctgcctcctggatttaagcaattctcctacctcagcctcccgagtagctgggattataggcatgcaccaccatgcttggctaatttttgtatttttagtagagatgaggttttactatgttggcccaggctggtcttgaactcctgacctcagatgatcagcctgcctcggcctcccaaagtgcagggattacaggcgtgggccaccacacccagccatgcccattttatagacaaggaagccacagacttatagacaaatatctgacttcacatcacaagtctgagtttctgtctttttgtggtcacgtctcattttcctactggactgccagtaaggatcctatgacagcagaaactatgtaggttttcttcacttctgaatcccaggtaaagtagcttttatagtaggttttcaacaaatacttcttgaacaaaagaaggaatcaggcccaagagaaattcaatgacttgtgtctggtactaaggtcagtagcagaactgaatccagaacttgagtttccaaacccttcatttagtactttttctatcatgcaatgtgagtggaggagatagagaagaaatgcaaagaagaaaaaacaaagcaaatgatgttggtgtagataagagcattattagaaagtttgataaatgcttttgttttgatacatctcagcctatagcctgcagctgccagccactaaacacttagatgtttatgttttgcttgaaatactttttaacatgcagagggatatccagatgattcacagatcccagaccacagcctaaacaggaggcaacatttccttcctgagcatggttctaggaaaataaagaacaggtgcatgaggccagaatgagtctctggggctcacagcagacagaccccagctgaactcttctggactgacaatgcttccaatgaggaaagatcttcagggagcaatgtttggcaatgattttctccctacaatctaattataaagtaatttcaatcaaatatatacaaacatatatatatatatgtatatatcttgtgctatagttcttctttttttaaacctggaaaaccaggtgccagaaaaaataataacacggtgttaatctgagaaggaaagtaactggaaaagaggataaggaacgtacaacaatcagacagtggaggtggctccgactccacaacctctaattcatgtgacatgtaatcttcttaaacaatgattatagatactaactgtgtatttgaaggggatggaattgtcattaagtgctatgcaatatcctgtcaaccaaattctcccttcaggtaaacacatgtcgcttctgttgaaattagtaggtgtcacaggtaaccgggaggcaagtttggttctggaaccttacaaggcactgtgaagactttgatttacaagcgattattaaggaagatttccaccagaagtagtcatccataggggagaaattaagtatctttatttcaatagagtcaagaaacattcgctgatggtagactttgttcagagcaagatgctgagtgttgctgcgacaatccaagaagaaacacggacagccctgccccaacttgctcccaaatctgcaggtgaaaggcagaccatctcttgtgtctgcctcattccctcagttctcagcttaaatgtcactttccctggatgacattcgatttgcccagtaagatgcagcatatttgtaattacttatttaaggcttgttttcctctttacctccaagaagaaagggaccacgcccatcttatgttggcaggctgtggatgtcttgagaagaacacaggttctagagccagcagcctgtgttcatatttcagcttcaccacttatctcagtatgatcttgggcaaatcacataacttctctaagctttggtatcctcatctgccagacagaaataataattctctagtacttatctcatagcactgctctgagctatgattaaatgaggtaaagccactaagtggcctggcatgtattaagcccccaataacaatgaaataaaatgtcagcagataaatgaagttcatccctttagtgaataaaaaaaagacaatggttgccattctctggttattataatgatgatacaacaacaataattcttattgaatgcttactatgggccaggcactgtaataaatgctttacatatagtcagtgaatttaggacatgtggatatcaagccatcgatgacaacccggccttttaaactcttctctctgggcatatcagcatttattagggaagcaggaccatcagaagagccagtgttggtggcatacgaatgtctgtgttagtcaatgtcttggaaggaactgaatgacatgctcaaagggttaattgaggaggatgaaatgaaagaactgtgtcaaggatttgggcacggttaaggaaaacaataagcatcaaggaatacctagggactagcagcatttgggctgttacttcccctaagcttgaatggataagaaagagaaatggtgtttccagggtgcagtgagatctatagtcaagggaggggagctgccctgcagatgcagtagtgggagatagaggatcccagccatgccaaaaccatggtgaggcagggagcatccagagaatgctcagagcactctcctcctgcttgcttcatctcctgttgctacctctccatggccaaactgtgctagaagccagacagtgatggagccaaggtgatgcagcccataattatctcctcctgaagcagagaatcaaacagagaagggctgagaatgaatctatttagaagagcaaacagaataacctgcacaaaaccactgaccatcacatctagtcaaacttgagtaaattcatgttgactacatgaagaacattacagggaagtgaggaatctcaacagttaagccaagcaagactgtcagagcttaaaaagttaaaaagaggttggggatctggttctcagtctctttctgggctaccttatagcaatttgaggctccgtcatcagtttctgcaaggtttcaaagatccaggagaagcttagtgttgtgtcaagatgctgatggacccatcacagaagtttaatccaacctccatcccagagtcttcacaaatgctcaccaaagaaaattcccaggacgattcaggggcctctcaaatctgctccgagacgttgacaaaaaaccttaataacttgactgtcaatgctagtaacgaatccccttcccctctaccggaatgttcactccatgaacagtctacaagagcaacaatcctcagggaaatcacagatcacttgctttacaggaggagaggagtaagaacattgctgtctgtgcagagagagaggatggcaagattcagatacatgttactcggcggagttcatccgcatgaaagaatactaacaaacactgggcttaagggagttaagaaggaatcaagaccattcagatgtccctgcagtttctgcttgtttaacagatgggatccttctgagaatgctagaatagggaattttgacaccaagccacttcagccataaaccttattcttgtacctttttttcttgctggtaattttatatagcagattgagaaagctactctatgctactatagactatacaccaatacttttgataatgagttctaggatgtatttttcttcttgtatctttttcttcccgctatgatactagtaatttataagggatctgtgtaatttgaatgtatttgaataactttagctctactgtttgatttgacccaaagaagccaagacgacataagtattcccatgtgtcttagaagcccaaagtcaatgagatgaaacccaacatcaagaaattgaagcaaagttacttgtggataaagaaagcattaggtagtttggctatagcataataattagattttctggctttcaaaattttggattgcaatcacagcaaactttgttatttttacagttttcagtacaaaaaggagtttatatagaaacagtaaagttggcatttgagtacctttaaaaaacaaagttaaaaagaaagacaagcttttatttcctgctacaactactgaagatgcaaaaaaggtaagggccattagttagcaaccagtgtctattattcctctttctgctgtcattgttgaaagatgaaagttcatgcaagcaggctccattcttgcacatgacctaattatcatatttagttgaatgtaaaaaccctagttttgctgatgaatctgaaacatcacagccaatcactttgccttcccattttcctgtctaacatcaactgattaagattgggagtatcttctgtttgttaaatgaagcacaattcttctggatgatatctttatattttatttttttgttgtgataaaatatataatacctaaaatgtacctttttaaccatttttaagtttacaattcagtggcattaagtactttcacattgttctgcaaccatcaccactatctatcttcagaactttgtcaacatcacaaaaagaaactccctatctattaaacaatatgtcccatttcccttccccccagaccctgacaatcaccattctactttctgcttctgtgactttgcctattttaagtacctcacatgaatggaatcgtatagtatttgtccttttgtgactggcttatttcatttagcacaatgtcatcaaggttcacgcatgtcatagcgtgtatctgaattaccttccttttttaagacggaataatattccacattatatgtacataccatatttcatttatccattcatctgtcaatggacacttggcatgcttccaccccttggctagtctgaatagtgctgttctgaacatggctttgcaaatatctgttctagccctcattttcaattcctttggtcatctacccagatgtgggattgctggatcatatggtaattatatgttttagtttttgagaacacgccataccattttccatagcagctgcagcattcccacagcaatgcacaaaggttccaatttctctacatcctcactaatgttgcagaactttatccttagttcagctaaaaccaggctctttcacacgaccaggaaagattatgcttgcggacatatacaagagtaaggaaaacggaatttattgggcaaaaaggaaaaaggcaaaataattcttagcaaagagagagagagtcctgctagcagatttactgcctcacagattgaatcccaggtcaccacacaggaacaggagaggccaggctcctccccactgcaaacgccatgaatttcccgaggctccaccccgtcctcccagtgtgcaggtgggcattattcagaaagaatcagtcaggaaatggcaggcttcatccagaaccagcagtctggtttttcagccttcaggctgctttaggctcaagggcggggttttgccaggggacttttggctgcctcctgtctctatcactaacacatatttactgtttctattttattttattttatttttttgaagacagtcttactctgttgcccaggttggagtgcagtagcacaattatggcttactgcagcctcagccttctgggctcaagcaattctcccacctcagcctcccaagtagctgggactacaagtgtgcaccaccacactcagctaatttaaaattttttttctagagacagggtctcactatgttgctcagactggttttgaacccctgggctcgtgagccccctgcctctgcctcccagagtgctgagattataggtgtgacccagcatgtctggatttttaaaaaaataataataatagtcatcataatgggtataaggtggtatttccttatggctttgatttgcatttccctagtaattagtgatgttgagcatgtttaaatgtacttattggtcatttgcatatcttctttggataaatgtttgtttagatcttttgtccatttttaaattaggttatttgttttgttgttgttgaggtgtaagagttctttatatattctgggtattaatctcctataatatttataatttgcaaatattttttcttattctgtggatggccttcctactctgtggataatgccttttatgcacagaagtttttaattttaatggagtccaatctatgtattttttctggaagatttatctgattttattttaagacagagacctcagctcactgcaacctccgcctcccaggttccagcgattctcctgcctcagcctcccgagtagctgggattacaggcatgtaccaccacgcccagctaatttttgtatttttagtagagacggggtttcaccatgttggccaggctggtcttgaactcctgatctcaagtgatctgcctgcctcagccttccaaagtgctgggattacaggcgtgagccaccatgcccggccaaagatatcttttaatgtaggctttgcacggctaaaatttttgaagagcaaggctcagattggatgtggttttggttgtggtggatttttattctattcaatttacagcagagcaaaaagaataaaggcttaggtttcataactcacaaaagtacactaactgattcatatactttggatgattccatcatatgtccagcactgaaatttttcctcatggcaattgagggatacaggtctccctgcctcctctccagtctattggatgctctagcaccttgccgggaggcaccagaagggagtcagatgaaagttactctttcacttgtaggtcacagtgtattagtctgttcttgcatttctataaagaaatacctgaggctgggtaatttataaagaaaagaggtttaattggctcatgtctcctcaggctgtacaggaagcatggatgcatctgtttctggggaggcctcagggagcttttattcatggtggaagggaaagcaggagtagacatcttacatggaaggggcgagagacagggagagagagagaaaagagagatagagacggggggtgtgtcagacacttttaaacaaccagatctcatgaaaactcactattgggatgacagcaggaagcgggatggtgttaaaccatgagtaaccacccccatgatgcaatcaccttccaccaggccccacctccagcattgggaattacatttcagcatgagatttgggcagggacacaaatccaaaccatatcacacagtaacccaactcattttcttaagcaaagacaaacttaaaaatgcggaaaacatttaaattctgctcagaattaattagctcctataactgaaagagagagcggtatcctggcttcaggtatgggtggctccaggtttgcaaacaatgtcccagctctgctcttcttgggtaggcaccatttttagttagtacttctcttttttttttttttttttttttttttgagacagagtctctctctgtcacctaggctggggtgcagtggcgtgatcgcagctcactgcaagctccgcctcccaggttcacgccattctcctgcctcagcctcccgagtagctgggactacaggcgcgtgccaccatgcccggctaattttttgtgttttttagtagagacggggtttcaccgtgttagcgaggatggtctcgatctcctgacttcgtgatccacccaccttggcctcccaaagtgctgggattacaggcgtgagccaccgcacctggacagtacttctctttatgataacaaaatgatgcctgttggctcttaaattatttcttaccttctcagcagctccaagcagaaaataagttctcttttccttatagttctaagaaagtccttgtgtgatcttttatcttaaaactgactacactgttggccccacggatgagtaaacatcggtgggtcagctgaagtgctttctttgttggggagacacgttctctgatgaacaactatggtcaatattgacacctgttacactatgaatgtatttcttcccatcattaacttgcttcagctcttacatggaggaaatactcatactgatggtacactattcagggctgcatgaagatgcccctgctcccaagatgcgagggaccagtgggctaagagcagcagaaagaaaaatccatagatatattttgttttggaaaccaacatttaggcgtacatcactgcctcatgtagtatttcaaagtaaatagaatcagttcactaatcacccaattctgcttgtttttaaaaaatataaacaccagctagactgaagacttgaataggactgagtgtatgtgcatataacataaggagaaaagctgtgagtataagaaaaacgcctatcttattttctgacacctgtccaaacaagcagaggaaggtgaagacagaagaccatttcggcatattaaatatgagaaagaaataaaaatactctggggcctgtgagccagtgatctatcctctgacataactgttatttctataaagtacaattttgaagctccttgacagctgaaagttgaaaaattacttgtttatctttttcactcctccttaaatgccaagtttacattttactcttcgtaccactatgttactttctacctattctgcaggcagtcaatttaaaatatgatgtatttggctgggtgcagtggctcacacctgtaatcccagcactttgggaggctaaggtgggcggatcacccaaggtcaggattagagactagcctggccaacagggtgaaaccccatttctactaaaaatacaaaaattagctgggcatggtggcaggcacctgtaatcccgactacttgggaggctgaggctggagaatcacttgaacccaggagacagaggttgtagtgagccaagatcgtaccactgcactccagcttgggtgacagagcaagatcatgtctcaaaataataataataataataatgaaaagatttatttgcctccttatgaaagaaaattttaaaataaaataaaatgtaacatattcccaccccaggacctttgtacttcttgttcccgccacctggaacactctttccctagagagctatatagctcactcctccacttcattcaggtctctgttcagtcgccacctcattataggggcttttccaatcaccctatctaaaatagtctcctccaaccccatcactctctctctaccttttcttacaacactcattcctacctgatattttatacattaacttatttttatctgttgtccccaatagactgtaagtactacaagggcaaagacattgctttgtacccaggcactgctttatctccagcacacagaacactgccttgtacatagtaagtgttcaatgtatagtatacagtgaatatatctcaatctttttttcattgctacagacaagacagcattgttcccatgcaagggcacactcccacagggataaacacatcatggcaaagcttaaaattaattttctggcagtacaaccaatggtggattttgttttagttggaaattgggggtggaactcaaaagcattttacaattatgtcaatgataaagatcacttatttaaagatcccaaagctcttataagggaaaaaatagaattatgtcttacaagacaacacagcaaatcaaatttaaaacttttaaatatatattttatatatatatactttttttttttttttgagatggagtctcgctgtgtcgcgcaggctagaatgcaatgatgcgatcttggctcactacagcctccgcctcccaggttcaagtgattctcctgcctcagcctcctgagtagctgggactacaggcgcctgccaccacgcctggctaacttttgtattttcagtagagacggggtttcaccatgttggccaggctggtcttgaactcctgacctcaggtgatccacccacctcgggcctcccaaagtgctgggattacaggcatgagccaccgccccaggctcgcattttttaatttattcattcagtgcccatcacatggatcctgtcaaccttcagtggaccatgggcatacactttgggaaacgctgccgtaaaacaaatacctgattaagtattcattttagttcccagtatgtgcctgatacagttcactgcttatgaaaggaatataaaaatatgaacaggcctttgaggagcttataaccgagtagatactcaataaatatttagagagatcaaattttagagatcaaagcaatgtatatgtctagtatcattagaaagaatgaaaacactggccgggtgtggtgactcatgtctgtattcctagcactttgggaggctgaggcgggtggattgcttgagctcagtagtttgagaccagcctaggcaacatggtaaaactctgttaaaaaaaaaaaaagaaagaacaaaaggaagaaaggaaggaaaggagagagggagggagggagggagggaaggagaggggaggggagagcaggaagggatggagggagggagaaaaggaaggacggaaggaaggaaaacacctttgtccagtgttgagaataaatgcaatacttccaactctgtggtctcaagatttgttttgctgtatctaatgcggatgacctttatcagcaagacacccattaacacatagaagataagttgcagtgtgaatagtgccttgagactgtggcaataaaactggagccacgcctgagtttgcagtttatttggccgcacgtggccatggaaagtgagcatgaaccatcattgtatgatatactcaaggctcaggaatatgtatacaggttattaagtcaaagtagctgtaaaacactgcacgagagttgattcagtctgttaaatattttacacctcttacaaaaatatctacccaaaaagaaaattagatacagtgaataattcacaacataaatgctcttgtgtgggcaggagttgggtggtatttgtttttatgaggtgaaatctgcagttataacatagacttcttcctagaatggcaaccaggattctaaactggcaacaggcagctgcaggcctgatgtgaatttacaggttgcctagtagtgctactgaaaaatagattgtgtggtaggaggttttctcataacttttttctttgtcattgcttttcttcttcttttccctgtgcaggctgtaaacagattgtaaaatgtgtgacaccccagaatctgagaaaaaatacaaagctacttttagtatccttcaccatagcctacaagttctttccttcctcccttcctcccttcccccaccctccctccctcctccctcccttccttctttcctgccttccttccttccctccttcctttttttgagacagggtcttgctatgttgcccaggctgttctcaaactcctggacccaagtgatcctccagccctagccgcccaaagtgctaggattacaggcgtgagccaccagcaccaggctgctcttgcttttctacccaaaactgctggacatgtgcacttgatacctatgacttcatctactttcagacagccatgaggggtaggagctagggaatgaaggtggggcccgatgaatgagtatatcaatcatgtttttaattttagatatcttttggtatttcaacattttggggaatttacagaccccagaagagaccacccctcccggggctatctaattcctaaggataataacttgcctataagcatgcctttcacacacaaaccaaccaaactcaagcccatattcaccaaccacctccttatctatctctcacacactagccaatatttcccctgagctaaattatctcagggccaggtattaggcaaccacagaccacctagataaaccaaagcctgctgggattattcaaactaggcaaagctgaactgtttgccctgccttacctttcctgcagaaacaaggctctagcctaagtgttcccctcgctcctttgtcccttctgacagaatctgcatgatgtggcgtttctcctctcagaagagcaagtaataaattctactttcaatagcatcggcctctccttgtcgtcactcagtccgtacctccataagttaaaatctcacagatgcaaatggagaaaatggacttttgtagccatttttaggaacaaggcagcttggcttcaaatcttgctcagagacaaactactttccccaaggcatcatcagtgaccgtaacacacacctagtcacctagtgtaggatgggagccaggcattctctctgcatggcttcctacttcccacgtgacataaggttgcatggccatgcgcactcctgtgttgactttctacagcaacattaaggtccagaaaatttgtgtggcctcctgaagaaagtaggaatgcagatctgtagagggagtgtaaaggtggagccctgctcttccgattctcacacagagccactggaacaattataacgagcatggctgtaaacatttatttactgagtgcctctctctctgcttcatgttttacatgcatcgtctcactaaacccttgcaacaaggccattaggtaagtcctattattatcccattttagaaatgggaatttagtgttaaagacactggtcatatagctggtaactggcatcttgggacttgacagactaactctaaattcatagcccacactctaaatccctactctatatcatctgtccaagctgaatgaggctacctctccctcatgagacagaattcaagagtccagttccctttgtgaatgaaacatcagtctgaaaaccttaactcctagttgggcacctttaattggctgatggatggtaccatgtctccttccaaaccaaacatatttttggtaggttttcagaagcaagatcagctccaggcaacactgtgaaataggcaaccctcttggtttctggtgactgaaaccaagtgccctcactacctctgcagatgacccagatcactctactcccaataccgtcttctgtggtctgtgccttaggccccaaattcattctctgccttcctaaacttatcagaattctcattccacttttttgaaatccattaagggctctggattcaaatgaacctggtttctaattccagttgtacagcttttagctgtatcaccttgagacccaatttccttatttgtaacactgtcacaataacatagactttctcagttttttttaataagaataaaatgtggcatatccagtgtgttgtctcaagatcaattcttaacacatggtgctccataacgatagttcagccatgaggaatatttccccaattttcatatatgctatttaaacaaaaagtaataacactggcttccagaaccacaaaagtcagactctttccattgtagacatacatcacaaatacgtcttgatagaccaaccaggaaagtaagcactgacctagcacatttgctgggaattcaagtgatatggtttggctgtgtcctcgcccaaatttcatcttgaactgtagctcccataattcccatgtgtcatgggagggacccagtgggaggtaattgaatcatgggggcaggtctttcccatgctgttctcgtgatagtgaataagtctcatgagatcggatggttttataaaggcgagttcccctgcacacactgtcttgcctgccaccatgtaagatatgcctttgctcctacttcaccttctgccatgactgtgaggcctccccagccatgtggaactgtgagtcccttaaacctctttcctttataaattacccagtcttgggtatggctttattagcagtgtgagaacagactaatacacataggaagttctgttaaaactagacagtagaataaatgaaaattaagcaattaatctaataagagatgtaagagaatgcagtctactttacaattttgtcaaatgtttggagctctcatgtcataaaattctaaaaggagaattttgtaaaaaattcgtcacggaaaaagcactaaatcaagcatcataagacaagcatcctcatcactgctctgccacttattggccatatgaccttgtatatatcacttgacctctatggatgtcaatttccttctctgtaaaatgagaatgttggaccagataatcccaagatcttttccagttgtaccactctttgagtcaatgactccgccattatccctccccttgttctctggagattttgttgccaaaataattagtgttgcccccgagtaacatcacgtagcaaagtccagtcacgcacaggaattctaggcactgtgactgcgaattctaatccctctttggtcatgccatcattgaatgaccttgggcaggcacctaacttcagctaactgcctcaccagccctccagggatttgcccgataaatttccaactccttactctccacaagctgccctccaaaatgcctttacaatgcttaacttgggaccacccatgacaaatcatgaaattaggctttttctctgaataattctcaatcatagtatgtttctgcctcaaacataaaagccttcttttcttcctgttaaaatcataaccgtctttcaagggaggtgaaatacaagtgaaaacttaaaaggctgaaaaatttgtcaaatctatggcaaactcaagtctgggtagaagaactgatacacattgtataatagaaccaccatgatttcattaggctagaacaaagggtggaaactaaggagaaatacaagccctcagcaggtatttttgagcagatgtgtcttataataggattggcactacagtctctgacctaaatttaatggaaaataagtccaatatttctattaataataataatataatagctgtcatttgttatgcaaatattgacttaggcattctgataagggatttacatgctgtacctattagaatgctttcagctgcaagtaagagtacctaactataaggggcttggtggtttcctgtctcacattggctgaggaggagttggtcccagggttggctaattgagcagcatgacaccagggagcatccatcctccaactctgctattttccatgtgtgggtaatatcaccccttgtggttgcacaatggctgcaatgattccaggtgccacacagatatttcaacatctaccaaagcacacctcccacatatctctttttattgtttaggaaaactgtacccaaaaacttcctacaaatttcccctgacatctcattgtccaggattaaatcacattacccatacctaaaccaatcaacgacaaaggaaatgggactgccaatatcatcttagatcaatcatgattcacctctggttcaccttccttgaacatatggtatggtgaccaccctacccaaacaaaactgagccccactggcaaagaaggggagggtgagctgggaattggcagttgggtagataacagtgtccactacacacaaattattatttcaacaaataccctctgaggaattattatcttcattttgtagatgaggaaattgaaactcagagaagtcaagtaaattgcccatggtcacacagctagaagttgagaaattctgtgttcttaaccaccatattgatagttctgaagtttcagtgtatgcaagaaacattagagagtttagtacaaacatagattctcaactcaactccacacccagggattctgattcaacagtctaggagaggagccctcagtcttcattttcaacaaataatttcagttaatttggatacaggtggtgtatgaaccacattttgagagaataggattggctattacttggacagaagtccgacttaaaacaaaaacaaggccaggcatggtggctcatgcctgtaatcccagcactttgggaggccaaggcaggcagatcatgaagtcaggagatcgagaccatcctggccaacatggtgaaaccccgtctctactaaaaatacaaaaattagttgggtatggtggcgcgcgcctgtagtcccagccactcgggaggctgaggcaggagaatggcgtgaacgtgggaggtggaggttgtggtgagccaccgcacagtctgaacaacagagtgagactctgtctcaaaaaaaaaaaaaaaaaagagcaaaaaagccccctgattttctggaagtcccagactcactatctacaaaagccatccatcgtttttaagtaccaccacagaaacatctcatcccagtccctctatagtccgtacaggtcagcccctatatagtgtcaagatcttgctccctaatttaagaaggttatagataaaactttcagatgaggggaatgagctccatgagagatctaacaggtcatctaagtaaccattgaagaatgtgggaagatttacggttgaggacagtcaactcttgtgggtagggatgagagaaagccatcatcaccctttaaatattgtctaggatattacgtgtaaaggacactcagaggtaggatcaatgataagaaattatgaggcagctcattttgttttactatgtgggagaacagactaataattaacttggtcaacaatggtaaaggctctccacctcacaaaacactccgaatgcattccagcagaggctggcagaccctgtgcctgtcaccaatgctgtagaagggagtcctccattgaaaggaagcattgtgcagatgacttctaaaatatgctgtgatccttcaaccacatcctctgcaaactgacttgtattcttttttcactatagtcatttctgctgaatacctaggggtaccatttaatttcgaatgcattaatgtcctattttcccaaattgatagaatatgtctgactcttctttgtgtcttcatggtacctagctcaaaaccatgctcatcataggtacttaataaattgttggtaaatgtaaaaggatggcgtagaatggcgggtaagcacatccagatgatgggtagaagataactgttagtacttctgccctgtttaccaccattcttccctctctggacaaggggcatggaggctatatttgcaatatgcaccctcctcgctggccattattgattgggtcagaaattaacatgtgaggcaagctagggccataagactgacactaagatattaagacaatcttttaaggtggctataattgtaacatgtgagctaaaaagcatgatctactgaaaaagaatgaggcagatgacagacaaagactgagctccctggctttccatctcctgggtccccatcccttcctgaggctcatgtataagtgcgcctttggtctctgagatgaacccctctgtctttgtaaaattcttcctccctccttccctttcttcttttcttgttttagattttattgaagttggttttagttcatctcaatcagaatatttaatccaaagaaatttgttcctgagtttgctgttgaggccactgatgcaaataactcatgctcttagaattccaagaaaatccaggatttgggggaccccagtgactacagagcatttagacctttgcatgttaccagatattttagaaggttcgagactggttctactgcaggctgattttcttaccactccaaaccctaacctgcaggggcatcaaagctcttatgaaggctccaccatcagaccacaggtctccttataacgaagatcccatcccctgcagaagaaattttgaggtaggaactaacctctagcgcaatgaggcaaggccagcccaaataacagatgggaatatttagaggtatctagaactccgttatgctacaaagtgtttctccgtacaacatcttgggtctacataaggcagtatccctgtaagatgcaaatcgtctttcaaaaccacatttatcagtgagtagtcagtcacatgaacctttgtacttcagttttgtggcaaaactgtttcccaagatgcctgtgtttttcttaatctgtgccccatgctgttaagcagagcatgtggcctgtcactttgacatacttaaacaggctgtgaacaaatccagctgatgcttttccaaaacccatttcaatcttggctgcaagggcatccctggctgtgaggggtaggtagaaacagatagtccaggagtaggcaaggagatcattgagaaatccatgtttttccctcctgcaattaggatatctcttatgttggctaaagatggcaaatcattaatacatgggagataagaaagaaccaatcctttcccctttcattcttattccttagagttctgatgatcatactttgcctaggacattcggaggcccctgccatagtcctttcatcagcccttactgctttttgatccttttgtttttccccaggcataactgccccttgtgctgagttcccttaggaaaggaatcacgtttcaacaaggtcctcacattgtagaatgaaatctctctgactcattgtataaatatgcaaaaccctaaattctcttaattaaaaaagtagaaccagggaagccaactcaacttcttgctctgaatctgaacagaagtgctgtttggtgaaagcaactcctcagatgtgtgaccagttcggcatccacagacagtaatgaggaataactttaataaccaatattctataaggatagggactgtcatcagaagagacatcaataatcttctcttggcaaatgaacaaacaaaaatcactcccattttttcactgatgcttgaaatttctttaacaggaattaaatatttctggagaggctatatgtaattttggctaaaagtttaggtatttacttgttattgcaactaggcaataagtatcaaaatttttcaaaatatgcatacctttcgacctcacaattccacttccagaaatttatttctagtaaataatctgaaagttgtacaaaaaagtctgtacgtgaagcttcattatagctttttaaaaacttcttataatgcaaatttcaaacatacgcaaaattaaagaggataatatgatgaaccactgtgtatgtaccacccagctttatcagttatccacattttacccagctcctgttttatttattctccaccattctttttcattgctatttttgctggaatgttttaaatgcaattccagccatctggcattagtcttttaaatattttagttgtaatatttttaaaataagaatttttttggatcttattattacctggtatctttctttcaccatccaagttagcaataatttctgaatatcctccaatacacattcatgtgcaattgcagaatgtcaaaaatgtctttttacaatttgtttaaatctggatccaaaaattttcacaggttggatttagttgatagttctcttaagtctctgtaacctatgacattgtctccactttttattatgccatttatttgttgaaaaattaaggtcattttgtcctgtagaatttctcatattctggatttggtcaattgtctccctcttgtatcatttaatcattttttttccccctgtaaactggcaattagagcctgaggctcaattgaatccaggttctctttctttcttttttgggtaagaatactttgtagatggctctgtgtacttcgtattacatcacatcaataggcacatcaggctgttcatcccatttttagtggtgtgtacatcaattagcagattcaagtgctctcagcctaatccctccattatatactttttcatcaatttttcgcctaatggttttagcagttattgatgttcattgcctagatccattatctcgttagagattttaaagtgttgatgttgtaattttttaataccatattgttacattagctcttccttctgtaatgaagcttttgaaccccagctttttattttttaagaaaatgtcagttatcaaatagtaaacacctataaccttcacctagattcaccagttgctaacattttgctacatttgctttatcactctcgttatttatacttattttttgctgtttcattcaaattagtttacagacattatggcaagctttaaatatttcagcttgtgtcttctaataacgatgacattctcctcataaccatagttccacactcaataaatttagcattgattcaatattatctaataaagattttttaattgccaattgtcaccaaaatgatcatatatgtatgtgtgtgtgtatatatatatatatatatatatatatatatatatatatatatatacttttaaaatccagaatccttcaaaggtacatgtgctacagtggtatcatgtccagtaattttctacttccatcttctttctacatttattagttggcattcttttgtaaagaagagctttctcttttcctccattgccatcattattttttagatgctcatattgactcaaatttgtccaatgcgagcaaccataacctggttactgcatcattttgacccagtcccattggtctttgagcatttccttattttctggcacacgtgattctaggctcaccttacactttcccagtctcacacctagaatcagcagtttctccaaacttccctggttcttttcaatgaaaagtgctgtttagaaaccaagatttggctgctagatatgcttctagatatgctcattgtttctagaccctgtcagtgcacagagctaagaaatatatctttcaagaaacgtgagttcatactgatacctcttattcaaatcctatatcatagagaaatcttcctccattctccctttttatattttatcttctcccacagtaagaaccctcatttccaaaaaaattaagtgttttattgtttgctatatgctttaaaatgcacaaaatattcttagtattacttagcaatagtattgtaccaccacaaaaaacaagtaaaattaaatatttctttaaagttccttctcttcataaaatatattttattaaggtgtattaaaaatttatttgaggctggggatggtgtctcatgcctgtaatctcagcactttgggaggccaaggcaggcagatcacttgagcccaggaatccaaaaccagtctggccaacacaccaaaaccccatctctactaaaaatacaaaaattagctgggcatggtgatgcatgcctgtaaccccagctactcaggaggctgaggtgggaagatggcttgaacctgggaggcagaggttgcagttatctaagattgaaccactgcactccggcctgggcaacaaagagagactctgtctcaaaaaaaaaaaaaattttgaattaattctgctttctatgtaggaatacttgctgtagagttggatatatagttaagttcatttgtttctctttatattcaatttcagtgttgcccttttcattcttttgatttaattttattttttgaacatgtataatttttacatggttcaaaagtcaaaactacaagaaggaaaactctaaaaaataacaaccctattcctatcctttatattctattattgtccccaagcctctttggtgtctagttttatgaattcatagattatttttgatatgtttatgcttgcaaatataatcaaatatttcttcttttttattactgttatatatattttgctatttaaaaagatttatatttttaacacagtggttacctttttactaatatttaattttttaagggtcataatccctttttcttacatagacttctacaattggtttgtacctttaaatgatatcttctgtctgccacatactacctacatatcaatcaatagtcttattttacttcctcctttccctttctcttcttcaatgttttcagttgtattatctctaatgtatcagaatgtataatatatacatatttttctttcacctctgttcccatctttgtttaagtcttagagctacaattaaatataatcagcactcaccatcagtgctttgctgatatctcatcatttcctggtgggatacatttattgtctagtagatttctcaggatggaatcatgattatgtgtattctcactcttgtatgtttacagctatttgcctatagccttgatatttgaaggtcaactgggctagataacacagacttgtttttaaaagtgggaattgaaacaattcaaggaatcaacaaagattggtaatataaataaataatggtcagttaaataatggaatcctgtccattcaaccattatacatactataaacagtgtggaaaaatagaaaatgatacataaacttgcaatggtcaaatttgtgcatatgaagtataaggatgctacaaatgtgtgtgcacatgtatttagtaaaaagagggttggatatacatgaaaaagttaacagtaattttctctggttagtagaattattggtggtctttagcttctttgtgtgcttttctgtattttttaagttgtagcatttgtgggattggagagaatacaatttttttgaagagcaagacaaagatctaaagttttcaaggtttatttttaatgtgctttctttaatcaataccacaagatagggtgtaccaaggaaaaagcagtgtgatctaattagcaagctcaggacagcataagctggcctcagtgccctgcctgcgctaggcactcaatcagttggtgctcgtgatgatgaaaactaaaatgagtccgttccaagcaagaaccttttggggagtagagttaacttttctgagtcaagctcctgcctccaggtttgcaccgaggatgaaatgaagtagtattatatatctgtaaaacccctgtcacttcatccaggcagagaagatagattgttagtaccttattctcaaaactaacagaaatgtgttcagttttacttgttctgaagaatataaaaacaatatggatgaatggccagtaaaaggagccagaagcagcctatgagagtgttctagaaaaacatgaaggggacaagaaaaagatacgagggatagatggataaggagggagaaagagatagagagaggacaagataaagtttagagcctatcattagaatatgtaatacttgggactttgccttccgtttaagtaaaatggaggaaatctgtgcccttacatcctgactgtgctgtcgttatgataaaaagaagtaaatggagtgcagggtacactatacacctgcttctttaagtaatccttgccaggtaactaatcgctgggattccaaaggttgttcttccagtgggggtgaccgtgaactgtaccccagagcaactgaatcagaatttgaatgggaaatgtcagccatagaatttgtttaaaacatctcttccaatgattacgatgactagcctggtttaagaactgctggcccatacatagggctaccatctatcccctctgctgggacagtcccagagcaagtattactagcagccctttctcttacaaaaatctctctgcagggtatatattatgcagtttcctatctgtaccttgcctccgctattggcattctcagtgaaggtgcatagggatagccttgtaccattactttcagtccagaactgaacacaagacgtagagaaaaattaccccacgaaattaaatttgcatcaaagtgtagaccaaagtcagatcttccctgagagtggaatctgatgtatacagaaaacaaaggcataactttaagtgggggagagagaatgggaaacccgagacatctccaagacaattgcttctgctacttcaccatttggctcaagccaattgagagagccagaaatgaacataggtttggttttatctgctggttatttaagaacttttgcttgtttcttctttacctcttccccagtttctggaagagtcaaaataagataatcatttggcagtgatataacattgctcttcaactgctgagaaaccaatcaatattccccatctagctaatgtgtcattcaatattgagtgttaccttgttctagtttaatcctgatctgttacctctaaaataaggacatgcaaagataaagataaaaacttgggcactctcaaaaatattcatgttataaatatgtaagggaaaatatttcaggtcatagtcctcagtacatgccaatacattcttggggtacccactttcctgcagcaccagaaactttggcttcctcctatgctctggacattttcattcttcctctttttgctcatcctcttcctgtatcccatattatgggccttttccatggaaagccttttcaattaattcacttttaaattcatattcatgttaccaagtttacaaattttaaaacatggttttcattactttcaattcaaactatgactctatctacaaagccagtaaaacaagaagatcaccttcaaaatttctctgacaagtttctagaaactccagtcgacagactaaactgcttaaagaatcaatctcaggtacaaatttaatcaattaaatagtcttaattttaaactgcatttgtaagtgtaacatgttcagattcatttttacgtgcttcaaatgcttgacaggatgaagttataaccataacaagcaaaaacctccctagcatttaaagatctcttgttgcaactctgatcaaataaacttaaaaatataaattgaattatcttaactattccagttctatttacaaacttatctttataaacattcaccttacaaatcccaagattaaaatgttacagattttatattgctatcataaagataactttttagggtcagaacgtgttggattcttttgcaatagcaaacatactggcccttttagagcagcttaatttgggcagatggaattcagcaacccctagcctaggctggattcaactaatctctttaccgcctgattgaattcttcattcctttcatattctttttgtccagctccatccacaaaagcccccatctgtctaaaaacgatcagcctttctttgacccaaaatttcatcaaatcatagtcctttcttcacgttgtgtctgaaaatccctttgaaatgcacatatactatcttggatggagactgcatcatggctttaattctcataacaccatcaacaccacacacacattggtttcacttactcaacaagaggctcaatgaggtaacagactattatgaaatgaatttcaatgtcttctaaaaacttttttttgttgttgatatttgtttaaaacacactgtggaaagaacacaggcctttttgtaagcaatttttgaaaggcttgtctcctaggcagctacaaactcaagacattgctaggagaaattctgttatatgaagacagggagagctggaagggatctgatgaccatttggtcccaccccatgctgtacaaagaagaaaactgagccccaaagagcaggggcaaaggagggtaaaatgccttcacttcttctatgttccaatttgtgtgcaagttgaacttcagttgagatgcacaaagtggcactcaatcctttcccactcatgcacgttgcagacattgccatgctcctcaagctcactcatcccctggccctgaattcctagaagaccactcagccttcacctccactgagtcagtggcaggtatcatacattcactcaccaccctcaaacttctaacccagcctcacaagaacctaaatactttgtgaacagaagctaaatttcagtgaaccaaagggtgaaaaggagatgaataagtagagactctctttccagaaatctggagaaggagcaaggttgcacagcagctgagggagggatgcagggtcaagggcaggagggaggctggagagagttgagcctattcagcttttagagggagacagagggaaggaattgagcctgtccacagagacatggaggaaggtgaatacatagggcagagagggaatgattggcagggaaggaagaaccttgagaagcgagagcaggcatggagtgcacaggttgaaatattgattttgaaggaaggagagatgcttcattctccaaaataggaggaagaaaaggtggatatgggcataaatactgctaaggatgtgaatgagaaaacagtccagatgaccatgaggatgggggataagccaggagggaatgtagactgtgtggataaggaagagtctaggatctggacaccttcacgagctaactgatggggtagtggggataagggaatgagtgagctgggaggacctaggagtttgagacttggggatgagggaatcctgagtgatgacgcagcaagttagggctgttgaaatcccgcatggcaaagtataggctacgtgaaaacattgaggccgaaactaaagatcggaagagttagtgcatcaggaggactgtcttcctggacactggagttacccagctggcagttggcagaacatgggggagagaaaggtcgtgagcctgctgccaaaatctttttttttttttttttttttgagacagagtttcactcttgtcacccaggctggagtgcaatggtgcaatctcggctcactgcaacctctgcttcccaggttcaagagattctcatacctcagcctcccaagtagctgggactacaggtgcacaccacgacgcccggctaatttttgtatttttagtagagtctgggtttcatcatgttggccaggctggtctcaaactcctgacctccagtgatccacccacctcggcctcccaaagtgctgggattacaggcatgaggcaccatgaccagccccaaatctcatgtgaatattggagactgaaaggcagattgacacatgatagggataacataggacaaactgtgaaccacaaagccaatggaaatttacataagagagaaggaatagtgacctggcaatagctttggagagcaagagagatattaattcctaactcccagcccagaggggcagagggcaggtgagcatgagccctcgccacttgagaaggataaaagggaagcaggaaccttaggggagactaaggttcagctgatagcagaagacagaggaaacatttaggaaaaatgttaaagatatatgaatagagttccaaagggcacagttgaatgatgtggaaggaaaggagaaagggcaaggagacaaaaagcatccctttgtaacgggataaagattaaagaggtttttatccaaggcaatggctgagattgagagagacaggaggcagggagacctctggccttaactgactagctgtgtgaccttaggcaagttacttgccctctctgtgcctcagtttcatgattgtgaaataaggataatactaatacttacctcataagattgttgttgctatgaagattaaatatgttaatatatgtaatgcacttagaaaaatgatcaacacatagtcagttgtgaagaagcattagttttggaaggaaaaagattccactccgcactttccttcaagtgacagacattcaattatatcaagtcctgaagaatacatcctcatttcccatcacttacacacagcaaaagcccagcatgcaaaagaaaaaaaaaacccaaaaaacaaaccctatcagagtcagtgatagattcagtttctcagtaattaactattatctgttcctgtacagaaagaaaagagtgcttaaaaagttggttgaagacagaaagaatctagagctataaatgttaaagatgaacagttaatatcatcagagaaacagaaatcaaatcaaaaccacaaggatatatcacctcatgcccattaggatggctactatcaaaaaaagcagaaaataacaagcgttggtaagaacgtggagaaattgtaacccttgtttgctcttagtgagaaggtaaagtggtgcagcactgtgaaaacagtatggcagttcctcaaaaaattaaaaatagaactagaatgtgatccagcaatcccacttctgggtacatatgcaaaagaatcgagagcagggtcttgagcagatatttgaatactcaaggttatagcactactcacaatagccaagaggtggaaacaacccaaatgtccatcagtggatgaatggatcaacaaaatgtggtatatctgtacaatggaatagcattcaaccttaaaaaggaaggagatcctgacacctgctacaatatgaataaacattgaggattttatgcgaagtgaaataagtcagttgcaagcagaaagatactgtatggtgtcccttatatgaggtcataggaggggcatagaaacagaaagtataatggtggttaccagaggcctcaaaaaagagaagaaggagagttgtttcatggctatagagtttcagatttgcaaaatgaaaacgttctggaaatctgtttcataatgatgtgaatatacttagtactactgaaatgtacacttaaaaatggttaagatggtaaattttatatgtttttataataaagaaaaatgaaaacaaaaagatcatctagtatctccccccttcccctttacaggtgactgaagtaaagcccagagaaggtaagcgacttatccaaggtcacacagttcacggaggcagaatcaggatcagaacctgggattctgacccctgcagtaagggtccgtccattacatcctgctctctatgtgaggtgctgaggtaatggaaaagatgacactgttgatttatcagtagtgacagtgacattccaatgaacctgaaagggataaagattctactctgcttataaatgttcatgtgcctgtgctctttctccaaatctcatcaggattattcaaaccagcagtctctgacaggccacagtggaaacctcaagatattcacagctgctctagtctggagacaggccagaaagcagatgagagcagtttttccgttcctgggctgttgcccctgtaatttagaagttccgacactggaaaacaagaagaactcaggggctcacttaaaagcaagctcagtgtggggtctccaatgtcgtgcagggaagctgctagtcaaaacttgctaatttgaaatgggttcactgactccttcttcggactcagggaatgaagtcttttttccccacttaggagtttttcttcggctccttatttcaaattccataaaagagacaacaggaaaagctggccctagcccaagaagcagagatgaaaaccagatctctatttttgtaagtgtgatgtctataggttgccttctattttatatcagaaagttctattgtttccatggaaacaatgagtgtggctgaggatccctacaggacctcagcacttttggggcttgggtgattggtgctattggcttggtgattccaaaaacctccctaagtttcaaaattttaaagctcaagccaaccttctcacacccctgctgtgctcctcccatctctttgacacacagatacctcatgcatatggcactgctctgagctctgaaggtgttaggaaaatcctccctgcagaaatatgacctgtgataaagaactaaataaaacattttttggcaagaacatttctgaagatctttccaatccagaaatattttttttgttttcagtaaccctaccaaggctgaaccaggatgcctataaaaagccttctgtgttcccctaagcactcttaatgaatcctcaggaaggatggaataagaggggggtcagagacctgaagcccgtgccagaggctgagcatgccagcttggcttggtgcactggtggcagtgctcagggcccctgcctcctgtcctcccattggcatggtctcagcccacactccttaagggaattggctgtgctcctggcttgtctcgcctgtgtgtctgctagttatcgaacaaagggtgggattacttccatgcccagtttcccagatgctcgcaagcacagagccaagaatcagctgaaacagaagggacaactgagcagagaagccctcttgatgagactcggccacacttgagctgttgttcctgccacgagacacacctgtcatataaaagccaacaagccatacaggaaacatggtgtgcctcctgtttacagccgatcctagaaaacaaaaactttgctgagacagcaccaaacgtgaaaatggggagaccagccaaggggcctgaaccgtgcacagcccctctccctgttgcatagacaggaggaggagtcaaaagctaagaaggttttgctgcttccagaagctgttccctcacctcctcctctccttcactaggtatattttccccaatcttcaaggactagcttcagagcctgaaactccaggagctgaccccctgataaaactttttaccccaaagtaaacgcaggcaagatgcttgctccgggtggaatgatgggcacctcttggttcatggctaccttctgcaagctaaaaggacctacagggtaggggtgcatactatccctggaaaccgaaacacaagaaagtctcttaaaacccccttgatcacccaaatgtccagaagtcattggaccatctgaggctcctccagccccaattccttcaggagctaattgcagaagaatttcaaaaacgatctctcatcaacttgtccaaggaaaccaggactcaatataccagaaagttgtgaaaatggggtgtccagtgggatgactagatccaaggtttagggagaattagaagggagataggagaattgaagaaaggtaaggacaaagaggaagattattccagggcaagagagaaaaaaccaaaaatattaattggagtaaataagaaaagtattaattggagctgttttgagggatccagagaggaaaccattcccctggcacaaggtacatgttttaagggcaagagaaaaaaacatatgaagagcactgagtaaaagcactgaatttttttcctggctactcctttggaaagaagaaaggggaattgtgtccataattatgcattttttttttttttgagacagagttcactctcttgcctaggctggagtgcagtggcatcatctcagctcactgcaacctccagctcccagcttcaagcaattcttctgcctcagcctcccaaagtagctgggattacaggtgtgcaccaccatgcccagctaatttgttttttaaatttctgtagtagagactggctttcactgtgttgaccatgctggtctcgaactcctgacctcaggtgatccacccgcgttggcctcccaaagtgctgggattaccagtgtgagccattacacccagcctatgtcatattctttacaaagctgaggttaaggaaaccaacttggtccttggatcaagtcatttatttctataaagcagctccaggctgctataggtaaggagaagagacataataatatagatcaatactgacttgggagtcttctcttctgtgagtttccatgaacaaaatttgggagtcagggatatggaaacagaagggagctgcaactcattgagcatcgctctgctttgagccctgggctgagtgctttatattcaggacctttgtactccagatccatacaagcagctgcccacccaatatccccacttgggtgtctaaaggcatctcaaactcatcccaaattgagcttctgctctttcccccatatcctgttccagccacagtccttcattcagtggatctcagctccatccttccagtggctcaagccaaaagtgttggagtcatgcttcaccctgtactgctcgcataccccatgcctgcttcagtaagaaaatctgttggttctaccttcaaaatgtaatctggaatggctgtacttttccctacccctactggctccaccctggtccagaccatccttgtgtctcacttggatgattgcaatgttctccttgcttctactcttgctcctttgcaatctattcccaccacagtggccagggggatgttttttaacatgtcatatcatgtcattccactggtcaaaatccgccaacagcttctcattctactcagagtaaaagcccaagtccacccatctggaccacattccctccctgattccatctagtgataccccttgcccactcggcttcagcctcaccagcctctaggcatcaaagcttttgtgcttactgtttcttctgcctagagtccctgtccctagatctcaccccctcaagttttttctcaaacattactgtggggaggctttcccaactaatctgaataaaatggccttctttcctgcttaatttgttttccagagcccatatacagtaactcttatttattttctttatttatcatatgtctctcttccctagaatgtaagttcctgaagttaggattttacccactgctgtatccccattgcctagaatggtcattgacacacggtgaatgcatgatgagtgatctatgtagttgtgccctctgtaaaaagtctgctgggcacggtggctcatgcttgtaatcccagggatgtgggaggctgaggtgtgagaattacttgagcctaggagtttgagcctgcagtgagctgtgatcacatcactgcactccagcctgggcaacagaacgagactgtctcaaaacaaacaaacaaacaaacaaacaaacaaataaataaataaaataaaaaagctatgagttgatgaatctatctcaaatctattcttcatccagagtcctcattccaagtgaactacgcacccagcatcatgagctgcctaaactgttgaccagagcatcagctcacgcagccccagggagatccctgatgttcaggcactgttgggggaggaagacaaggtacaaagaaaccaacaggagtcaatgtcaagaatttcacaggggataggaaattttgatttggttcatgcagcttggattccttcagaaagccttgaactgccaccattagaaaaagatacacacacatacacacacatgcacacacccacacgccctgcctgggagaactgacattaccaaattccagaaaaccgaaaacaatcttatcctaacagggagagagacatcatggagaacatggcatttagtaaggagaaaaggaaatatagctcctgagtttgaatggaagaagaacctaaaaataactaggcggggcgtggtgcctcactcctgtaatcttagcactttgggaggctgaggtgggcagatcacttgaggtcagtagtttgagaccagcctggccaacatggtgaaaccccgtctctactgaaaatacaaaaattagctgcacatggttgcaattgcctgtagtcccagctactcgggaggctgaggctggaaaatcacttgaacccaggaggcagaggttgcagtgagccgagatcgcaccactgcactccagcctaggtgacaaagcaagactccatctcaaaagaaaaaaatatgaaaataaaaaaataaaaataaaaataacttgccctattcaaagatatcttgcttgccatatattttataataaaaataaatacatgagttgagggaatgaggtgagggtatctttaatactgccttccattaatatcttggctttctttctgagaacacatggtacattccaggaagacagccctgtcttatttctaattttctaaaatgattgttcctgactttagcagtatgacatgggtttttccaagcccaatcactcatgattttttagcctagtaatctttaaaaccaaagatgcgttttgtcttggagctggggaagaggaaggcaatgatcatttacagagccctattatgtgtcagacactttatacttcactcctcaaatttgaagttcgtatcattatccctgtttcacagatgaggagactgaggcttaagagcattaagtgatttgcacatgattgcccagatagccaaggcttgacctcaggactaatgaactccaaaaatgctattccttcaactatgcagtgttgcgtttttcctacagtgactaacagaagagtgagagctgtgcctggacattaataatgaattagctttatttgtaaacccctgaccaagaaaatatgtaatacacaatatctatacctgtagacattttccttcattcaaggaaatagcacttcaaaagaatggaaataacacaaaacagtttgatggtaaaccaaaataatctgttcaggtcaaaagaagtcaaacttgatccagccttcgaagggcattttctagcatcatctgaacaaatcttactccatctgtaaggtggagataattatttaatttttaaatttttcatgtatgactttttacacctttaaacatctctaacaattgaaagtcatgatgtgtatgattcctgagcgatccattgggatgctacaaatagctgttaatagaaaatccaggctgggcgtggtggtgcacacctgtaatcccagcactttgggaagccaaggtaagaagatcgcttgagcccaggagttcaagatcagtctgggcaatagagcaaaacctcgtctccacaaaaaatacaacaattagccaggtatgatggtgcattcctgtaatcccagctactctggatgctgagatgggatgatggcttgagccccaggaagtcaagacggcagtgaggcatgactgcaccattgtacttcagcctgggcaacagaggaagaccctgtctcaaaaaaaaaaaaaaaaaaaggaaaagaaaatccaaatgggatgacagagtggttttaggttggcaatgtcagtagctctgtggcatgaccaggacacaggtttctctcatcttgccactctgccaccctctgtgcaacggctagtcttcttctcaaggcaggctcttgtaatggtctcaaatggctgcctcagttccagccaacattcagatgacaatcttgagaggtggaaaaggaatattcctgtcttgggtctcttgggtctccttttacaagtgagataaaacttccatcattctgggccaggcatgaaattgcagggatgacctaggaacctatatgctcctagtgatacagaggcacgagcaaagtccaactgcacaagcacattgcaagcctcctttttcatcccatctgttaatattccattgctcaaggcacatccatggcagaacccaaagtcaaggagcagagaagtatactgctcctgtgttggcactgtgacgagggttctgatatatgctactacagggagtgaagaattgggatcaaggatttaaactaccagctacacgggctcatgcctgtaatccctgcactttgggaggctgaggtgggcagatcacctgaggtcaggggttcgagaccagcctgaccaacatggtgaaaccccatctctactcataacaaaaaattagccatgcatggtggcgtgtgcctgtaatcccagctactcaggtggctgaggcaggagaatcactggaacctggaaccttggctgcagtgagccgagatcgcaccactgcactccagcatgagtgacagagtgagactccatcttgggggaaaaaaaaaagaatttaaactacctaaactaccacctgtggttatattaggcagaaccttatgaaactgccatatttcaaatacaaaatagtcgaatgctgaccatcctgtatgattcggtgtaatgccatcactggaacttcagcatgaccttttgtccactggctatcagaactctctggaaagcagaggacacagttggtggttcagaaaaagcagatttactaaggacataggaagtgaaaaacaggtaattatctgtctctgatatagcagtatcattccctttaagcagagtcatgctacatttgaatcaagcacttattagaatttaaagattatgtgaaaataaaccttcaaggttgagtcccaaagatatttttccctgggaagtcagatgtgtcatggtcccataggaagactattacttttaagtagagatttaattacattttaggattgtcttaattatccccgctcaataaacttcctttccaatagaatccacgagcagcacatcctaacaaaagttccctagtttgtcatcccctcatcccttttcccctccaccacgcatatacacccatgaacttgatttccctgcctccaccttagttcattctcatctctttggaatacctgttagtcacttgctgacctccagtcatcctttccacactcctgtccccatgcaaactacctcctctgccttcccataatactctatatatctgtaatatagaatttaacacattgtaacaaaaatatgtaagtatacatccatttcaccctctagattatgaactccttgagttcagggactgtgttttatttatctttgtttttttgttttgttttggtttgtttttgagacagtcttgctctgttgcccaggctggagtgcaatggcacagtctcggctgagattacaggcatgtgccaccatgcccagctaattttgtatttttagtagagatggggtttctccatgttggtcagtctgatcttgatctcccaacctcaggtgatctgcctgccttggcctcccaaaaaattttgtatttttagtagagatggggtttcgccatgttggccaggctggctcgaactcctgacctcaagtgatccaccctcctcagcctcctaaagtgctaggattacaggtgtgagctaccgcgcccggcactctcagtttatttttggcttgtgcaaagtctaaagcagatgtgcctgcttgggcagctctccaccaagtggtaacgcagggatccaaccttcttccatcttgacactaccatcttcaacatgtggcttctaaaaacagtgcaaacatgagacatgtcatgggaaaggcacagcagatgctcaccaccttagctcagagatgacacaaatgactccttggctagtcacatggcctcagttagaaatgggggtgtggcgaggaaggcgggtgggagggcctggatgagcaacaactctacacgatggaaagggagcatgaatctttggtagttagctaactatctctgctacagggaggagagaggaagaaaggtagggaaaaagggagggagggacttactcaatgcctaaatacatacatactactttttaagtcctgtgcaaagacttctcaaattttctgccacttagatccttaaaaccagatgtagaaagcagttgaacaatatgctgagagaaaacacaccaaatataaaaactaaaaataaggaggagcccattgcagtttcatgtcttaagcacagtcaggaggaaggaaagcttcaggatctggggacagggtatacatatgtctgcttgagttccatgtcttaacttgagagaggaagagagaagaggagaatagcaggaatctgctcaactggaaagcttctaaggagaggaggcttatgggagaagcgttatcaagggatacatcctgctatgaagaaggcagagtgttcacagtgaaaagcaaaccagggaattggggggacatgactgggtcatgagagaatcatagtcatcactatttgggagtggatgaggagtgaatcaccaatatgagactacatgtccagctattgcagttcaatgcgaaacatctctaacaagtcattttagcaccagtaagctcctgctcttgagaaaagcaaccactatccaggaggttgcatacagtgaggaggtctgggattggaagccggggggtgagagaggaggagtaaaagcatctgtggtggagactgatagctgttcactcaaatccatttcctcttcttcctgagcacagggcctcccttgcagttcagcattgccatgtcaatgaaatatgaatagaaatagtatgggcccctttcagaatcagcctataaaatcctcctatgtgtgatcctccaagtgtcttcatcctctgccagcaagatgcacatggcagtgaggtcttatgttttggtgaagccacatttgaacctgggtccttgaatgacttcatggaagagagcctacttgcctagctggacacctgccaggactgttagatgagcaagaaattaatttctactcaatgatagacactgtgactgccacccagattccatttcaatcaaggacttattgccacagctgaggtagtgctgtcagcaaagagtcccttcaggggctgcctccctgaagaacaagagaatggttttatttaaggttatgcccttttgagaaaagcccacatctggggatcaaccaatgtgaggctccatgtccaacattgtggttcaatgtaaagcatctctaacacggcattttagcaccagggcttctgtagtcttgaccaaggtttaaagcatctggcctgatttacagatcaacttctcttttgcccagtgctgcttccgtttactcttttctacaggtttttaatgaaagaacactctttaatcaacatctggcacactaaaccctcagagtcgccttcctggaccccctgtctccccctgccatgccccgtaaatacactatgttgttggatgtgtttcatctatatgctgtgttagttcagataagccatggcatatttgatctacatatagatgaaacatttcttctgctgacacggctatgctaggttggccagcacacatgttccttgctatgtagaaaagtctaggccgtctgcaataggagagaattttgtcaagacacaagcagtagagacagaggcagatgggagagagaaaatccagctggagtgagtctcttcccagtttttgtagcaatgattcctaaaacttttccttcagcaactctagtatcttccccagtgacagaagccattgactcccttttccttcctactttttttttcttaagatggcttaaactgggtttctgtcatttgcaaccaaaaaagtcccaatacaagcggttttgtgctatgtaagtgaatgagtaccctaccctttcactggtactctctcaaaagaaaattagagacagatttacataaacttttaatgaaaccatcatttattgagaactttctacatgccagttccattctacatacttttttgttttgttttgtttttttaggcaaagtctcactcttgtcgcccaggctggagtacaatggtgtgatctcggctcactgcaacctccggctcccgggttcaagcaattctcctgcctcagcctcccgagtagctgggattacaggcacctgccaccacgcccggataatttttatatttttagtagagatgaggtttcaccatgttggccagactagtctcaaactcctgacctcgggctatctgcccgccttggcctcccaaagtgctgggattacaggcgtgagccactgcgccctgcctattctacatacttttaatatattaactcagtcctcacaagagccccacgagatgggtaccattactattattcccactttcagacaggaaaactgagacacagagagattatgaaatacacccgaggttacccagtttatgagtgatagatacccccagcgcctgtgctcttacccagtgatgctctcttgcctgtgttcacacagcctgagatggggacatgagaggcttctgtctcatatgggttatattcatgaatgactagggttctttcccttctctctctcttttttttttttttttggttgagatggagtctcactctgtcacccaggctggagtgcagtggcacgatctcggctcactgcaacctccgcctcccaggttgaagtgattctcctgcctcagcctcccgagtagctgggattacaggcatgtgccaccacgcctggctaatttttgtatttttagtagagacggggtttcgccattttggccaggctggtcttgaactcctggcctcaggtgatccacccgcctctgtctcccaaagtgctgggattacaggcatgacccactgcgcatggtaggtccttccccttctctttgtgcatccattataacttgcaagagcaactaccttacagaagttaacagcaaaaatgaaccagaaggcagagaaattgatccccaaactaacaagcaaaagaagtaattaggggtgctgtgagaggaaaagccagggctgggagggtgtgcagacctgaagttatttaaatgataaaggcacggggtgctgcaggagagacgttgaagggttaatgttggacatataaacactagacccgttgggaagagcccaagaggcagagcaatcagctctgaacagtacacaggaggctgaccaaagagcagtgctttctaagccaggacatgggctagaacctgccagatagaatgtggttttctcaagaaccaggagaatggggtcaagaaaggtcaagctggtagggaaactgagagaggctctgagtcaagaaaaccttggagggtaaagtgtcaggtctctaacttcacagtccctattatcatgtaactgtgaactcttcacaccccgagacttcacatattggagtgaagaattggtttcttaaacttcaagggctaggtgagtgtgatgtttccttactgagccaaggaataacagaagagtacggggcagagctacattcccagagaaaagtcaagaggagtccagtcctgaccctgtgtccaccatcacccatgggagacaatggtgaaggcttctgctgctgagtgtgggggactctggcattttgtcaccactcttaaactgagtttgcctccaaatatgttagcctgctttagaataaacagtgataacaatccatttatttgcagagaaggacttccctccacttgccctgggttaagctaaagtagaatgaaatattggtaaaggcgggcaggcacacatttcatccatcactgctttttttccaggatgcttttgactacatcttatgtgcatataatgtctctgatgataaatatttcaagattagaagattctccttatttaccactgcctacagtcactttttacagtttcacaccaatttaactatgaataccaactatggtaggtgatgacatacattagctcacttagtgtttgaaactacctcaagaaaagggcattattatatttcgattgtggtaaaatatccataacataaaatgtaccattttaaccgtttggaatttacagttcagtggcattcagtatatctacttgttgtacaaccatcaccaccatccatctctaaaacccttccatcatcccccaactgtcaccaccatccgtctctaaaacccttccatcatcccccaactgtcaccaccatccgtctctaaaacccttccatcatcccccaaccatcactatcatccatctctctaaaacccttccatcatcagccactgaaacctcacacccattaaacaataactccccattccctctttcctcccagcccctggtaaccattattttgctttctttctttatttagctactctaaagtcaaattgtacctcagataagggcagtcataatatttgtccttttgtgtctggcctatttcacttagcatgtttttgaggtttgcctatattgtagtttatgtcagaatttttttccctttttaaggttgaatatattccattgtgtgtgtgtgtacatacatgtaagtatgtattttgtttatccatttattctttaataaatatttgggttatccttttggattttgtgaataatgccgttataaacatggatgtccaaatttctgttcaagtccctcctttcaattcttttgggtgtatacctggagacggaattactggattatatgctaattctatttttaaattttttaggaacctccctaatgtcttccacagtggcggcaccgtttttcactcccaccagtaatgcacaagagttctaatttctccatatccttgaaagccattatatttcatccccaacattacagacaaggaaactgaggctcacagaaatgaggacttctcacagttacaagctactgaatatcagatcccctacgggaagccaggattcctgactccctgtccatcgcacttccccagtcctacagctgcctcagtcacagaacagcaaaagtagaagcccactgaaacccaaaaccagcagaattatatccaggaaagaatttgtgtctgggagttactgtggggaaaagcaagagagatcagattgctactgtgtctgtatagaaagaagtagacataggagactccattttgttctgtactaagaaaaattcttctgtcttgagattctgttaatctatgaccttacccccaaccccctgctctctgaaacatgtgctgtgtcaactcagggttaactggattaagggcggtgcaagatgtgctttgttaaacagatgcttgaaggcagcatgctccttaagagtcatcaccactccctaatctcaagtacccagggacacaaacactgcggaaggccgcagggtcctctgcctaggaaagccaggtattgtccaaggtttctccccatgtgatagtctgaaatatggcctcgtgggagggaaagacctgaccgtcccccagcctgacacccgtaaagggtctgtgctgaggaggattagtataagaggaaggcatgcctcttgcagttgagacaagaggaaggcatctgtctcctgcccgtccctgggcaatggaatgtctcggtataaaacccgattgtacgttccatctactgagatagggaaaaaccgccttcgggctggaggtgggacatgcgggcagcaatactgctttgtaaagcattgagatgtttatgtgtatgcatatctaaaagcacagcacttgattctttaccttgtctatgatgcaaagacctttgttcacgtgtttgtctgctgaccctttccccactattgtcttgtgaccctgacacatccccctctcggagaaacacccacgaatgatgaataaatactaagggaactcagaggctggcgggatcctccatatgctgaatgctggttccccgggtccccttatttctttctctatactttgtctctgtgtctttttcttttccaagtctctcgttccaccttacgagaaacacccacaggtgtggaggggcaacccaccccttcaagttaccaccccagttattcttataatggtgatagctcgaaacacactgttgctagaactcttcaagcagaaatgtatgtggttcaatgacaagattgatcctgttgatttagcaaacatttcatccttcagtcatccggaattcattaattcattcaacaagcatttattgagtgcctattaggtgccaagcatatttttaagagctgtgaacaagactgccaagctttctcctctcatggaactcacattctcgagaagaaaacagacaataaatagaaaagcaataaattggatcatttcaatgttataagcacactgaagtctatgaacagggtgatgggacagagtaataaaggcagggaggaagagcgactttagatactgtgaagcctgtctggaaaaggtggtatttaagctccatgtgaaatctggtagaagaacatgtgggcatacagaagagcaatgtaaaggtgttgaggtagaaagaattggaatgttctaagaaaatcagggtgtcagtctggtgggaccatggaaacaaagaatggagagtagagggagatgtagtcagagagaggacaggcaccagatcaaatgggtctttatatgataatagctaatgtttatttagcacttactttgtgtcagatgctattccaagtaatttttatgggttagttattcaatcattatgcaaccctataattaaatactattattattcccactcttcagatgagggcactgaggcccagagaggctacataacttttccaaggagctctagttgttaaggggtggaacgtagatttgaacccaggcaatttggcttcagagtctcggttcataaccactttgtcataggaccatcttgtgattagatgttattgcaagatcaataagatatcaatgaagggctttaagcagaggtgacaggacttgttttgtattgttgagatgatcaccctagctgctgcatggagcaaaaagggaggcagagaaaccagatggaggccattatggaattccagctgagagaaagtcatggtgtggatgagggaggtagaggtgaaacagacagaaatagacactgttaggatacctttttgaagcagagctgtaggggtttgctgacaccttggatgtggaggtgaggggaggggaggaactcaggctcactgctaggttttttacttgagccatgtgtcaagtggagaagacatctagtgagttgggggaagaacagggtgtagaggggatatgtgttgagtatttgaatgtctagcatccatttccctaacagcacccccatttcttgttagggaacaccacctccttttttttttttttttgaagctgagtttcgctctgtcgcccaggctggagtacaatggtgcaatctcggctcactgcaaactctgcctcccggattcaagcaattctcctgccttagcctcccaagtagctgggattacaggcgcccgccaccacatctggctaatttttttgtatttttaaagagacggggtttcaccatgttggccaggctggtcttgaactcctgacctcaggtgatccgcccacctcggcctcccaaagtgctgggattacaggcatgagccactgcgcccggcgggaacacctctttcttatgagttatagtcaagccgagaggccatacatgattgagatagtccaatcaggtaatcctttcctggaatgcgaatctgaagaaggacaaaattcagtccctccaggagctcctaacaagttttttcttttgcaaggcatttgctgtgcttcctagttccaagtccaggactccagcctgccatcaattctgcgagtcccaaagccttccagcacattctgcctgcctaagttagccagtgccagttcttcttgcttgtaagcaaagaaagtacaggttggggataggatagggtagaggtgtgatgctcataatcaagagatacattttggacagggtaagtgtattagtctgttttcacgctgctgataaagacatatccgaggctgggaagaaaaagaggtttaattggacttacagttccacatggctggggaggcctcagaatcatggtgggaggtgaaatgcacttcttgcgtggtggcggcaagagaaaatggggaagatgtaaaagcggaaacccctgataaaaccatcagatctcgtgagacttattcactaccatgagaacagtatgggggaaaccacccccatgatcaaattatctcccactgggtccctcccacaacatgtgggaattatgggagtacaattcaagatgagatttgtgtggggacaacagagccaaaccatatcagtgagattaagatgcccataagacgagtcaaggaagctgtttgatatatgaacctatagttcaggggtgaggtctggaccagaaagaaagaaatttggaaatcttcagcatatacatagtatagttctgtgtgggaaaatatgccatatcttttgctaaaaggatcctgattttctttcggggaaatatccctccttcttggctaagaatcatgacaggctgttaatcaaagttccagattctcctctagccaagaagtaaggagaagtctcaggcctgaacagtcagcacaagccatttacccagtcgtagtgattattcagggctatgcagataacccagatcatttcaataagaattagccaaaggacttttagtggaacaataaggaaggaaaagttgttctttacagaagaattgctaaactggtacagtgcaagcttggagctaccagagcctttttttttttttttaaaccaccttgggactgtagcctaataagaatgagaccaacacaacacaacaggaaaaaagacccaagtaacagagggagagaggccacgtgctgatgcagcattgaggcccatgaggctgtcagtcctggagctaacatcacaattacatgaatcaatgaattcccatttttgcttcagagttgagttagtttctgctacttgtaaccaagtgggttctgacaagtacaaatggcatttaaatgagtaagatcacacaggaggaaaatgtagctaggactgagctgcaaaacactaataattaaagctccagtagaggaggaggagccagcattttggttagattgtttcttgtctttgatgacaattgggaccagaaaggtaatgcaatgtattgtatcgctgaaagaaagagaatctgttagcagagtatcgcaaattttgtttaactgtctgataggtacaaaaagggccttatgtttgcaaattcccaatataaaaaattcgcttgtagcttagtgttggcacgttattcctgtgtttaaaagtcagtacctcattgctgaagagcaccattgctgctgagtcatgccatccaagacaactatggctacctgccttttcttggcacccagcattccgagatgctggaattcagtgattttggcgaagacaagtcagacatgtgcggactgttggtaaatatgcaccagccctttgtggcttgactgcccaaagtcagggaagagcttggactcgatctctgctggcccctgaattcattttggatgaggcaggttggtgtgtgctaaccagggtccccgttcctaacaatagccagactggcatcgttggcttcaaaatggattgttctggctcccaagtcaaaagcggctctgcacaaaactaatattttgagcaaattgtacagagttgtgcacagtggaatgatgagttttacccaatagggagtgctgagacagccaaatggtggctctgaagtgagtgccaggaagctggtcttggggatgggagcagagtcatcatagaaatggatgaatggcagggactgcagaaacaatcaagtaagagtctgcaattagaggaaagagtttgctcttttagccagacacaagaagacaaagggaaactcttccttttgccacacaggaaagaaaatgtggatttcaagttgttttattctgggttagtaggctctgagaagcacttagagccatccagccagcccatgctttgaaaaactatcatcattgactctgtgaacacaaggctcattgataaacagcacaatgatgctcttaagtactcaggcactggagccagactgcctggctcaccacttccttccttaatgttcctgcgcctcagtttcctcacctatgaaatgaggatgaccatgaacgtgggaagcattatgttaatgaaataagccaaacacaaaagggccaataccgcacgattccacttatatgaggtgcctagaataggcaaattcccacagacagaaagcggaatagtggttaccaggggctggggggaagagggggagaatggagttattgtttaatgagtatagagtttctgtttgggatgtggagaaagttctggcagtggatactggtgacggctacacgacattgtgaatgcatttaatggcactgaactgtagacttcaaaatggataaaatggtaaattttgtgttgtatatattttacaattttcaaattaagtttgttgctacaaacaaaaaattgacctaagaagtcatagacaaaagaattagtgctgtgcgacttcagtacataaagtacaaaaaaatggcaaaaatcctcattggtgttggattttaggatagtgttgtaactgcctgaggggttcttcctgtgaccgcacaaagaaaaaccatggcattatattaaagaaagagttttatagacacaaggccggccatgccacgtggggaccaatttagtactgaaataattctcttccaaagctcctaggttaagagtttttcaaaggcagttcgggggaagtgatgggggtgattaggcctgctgctgattggttggggcagagatgaaatcatagggggtcaacgctgtcctcctgtgcactgaattgtttctgggtggggccacaggagtggggttgagggtccaagtggagccatcaggtcaaggtgaagccatgggtgtcagacatgcaaaaaaacctgaaaagatatctcaaaaagccaacctacaacagagatgttatctgcaggaatcactggggaagctgcatctcctataacctctggaataatgactaaacaatccttcatgtctataccttagcaagagactcaggctcttctccttcccctagcctggaggcctccccttagctttagaaaagcaattgagtttgagggaaggcctattatcatttaaatttacccaaatgtccctcaaactcagctcagccccaaagcccaggaataattaagggaaaggcaagatgggggtggggcgagggtagcccagctcactgttacaatttttcttactgatataatttttgcaaaggcggtttcagtgttggtgttggatatcaacaccactgagggtggtggagactggaaagggagtcttaggtggctggtcatgttttctttcctgatctgcaggctgattgcctgagtgtgttgcctttgtgaaaattattgaactgtcatttatatgtgcactttatgtatattagacttcaatgaaaagcaccccccacctctacaaaagacaatattatcctcctcagagggctattttagtattcagtgaattagtgcagataacaaacttagaacagtatccggcatataagggcctcctaagtcatttccagcagtgttaaaaaaacaaaagaaaagctttcctccagaaagctttgtggactcacccctgcggttgagatgccaatcattcccttcttatccacacttcctgtgctttgagatactttgtatttgctcctccaaattctcctccctgccaccaccaccccagaccccagccccggcttggctgtgtccctttgttagagtaggtagttaggcagacataagcagcgaaggagaggggcctcttagcccagaaatgtcaggcaaccatcaggtgatggtagggctgttgttaaactgtctctctaaaataataattggggtcagctggcaccagggaaagctactctaacaatagacagaaaacacctgaagctggtgattagcaacttccagataagatctcaggagctggatgagcaggctcaagcatgtgcattaattaagatgcaaaatggtggagtttaactggtatatgaccttcctccaggaacgctcaacttgtaagggaaaaatgcctcaagtgaacatgcgcacaacttccgtaaacacactgtgcagtgatccttcccaagcgctggcaggccactgtgcgtgaggatagcccaccccaagggaagaatcaagggaggagaaacagaaacccaggaaccacgccaatggagaaaaccccaagtcaaggatcaaatagggcacttggatctctcaagttgcccgctcggccctcttccaagtgtactttgcttcctttctttccttcctgctctaaaactttttaataaacttttaattctgctctaaaacttgtttctcactgccttatgccctttgggtgaattctttccttcgaggagggaaggatcaagtttactgcaggcctgtcggattcactgctggtaacacctttattaaaggttgcaggtcctgtccagcaggcccctccacttggctctctccccaggttctggtaactgcctcttttggcccaggggtaataatggtcccctgcagttaatccccaaggatactgtactactatcccttgtggtttcttgtggttttcttatgcccagatctttataaatcacttcttattaaaatcttctccagttttcccaattgcagtgtattattaacttctgggacctgactgatatctacccgcttagaaaagctatggaaagcaggccgggcgcggtggctcacgcctgtaatcccagcactttgggaggccgaggcgggcgcatcacgaggtcaggagatcgagaccatcctggctaacacggtgaaaccccgtctctactaaaaatataaaaaaaattagctggacgtagtggcgggcgcctatagtcccagcatctggggaggctgaggcaggagaatggcgtgaacccgggaggcggagcttgcagtgagccgagatcgcgccactgcactccagcctgggcgacagagcgagactcagtctcaaaaacaaacaaacaaaaaaaagaaaagctatggaaagcagccatgtaggctacgggacctcaatcagtcagataactgctgactagggcggacacaagcagctgaccacgctgaaccaatcagaatcatagaaacagagggattgaaccagtggagaaccacagaactataagatcatgcacaggtagagccagggttggggccatggcagcccaaaggcaccagcaagcggaagctactgtagggcagttgaaaaaaattggtctgtggggaaaaaggaacacatgcaaagtatcatttattcatgttttaaatgcattaatatattcaaaaatgtgttctaacaatatgcaatcaaatgtaaaatcatctaatgtggtcttcccagttattaaactccattttttttttttaatgtgggcatggaggggatggagtttcactcttgtcacccaggctggagtgcagtggtgcgatcttggctcactgcaacctctgcctcccaggttcaagcgattctcctgcctcaacctccagagtagctgggattacaggtgcacacaaccacacctggctaatttttgtatttttagtagaaatggggtttcatcatcttggccaggctggtctcgaactcctgacctcaggtgatccacccacctacaccttccaaagtgctgggattacaggcgtgagccacactctatctttttttttttttttttttttaattcttcagctaaaacagtggaaaaggtgatttattatatggttgttacactcggccacaaataaacacagaaatagtccagaatgtcacaggtccagggcagaggaccaacatgggcattttgtttatgagcaaggtgggtctcagaggtgatcggcgatcagagggcgatgaagttctagatccattgacacaagctctagacagtagcatgcagtcccacaacttgtaccagcatccccagcgtctggcattccatgtttctgctcctgtggcctccacggtgcaacaagctagcggtttacttggacctctgcctcatctttcttcttttgcgcttcagcctgcgcattcgcttcttcctccacttggctctcatggcacagaggtttccaaaaaaaatggcgctaaggccgagagccacactctatctttttttaagagacaagatctcactttgttgcccaggctggggtgccatcatagctcactgcagcctcgaactcctgggctcaagccatcctcctgccatagccttcccagttgttaggactacaggtgcacatcaccatgtccggctaattttttaatttttcttagagatgggaatctcactatgttgcccaggctggtctagaactcctggcctcaagtgattctcctcccttggcatccacaaattactaggattacaggcgtgaaccaccatgcctggccttgaactgtatctttaaagcccctgaaatattgttcctaccaaagtaatataaatgagattatgtcctaaaatgaactgtatgaaatgcaagaaagctactcattatgaaatcctgttaatatatgtgtgttggggtggataaggtaaagaatgattgacgctacttaataaattgtggttatccattagtacatttttaaattaaattactaatgaaatacaacaaagtagaaaatatcagccttcatcatgcttctaagagcaaatactgatttgtgaaacttatttcagtgatacatatactgggtcaagtgtaaaatgtatttccactgggtcaaaaaagtttttaaaattctagttaactgtggttaaaatatgcagttcagaaattactgtgatgtactacagtgtgggagtaacacaggaagaaaacacagtagagttattataaataaaatcttgctaacatctatgggaatcatatattctgagccttaatatgttctttcatagatggttttaagttggaggtggtcatcgagctaccatttcatcatcatccttctcacttttctctttttacaaactggagaacggtactgtcatcatttaggtatccccccagtgcttggaacaccatatgcactagataaatgtttgatacatctctagaaaatggtcttttcacaaagccattgtgtttacatagaatcaatgatatgaataagatatttaaaatttccatatatgcactgctgtaatcaaacatcatatgatcactgtaatatcccataagcagtggttttatataaaaaaattttgaggccgggtgcagtggctcacgcctgtaatcccagcactttgggaggccgaggtgtgtggatcacgaggtcaggagatcgagaccatcctggctaacctagtgaaaccccatctctactaaaaatatgacaacaaaagaaaaattagccgggcatggtggcaggtgcctgtggtcccagctactcgggaggctgaggcaggagaatagcaggaacccgggaggcagagcttgcagtgagtggagattgcaccactgcactccagcctgggcaacagagtgagactccgtctcaaaaaaaaaaaagaaaaaaattttgaaagactacattttaaaaaaatgagctattattgttattctttatattatttttcattggcatttttatttagatgtaataatgttgatgctaataccgcgtcagtaacaaactttactagctgtagtgagttgaactgtggctcccaaaagttatgtccacctgaaacctcagaatgtgatcttatttgaatacaagtctttgtagatgtaattaagataagggtctcaagatgagatcatcctggattgagctgggactttaatccagtgagaaatgtccttccaagaaagagaaaagaagacacagagacaaaaagagaaagccatgtgaagaccagggcagaggctggagttataaagtcccaaaccacagaatgccaaggattgctgggagccaccagaatccaggagagaggcatgggatggattctccctcagaaccttcagcgggaacgtggccctggcaagaccttgattttgaatttgtggccttcagaacttagagagaataaatttctgttgtgttaagccaccaactttgaggtaatttgttaacagcagctctaggaaactaatataccagctgaataatatactgatagtttaaaggtcacaccaattatagatttggttttcctggcccttgcctgacctatgtctttcacttagagaatgttggtaagagtttattctgaagcagtagtattggattcccacagacaaacatacgaggtcacatggcagctgctttacacaggactgtcaactgggccattgctatggttagaatgtttgtgttccctacaaagttcacattgggattcaatccccagtgcaggtttattaagaggcaggacttttaggaggtaattaggttatgaaggctctgccctcatgaatggaattaatgctcttatacaagggcttgagagcctgtgcaatatagggggaccccatctctacaaaatatttaaaaattagccaggcatggtggtgcacacctatagtcccagctactctggaggctgaattaggaggatcacttgtgcctgggaggttgaggctgcagtgaaatgtgatcatgccactgcactgcagcctgagtgacaaagtaataccctgtttgaaaacgaaataaaataaataaaagggcttaacagagttcatttggccctttttgcccttccaccatgtgaggacaccacaagaaaccccccatgaggaataggccttcaccagactcagctgctggtttattgctcttggacttcccagcctctagaacagtaagaaagaaagtctgttcttaatatattattcaatctaagatgttttgttatagcagcaagaacagactaagacaactattgcttggattttcttttactcctcaaaagccaaatatgtccatggttgaaaccaaagaaactggattttcattccaactgaacgaccacagtagcagagcgatcaggaacatgggatggggtcaggtagttctggattggaatcccggctccaacccttaactgagggagtgaacttggacaaatacctgaaactctgggcctctctttgctcatttgtaaaacaagaattgttaaactccctcaaatgctgtcagacaatttaataaggaaaacaccatcttgacaaagtcttagtggtacctcagaaaaaagaagtcagggatggatatttatacagttttgagatcttggttcaagtaacctcaagagtctttaaagaagggaactgaaggtcaggcgtggtggttcatgcctgtaatcccagcactttgggaggccaaggcaggcagatcaactgaggtcggaagttcaagaccagcctaaccaacatagagaaaccccatcactactaaaaatacaaagttagctgggcgtgatggtgcatgcctgtaatcccagcactttgggaggccaaggcaggcaaatcaactgaggtcggaagttcgagaccaacctgaccaacatagagaaaccccatcactactaaaaatacaaaattagcccggtgtggtggtgcatgcctgtaatcccagctactcgggaggctgaggcaggagaattgcttgaacctgggaggcagaggttgcagtgagccgagatcgcgccgttgtactccagcctgggcaacaagagcgaaattctatctcaaaaaaaataaataaataaaagggaactgactggaattgggctaagatcatgatgtaaccttagcccaaggtggacgaagggaggatcttaaagcaagtgttgatgagtaaactatggcttgatgagagtgagcaatttgcccaagggagcagattgttatctcagataagctgatcagcaggaatttcctaatgcaaacagagaagttatttgttggcttacagtcttatctattctatgaaaagttttcagaacaagtaacttaagttatattgacacaggtggtctgagttctaagtccaaatagcaatgtcatgttgatggcagttgtcacagttctcaagagaatgatatctactttctgtggctgttgtcaggagtaaatgacatcatggttctatagtatctgccacacagcagggactaaataagatattattattatccattttaatttattttgaaagaccaaacagatgtaataggaaatttttatatctctcaaatttttattgcttttcataaataataagcaaagtaaatggcttgcggctttcctggagtttaggaactactaagttactaaggttatagtagaatttgcacttactgaaagaaaaaaaaaggggacaaaaggaaaaaaaacattgagagctctttttctttgccatgatgctagttgtcggcatatttgcattccccaaggacttgggagtaattagctctgcataagctgcacatcttcaggaagaaaacaacttttataaatgcagagaggtttcatgaaatggtgtgtcatatggaaatgcaataatttctggagactaggagtctttattcattccctctgcatattctcaattgaattagtaaaattttcttataagagaatgctacatctcttcagtctctgaacatacaaagcccagaggaacttcttgagtgtttgtatatttgagtgtttgacttcagaatctctagacggtggttgagtcttatcctcaggaacagaaagcaacatggtcagatgcctgtttgactccaagggcagtgctcattcaatgcccccaccccagctttctccactgaacctcgcagcagcattctaaagactgcaggagggactgccctggttttgcccccttcactccagggagtctgaacctgcttcactcaactttcccatctctaaaagagagacaaaaagtgcagcactcttaatgttttgatgcgtcattaaaacaaataaaataatccaaacgatgtagaagaaaattgttttactgacaaataataattatacatatttatggggtacaatgtaacattttgatacaccaagggatgattaaatcaagctaattaacatatccagcacctcacctacttaccttttttttcctagtgagaatatttaaaatctactcttagcaattttgaaatatgtagtaagttattattaactatggtcaccatgctgcgcactaacatttattcctcctgtctaactcaaactttgtaccctttgaccaacatctcctctttccctgtcccaccccgtacccccatccttgagtaatcatcattctattctctacttctgtaagttccacttttttagattccacaggtaagtgaaatcatggagtatttgtctttctgtgcttggtttatttcactaaacataatgtcctccaggcttatctatgatgttgcaaatgacagaatttctttctttttaaagggtgtctagtattgtgtagccaattcttcataatcccaagatatcattactatgtgataataaaggcaagcgtatgaagtaaaagaaactgtagtaggtcaaactaataagaaaaatgctgatctgaatgtctatacaatgcatagattgtgtttttaaaaatgcaacagtatataatttccggacctgctatagtcttgggaactaagcagtataaaacttggctagtgactagataaaatgatgatgtataacagacattagttacttatatgcttaattaatctgaacatttaccctacactcttattggcgttattaatttgttcaatttgttaaaagagtttcctaagaaaatgtggctttatttcagtacctattttgaatcccaaatattttttatattctggcttgataactgagtgactaagaggtttcagggccttgctacttgggtttgtatacaggcctaccattttctggctatgttttcttagattacttcacctctctgtaacttagtttcctcaatgataaaataaaaataataatcatggtcacctcatagggtagttaggaggattgaatgtgttagttcttataaagtgattaaagaaccaaatgcatagtatgttagttcttgtttatttttcttgaagttaactgtaggaattttaccacttacaatttacagtggcattgctctatgggaataatactacgtgggaggattctaccgtggtttttgatatagtttggatgctgtcctcctccaaatctcatgtggaaatgtaatctccagtgttgaaggtggggcctcgtgggaggtgattggatcatggggagtctttcccccttggtactgtcctcaccacagtgagtgaggtcctgtgagatctcattgtttaaaagtgtgtggcactcccccaactcctgctcctgcttccgccatgtgaaatgcctcacttcccctttgccttccaccatgattggaagattcctgaggcctccccagaagcaaaagctgctatgcttcatgtacaacctgcagagccatgagccaattaaacctcttttctttataaattacccagtcttaggtatttttttatagcagtgaatggattaacacattttatttcaaatttatatcctgtatagccttgcattatgaaaagagcacagaacaggaagttaggacatcttgctttgaggtctagaacagccatcaactatatgatcttgggtgagtcacttcacctctctgaacctgtttcctcaagaaaaataagcagagtaggctgcctgcgtgatctcaagacaacacactgtgctagaatgagtcttacagcaagagttcaaagttcaaattctaattctagaactcgttgagtgtaaaattcacagcaagtcatagaacctcttggaaccccagtttccacatctggaagaaggggcagaatagtatcaaaaatgcttcactcccaggaatgtggtgagcataaaattaaataatgaaaaagtcaactataaagcactaaataaatataaggtaaaactattaataaaatctcatttagtttaatatttctgctaaatctttttattttcctataatcttttccaagtatttgttcttctgcaggtagaattctgtgggttgaaaccagactataaaaatctgtgtgtttttttttttttttgtcactcagactatctgctatgaagaatgttttcccttagttaaggtaacagctataaatgttcagtttgcccctgagtcattatctgagtcatgattctgtatgagtcaagaaatctaagaaatatagaaattatctatttatcccctttcttttctttgtataaatatctctagatataaccaataaataacttgcctctatcttgggtttcttaatattttaaagagactgttgtagaggaatagggtaatgggagattatcttcatcaagaaagagcctgtgcatataacctgtacacacacacacacacacacactcacacacacacacacaaaatcaacaaaaccctatgctccagccagaaaaacaccttcttgccactaggcccctattagtgctggtccctccacctggaattcctgttcctctgatttctaactgttcaattatacctagaattcagggttttgttataatctcaaactttcagtgagatggattgagtggttctttgcccagtgaaaaatctttaaggccaatattcctttttttgcagatggtgaatctgacagaggaagaattaaatgacttgttcaaggtcacctttgaggaatttgcaggaagtttaacttatgtatatttttcccctgtagtaccccaggtatatcttttcaaatcatcctcgtctgaaccaatttatgctccccttacccatcaggttctcctgtaacacatatataataccacatgttgccttgcactatagttgcttgtgaatagatacctcccttcccagagagtaggtcccacagaagagtaactatcttattctccaaatcctttagagcttttagcactgagtacatacccaggtatcacaaattttgtatttgttgaattggagtggaacatctcaaggatatttttctattgcctttctatgaataagctcagttttgcatgagtccactttgattctcacctaaataagatcatgtagaaacaccaaaagcaccagtgtagatgcaagagatggtgaagacctgaggccttcactgctgcctcctgccagccctgcagttctcaaagaacaagggtcgttgggcaatccttccagacagcttctgggagtgacccgtccttgacacattgagttagctgtgctctgaaggcccaaagcgattcgaagcatgattttaatgactgtcattacttctgccattactaccacccaataaaaaccatcatcagcttgatgtgattatccctcggttgtgcagtgcctctggactccagcaagcaacagagcatatggtctttgccaatagcattattcatcaatggaggataaaattcacagtagcacccagcttgtcacagtggggaatggctttgggcaagtcacagcttcagctcagcttagctctttccaagatgtgggctcttattcacaatgcccttcataaaagtgaaaatgaaacacatgctgaatgggatttttagaacaataagaaccctataattaggaagcaatagctaaaattatattatccctgagagcaaagcatagtaacaagttaatgcaattactaatccagctttttccgaggtagaagcaaaccatgcaattatatccttagtctatattttttcaggggcctaatgacaggaaaacaaatgaagtggatccccatcttccacccttgcctccgctaagccatcagaggacaagtttcccaccccactctctccaatttcacttgaaaaataaaacaggcctccagctgtgaaatggattatgctctacaactatgtacctggaatagaagccatcattcttcatgaagtttgctgagaattatgtatcgcagcctggcagcttcctgttccctcgttagcctgcatatcccacttaacgaaagattcgccatgcactgacttgtatgtgactcacagtgtgcacagtatgcactgactgtgacctgtccccaaatgaacacagtaccagtctaacgtaccaccttacctatggctctctcccatacacacccaatccactgcaggcaaatgatctacccacaatctcccaaacacagtcttcactgtctggtcactgctcctttacacgtggcattcactctgcttgcagaggcattttagagtggatatctaaagaaggagatttctcccaagcatgcacataggagggcactggtctgatgctctgattgacagttcactactgcaaagaggacagatgagaaagcagctcagctctttgatgctaaggaaaaaacacagaacctcacttatctatatgtaatcacaaactttagtatccatcagtaccaagccaaaatagttcctgtttggacatacattattagaaattaacaacaaaatttagtaaatggttggccagttctgaacgcagaatagccacctctgagtgagcattttgatcaatctaactcacacatttctggttcaacaaagttattagatgagaagacccaaaacggtgtgtaaatgggacacagatttataaacagttaatttataatcatatatggcaaattaacctgtatgtcactaatgtgccaccaatcataagacatgccatcatttaatctgtcatgaagaagtgaaaaactcaattaaacggtgacatcatgcttcctgattagaaatgttcatttttttgttatgctaaatttacataaatacatatttatttaaacaacacggggccacaatatgaacatctatgcccaagtttctgcatgcccagcaatgactgccaccctgacaatggtgactgatatcatcaagtgtaacatgcatcctgattcaagttgttcaactgtgacacaacgggtaccttagcactgatgaaatatggtacccgcctgcgtcacatgagcttctcatgatccagcagcctctcctcacctgacactggctctagtccccagtaatgactctgatcctgtttgtcctaggagtcttctcttcctttgtttcccacttccctcactgggctactcagtaaccagttagctgttaaggcgcaagcctttttttattttaatttttattttttccaaaactcctcaacaattgcaattgccactttgtttctactattattgcccttgacttatttctttatttatttaagtttcttttgtttttaaacaagaaggctgggtacagtggctcgtgcagataatcccagcaatttgggaggccgaggcaggtggctcactggaggtcctgagttcaagaccagcctggccaacatggcaaaaccctgtctctactaaaaatacaaaaattacctagaggtggtggcacacgcctgtaatcccagctactcacatggctgaggcaggagaattgcttgaacctgggcagcagaggttgcagtgaaccaagatcgtgccactgtactccagcctgggcaacagagcgagaccctgtccaaaaaaaaaaaaaaaatctcaaggctgggcatggtggctcacgcctataatcccagtactttgggagtcacagtactcaggatcatctgaggtcaggagttgaataccagcctggccaacgtgatgaaacctcgtctctactaaaaatacaaaaatcagccgtgcatggtggcatatgcctgtaatcccagctacttgggaggctgacacaggagaattgcttcaacctgggagacggaagttgcagtgagccgagattacgccactgcactccagcctgagcaacaaagtgagactccatctgaaaaaaaaaaaaaaaaaaaaaaccaagagaatcttccatcatcaattgaaaaacagtaactgcccttattctcacccaggaggagagaatgaaaaaatgttatcattttaatatctttataattttagtaccatgtacataacatgaagtttaccatttaatcatttttattacaacaaaatattttttaatttttctgctattgttgtcatatactttacttccgtgcatgttataaacaccatgatacattgctataatttttccccaagaggctttcagaggtctgcaatgagttagggttgaaaaaacagtgatccaatgtgctagttcaaagactgcctctccttggcttccaggaagccttctaaacctaccttttctattagcctaccttttttttttctttccaatcttttaaaattctattacagatgtacagcaagatcaaagggaacaccttgtccctggggctttagctactggctggaagagaagcatagaaatgtctttaactctttccagtggatatcactaaggttatccaatcatcccatgaccactcggccagagggggtgagatcaccccaccacatcctttacatgcacacacacacacaaacacacacacacacacaaacacacacacacctttcaggcttactgttgcctttttatttactttgcttcaccttggaagagactgttaatgctcatgctaacctgatttcacctgtataaaaatgtccagggacatgtgggcattctgtgatttgtcctggttctaaatatccctgagggtggtcctgacccacataaaaacaagtctgcttcagagccagcttcaaagcctacctctctgatccccaaacctcaggtgatcgcactgtcctctggccagtgatggttcttagagtctgtacttcctatttgatatttatacgcaatggcgtgctggtaaatgtttagcacctggctctgggggtggagaggtaggagtctgggttcggcgggtttatagattcaatttctgtggtgtaaacactcccaccatggctatttcaagccaccagtatgatgtcactgaccacagtcaggaagagacgcagagtggcatattgttatgtagtatttctaccacacagatataatacacataaataacttcaagatcagagataatactgaaaggtaataaaacaattagtaatgagttttgactatttattatctttgttattagtatactttatttaattataactttatataatttaatttctaataatggctgtgtttaataaccagctcacaaaactggaaaacttagcaattggcttttgcaagccagtaggagcagctccagcccacaaaagtaataaagtatatgctatcttgtattattattttaaatcttttatgtccccaactaaattatatacttcagattatgaagttatttgtcttaaatacttctttttatttaccatgctgctaaacacaaataggtaattaacttctttttttttttttttttttgagatggagtctcactctgtcgcccaggctggagtgcagtggcaccatctcggctcactgcaacttccgcctcccaggttcaagagatcctcctgcctcagccccactagtagctgggattacaggtacgtgccaccatgcctggctaatttttgtagttttaatagagatggggtttcaccatgttggccaagctggtcttgaactcctgacctcaggtgatccacctgcctcggcctcccaaagtgttgggattacaggcgtgagccactgagcccagctggtaattaacttctaacattaataacgtttactcattgtaaatgtttttgagaggccactaaaattcaccaataacaaaatttagactgggccccaaatctgacccttcctgaatcatatctttaacctagaaagtttatgcactaaaaaaatttatcaaaaaagatatattggctgagtgaggtggctcacccctctaatcccagcactttgggaggccgaggctagtggattgcttgagcctaggagtttgtgaccagcctaggcaacatggcaaaaccctgtctctactaaaaataaatgaaaaaaaaaaaaaaagatgtattactgacagtgtaattgaatcatttctgctaccagctataagattgcctaccattaagagcagcggtgaccagctttgttatcaatgctgttaggaacattgattaactttcaaccccaacaagcaagcaagccaactcctatgactgctgaagtgagcgctctaaaagagagagtattcttggaggagggagccccgtggtgggtaaacaaactgagaaacttagctaaccaaacttgcaagaatgatcagtctctttataatttacggttaccaagaattggcatgtaacccaaaatgtcaacttattatcaaggagatactatcattatcctactgatggaatatcttcccagtaacaatgatattggtattcattaaccaggattcttccttcccagaaacaaggaatcagattagcaatgagaaggatatttgttgtgtatcaacatggagaatttaaaggtcttgaagcatatatcctctagatatgaaaaatccaaacgaactatctctcttccacagtggagtgtatctatttggtgcaaaagtaattgcagtttttgccattaaaagcaatggcaaaaacagcaattacttttgcaccagcctagtatctaatccccagactattaatatctaccaaagtgtgtctgtcatctatgaaaattactggtaaagtctgtgaaaattttcactgaaggtcagcaaaggcactattatctcatgctggagaagttacaagtgaatactagtactagtaactagtattcattaatactagttagctttgtacactacagttccatggcagagacagcttactgaaaatatgccccagttcagggttggcaaatacatagcacatgtgctgtccccatcccttcccatactcttggcagacatcactaattgatcactacactcttccttcattgagtcttacagttcttcccaacacagctctatatgcagcactaccaatcctggccctgagctccagaagaagaattaggaagcaaggcatgtgcaggtttctcacagggaggttaaggactacatggaactaagtgcattatttcaagttcattttgatagcttgctgttagaaggttaatgttgttgcctgctgctccttactgtaaacccctaggtcctgactaccgaggggatatcaagggctctatgttggctttggtttttctcctctccagtgttacaatatggagatgcctacgtcttacttacacagaacgaattgttcaccatcattttgtcagtgaatgtatgttttagaagtcagttactatgggtgcagcacaccagcatggcacatgtatacatatgtaactaacctgcacattgtgcacatgtaccctaaaacttaaagtataataataataattaaaaaaaaaaaaaataaaataaaaagaagtcagttacatatttaagcttcccttggctctttgccacttccactagagggcgccactgaaaaggaaaggaggtaaaactaaagggaagccatttttctccttagtgcctttctgttgcctctgctcagccttaccatccagaagaggaagtcctcaaccagtctgcacagcctctggtgtaccacggacatagcactctccacacaaacagaaacatctcttgctatacttgcccttctcctctgatcccaaacacccttcattcatctcaatcactttcccatggacttgttttccttctttcattagaaccagagctccatgagggcaaagctggtctttgtcttcccataccattatggtgcctggcacagagtaggtcttccatacacagttgtgtgttacaaacctcatgtgctgaaaaatcacaagcctcttattcaaggtgacagaaatggaaaccacaccaccttattaagtcgtagcaaattttccacaacttcataagcatgtgcttggaccctgctttctaattcttcaaaccaggaaataactcccacatgggcactagtgttctgctcttctacacagtggaattaagcttcttaactccgcatctataaggtttgatacaaaaggaaactctattgtcatttaacctgacgttctagcagttttccttgaagttctcacaggagaactttggggacaatcctctcatcaaaatgatttctagctgctacccttctcccaccttgaaattcttaaagtttcttgcccccttgttgactttaattatgttcttccaatagccttgtaaaattgagcaagttcccgacagcattttgaaaggccctgtgagctccctggtcagcattttcaatctctaattataaatctgcctgatggctttcacttaatacttctaaggtggggctgagggtaattgatggttttgaagctagctctttaatagcagccgtcaatgtatcaaggcttaatttctttcatgatctcagagaagttgctgcaagtggtgaggaacttatgttatcatccatcctaggaaaacagagagattttattagagtgtagtgaaatatttataagaacattagagcttgtgggactcaagaactgacttcacctcaaactttcatttgcatacttgcttccagggaaatctattatgggatggcctggatatatcactttaaaaatcctgcttttaatgaacaaatgagaaaaggtgagtagttttctctagaaagaacatttttctcacccactgtcttcccggaaagataaaaatatgctcaaaatatagcatagaaataaagggactattttgaaacagagacgaaaacattttaactcaagaaagaaacgtcagtgatgatggaggatttccttaacaagaagaagaggcttcactgtttgttcacaaagaaactcggtctctcagtctttagttgtgactttctgttttaccgaactattattttaattgtggcttctctgtgttctcgttgccttcccgtaacatttccatgttactttgttggtactcattgtccttctgacaagccatgtcagtctcttccacactgcctcttccatcaaatgtatactacagtaccttcattagcccattatagatgctatgtttattcattcattcaacaaacatgtcttgtgggtctactattggccagatgttatgaatacgaacacagaaagcagtccacactctcaaggaacttgcagttcagtgagaacttgactggttagaaaccacctggcaatgttacaaactatattacattttcaagctatattcaagttatcagagactgtcatcactcctccaagctagagattctgattagctgacacatttgcaacactgatctagtgaacaagatgtaactatgattccttgacctgaatttagaggcctttagtacaaaaacagtgctgggagagaaagctgagggaagactggtagaagtctggaacttcagcaaagaacagataaattcatagaaagacagatctgctttcctctagttcagcggttctagggtaagactttgtgcaactgggaattagaattttctggcagcaaagctgtatcagccctttacaggtttacctggaataattcacactcccttccttaacgttctacctggccaaactatccaggcctagcataaacctcagagcccacagtgagaatcatagtcacctagttgctctgacctactgcaataagaaaccaatgttttgttttgttttgttttgtttttatgaagtaaatgatgtttaatgccaaaaagcacactcgctttgggtagctcaagaggtgtaaattcagacagaagcctacctccaaagtacagagcagaaaaaagcattcccaaaaatgcattctggattttacctctccctcaagcccatgcttaaagtcagcatctgtgtaatgctaatgattagtaaatcaaaaggcatttatttaatggagccgcttcagtatgctgcagtaagttgccttctgccatatggctttgggtatgaaatgattaaactataatatctggagcctctgttgctggctatttaacggtgttatgcatcatgagctccgagatggctgcaaatctgttttcagtttgcattcccagcaaaaaaggactcctggcccagagggatttaaatcctcctccactaatcactagggcatacagaatcacactgatcctgcatatagttagtagctacagacaacccaatcctaactcaggaaagagacagggaccttcattaggcagccatttccggggtttaaaaacaaagaaaatgataatctgtaatggctaagaaagcaagaagaagggaaggaaggcccagcacagagcccttgagatgaggacaatttggggcacagtaaaaaggctgcaaactggaccttctcaaacactagtccattggctgatcataatcgctacctggcatggatagcatcttctctgccaggcactctgctaagcactttaacacatgctacctagggtgggtgtggtggctcatgcctgtaatccctgcactttgggaggctgaggcaggaggatcacttgagcccaggaatttgagacaagcctgggtaacatagtgagaacccatctccacaaaaaataaaaaacaaaaattagcagggcatcatggtgcctacctacttaagaggctgaagtgggaggattgcttgagcctaggaggttgaggctgcagtaagctgagatcgcaccactgcactctggcctggatgacagagcaagaccttatctcaaaaacaaaacaatacgaaacaaaaacatatctcacctctcttaatattcacaacatcctctatctagtaggtactactattgttcccattttactgatgacaaaacagaggctcagaggacttaagcaagttgaccgaggtcacagctggttagtggtggagctgaagttcaaattcaagtcggctagactgcagggccaaaattctctaactacagtcctagttgagcatcaccactagttccttaggtaagaaacactgatggtgaataccaccatcaggggatttttagtttcttgcttctaaatatgatcagtaaactatgtatgatcctcattgcaatgggtggacttagtcttttttttttttttttgagacagagtctcgctctgtcgccaggctggagtgcagtagtgcgatcttgggtcactgtaacctctgcctcccaggttcaagcgattcccctgcctcagcctcccaagtagctggaactacaggcggcatgccaccatgcctgcctggctaattttttttttttgtattttagtagagacagggtttcaccatgttggccaggatggtcttgatctcctgaccttgtgagccgcccaccttggcctcccaaagtgctgagattacaggcatgagccaccgcgcccggctgacttagtcgttttcaacaaatccttttgttggcttcataaaatccaaagttgagaaaccatttcaagtgctgttatatacaggcacctgatccagcaaaccatgcctagtatttaaatgatcccagaacttagaaagggcaaaaatagatagttatttcctgttcagaattctgcctcgatatggctcatgccattttatgtgctatccattatagtattgtaagtgttactaggaatataacccagttcctgtccccaagaatgttgcctttctactggagagactggaaacaaagaggtcagttatacttcaaagtataagcaatttaattcctcagtggaattaaagtaccatagacatggagagaatcaaaagagttcaaaagaaagccttggctactttgctatgtgcaagagcaactaccagagtaaaatcagaaaagaaactcttgttcatctattcaactcagcatgaataaatcacttaaaatcataattgttctggaactttgggtggctatgggcaaaaagtcctatagagaatttaataaaactgtaggctttgtatcaatcaattcctttggaaatttttagcataactcaggagttggaaacttccttcttacaaaagacagaggcactgtctcaccctcagccaatagcctcctccctcatgggtcctgcttcattaacttttaactggtgcttttactattcagtttgtacttttaaacttttaaagcttttatcagatgtcctttgaaaccaaagcataccattaaaacacacacatttccaacgtgaccagatttttttaaaaagacctattcacaaagaccttgagaggacaaagaatgtatttaatgataccaactagcatggcgccagtaatgaatggttctgttctgccaataatacccaaaactaaggcaatgatttttttgtaagccttgttttgctttagaaatttacagtaatatactttcccatatattatcttatttcatccttctgtcaaccatagcgccaagcagagttggttttattatccccattttaaaataaggaaactatggttcagagcatttaaataacagagccaggcttacacatgcagtaagcaacagagtcagcgccagaattccagctctctggtttccagcccattgccatttcaagtcagctatttatatcaaacaatataacttctattcttatgtgatctctgcaaggaaaggttgcaagtcctatttgtctttggatccctggcacctgacttgggacaagtcagagtttatggtggaccagaaataaaaacactttgttctagtgtctatgcttttcagtcactgttaccagttacgagggttaggctaacactaagaaggccaaagtttcaggttttaaatatgcatgggacagtgagttttctggtattccatggccacacaatcttgctaacctatcccaaaagggacctggcaggttaatggatagattggtccaatgtactcccctaatccatcgtccatgcttgaaatcagggactgtcactctcacaactaacttctcaggaaacatccttgcctgtagtctctcccaggaggattctgaggcagggccttgtagattggtagccacactctattcccagtgattctccctgtacccccagcctggtatagctaattagagcagagctggtgcttggttcaaaggctatggatgagcatccaaaaatctttgagatgtcctggcagaatgatacttcccaatggaaacagtgatttactgggcccatgaaatgttccttatcataaattcaaagtgaaggtgtatggtagaaaggaattcaccagggtgatgaaatgatgtacaacaaacccccatgacacatgtttacctgtgtaacaaacctgcatttatacccctgaacttaaaagttaaaaaaaagttaaggaaataaaaaagaatatagaccaaaaaaaaaaaaaaaggaatttgaggagaagtaatagagaaatttaaaaattaaaagactttaaaaaaacagagtgaatataatagaaaagagtaacttaggagtgagaagagagagaatcagagatgaagacacattgacggtagacccccaggggaggaaactcagggaagcttcccccctgggttccagccagggttacagagctgatggctgtctgctggaaccgaggttgggttttcttcccttcaagaccagttgctctttaatctttttggatcccaatcactttcatcatctgatgaaagatatgggtccttgtctcagaaaaatgtgtatatgcacattcagaccaatgactgcatttaatttcaagagacttctagatcccctaaacctgacttcagattcactagggacccatgggccacagggcaagaaatcttgtttaaactattagttcatctcagatagctatggtatcatagccatctctgaagctcagcatttagtatggggcctgaaacgtagcaggcattgcatacatcttggtagaatgattgagtgaatgaatgaatgaatgaatgaatgaataagtagatgaatgaaataaatacaacttgaagtttatgtcctactcagcacattgggagcatcctcttcttcttatgaaatactgtattaatgtaagctgagtagtatgtcaggaaggaatgcctttacccagatgatgtttaatatatccatcaacataattgatgggcacactgtcaccttctacatccggagctagaaggccattataccaccagttacatgcaaatgagaacttggaatgacatagcctagaagaacagctctactttcctagtagatatagaaatgaaaagcaactatgttttctacctgaaatatatgtgtaatgattattttgaactgtaagctactttttcctactatataacttgaaggcaaggttatgtgacatagctttgtacctgccccccttgctcactgccaatctaagtgtgttacagatagagagattttaattaaacttatctcatggactgtaacgtgggtagagaagacctgctttttggtttgtcgggtgatgggggaaaataaaagggaattatagcagaatataatgatctcaaactttaagtattgaagtcattgtttcaaactgattacatctaaaagtaagagtcaattctgtgagctattttttttatttcttaattcttgatcataaaactcccatatagtccaggcatagtggctcaaacctgtaatctcagcactttgggaggctgaggcaggaggattgctttaggccaggagtttgtgaccaacctgggtaacatagcaagaccttatctttactaaaaaaaaaaaaaaaaaaattagtcaggagcggtggcatgcacctgtagtcctagctacttgggaggctgaggctggaggatttcttgagcctgggagatcaagggtgcagtaagctgtgatcatgccactgcactccagcctgggcaacagagtgagaccctgtctcaaaaacaaaaaataaaaccaaaaagcctcctatataaaaagctgtgcttcaacctaaatcttcaataattagaattgcaaggtatggcaaacaattgcagttttcacgtagacagtcttcccctccttgtggatcccatgccctggtagcgcaagaagaacgagggcccaattcactcacagtgcaaaacttatggggttccatttgtctcagtacttccttatgggtaccagtggcataaaatattgtatggtgcttccacccaaggagcatgaacattctctcattaacatatttaaagcccagtaacagaaaatccatacttggcatgtgacatagctaaccctaaaaacctaatttttgctagctcttgagtcacttagcttacctaagcataacatttattttatctttttttttcttttttgatacagggtcttgctctgtcacccaggctggagtgcagtggcgcaatctaggctcaccagagcctcgacctcccaggctcgagctatcctcccacctcagcccctgaggagctaggaccacaggtgtgcgccaccacacccagcttatttttgttttgttttgttttgttttgttttgttttgtagagatgaggtttcaccatgctgcccaagctggtctccaacttctgggctcaagcggtctgccctccttggcctcccaaagtgctgggattacaggtatgagccaccacgcccagtcacatttattattattattttttaatgtgatttagcatattgctgctgtattcagcatgtgcctggggtgaaggacagtgaaaaaataattttctagctcggcacagtggctcatgcctgtaatcccagcactttgggaggccgaggcaggcagatcacctgaggtcaggagttcgagactagcctggccaacatggcaaaaccccatctctactaaaaatacaaaaattagctgagcatggtggcacatgcctgtaatcctagctactcaggaggctgagggaggagaatcacttgaacccgggaggaagaggctgcggtaagccaaaatcacatcactgtactccagcccaggcaacagagcaagctccatctcaaaaaaaaaaaaaaaaagaatttcctgaatacctttatgaggcaaggactttccaaagattatcttattgtattagtctgttctcatgctgctaataaagacatacctgagactgagtaatttataaaggaaagagggttacttgactgagttccacgtggctggggaggcctcaggacagttacaatgacagtggaaggggaagcaagcacatccttcttcacatggcagcagcaaggaaaagtgccaagcaaaaggaaagggagaaaagccccttaaaaaaccacaggatcttgtgagagctcactcactatcatgagaacagcatgagggtaaatcccccatgattcaattacctcccaccgggtccctcccacaataggtgaagattatgggaactacaattcaagatgagatttgtggggacaaagccaaaccatatcactcatcctaaggattttcttttttctttttttttttttgacccattttacagaccaagaaattgagctacagtgaggtcacacagccgagaatcacacagtgaagagttgggatttgagcctggaatactctgacctcagagtctggatgctagtctcttgctgcctcccctgtgttatgaggtcatgtctaaatcacctccgttactgaaaatgcttgtgaaagacctattctgctggatagagcagtcaccttagtcaaatatgatccaaatgttgccattaggtcctacccaaccccatcaaagatcagaacctggaggtgtggtaactccctccagtccagaaaaaaaaaaaaaaaaacaaacccagtaggtcagagtaaggagctgctctgagccatcagtgggagggttaagttaaagaatagaaagatgtaacctgacccaaaacttagctctcattttcaacaggcaagagctccttgcagggtgaccttgactcagacccacaatttcatcttttttttttgttttctttttggaatggcaataacaatgtctgcccagcatccaccactttaagttggtgtttacaatagaactgacacagccctttaagcaggctcttgcgtgcagagttaactctccccttgcacacagagcagatcgtcaggctccctccagccccaggacctttctctaaccataaaaaggcaattgtacctctaaaccccaaatccttacctatccctgctgcacccagctgtgcaaggtgagtcctaggaggtcacatcccacatgattccacgttttctcatcagtatcctttgctagttccagatattgcaacatcactactgttcaagattagaacttaagaacttgaaaaggtcaagaaagatgtggtgccttgtctccacatcaagtaaacagtccgtggcattggcctctgacaaatgacaacagactcacggggcagcagttgaggagctgtgcttacatgatacttaccatcctgagaagcatggatgtatggggatacccataccctggtaacccaaccccatgggctcagacagtgttgaacactagagaatcttcatcatttgctcagctgtcaccacttccacagatgcaagaaatggccgatggttctagaggatgaccccagcctctcaaatagaaaagggagtgtgttagatgtcatccagccagtcgtatagaaaggtggactttaagaaactgtggttaatgttggaaggaaacataaggcagcttttaaagctattttcatagtcttcaaagagaaataaatgaccagcgccgacggctgcagacagcaggacaggcagcctgacggagctctgtattcactttattctaatctgttgggggcaggggaattcatgggtccacactctatgaatccatgggtccacagactaattacatcatacattgtctgattaatcctcccgataattgatcctgctctggcatgagatagctgtgtgaccttgaaccaatcattaacctttgggcctgtcctcttctaatgccagggtaagaattatcaacatatatgttgaaatccccaaggattatgccaaggaatggaacagagaggaagacagtgagacatgttgagggggtagaggacttggatagagaagagtgaggcagagaagcagcgtaaataagtgggagaatatctagggagaaaaggaaagacaaattcaataagcagtttcaaagcatgagcctcaaaataaatgtctttcttccttgcaatattactgttttgtactggcttaagaagctagactatctcctgtctgcagaaaacagacaggataacaggaaacagttttggattccacagtgattatagctacttaagtttgacttaccaaatactgtctcaaacagatggtatgtaacatttgattaagggcttatcctgcaagcccgacagggaacatttctttccctcttaatatagaaaaaatgtagagaagaagggaaataaactgacgatcttgcccatgttccatgtataccaacgtttatgccttttctaaaatgaatctgtgcttattatgcaactcaagaccaaactgcatactggtgacaccatagaatttcagtaaaaaaggatattgaagatcatcctatataagccccttattttataggtaaggaaacagagacacagaaagataagtttgtttgcccatggtcacactgtggcacatctgggaccaggtctcctgattccaggtctggcattcacaccagtctttatatgtgcataatgttcaatatagggaaaacatacaaatctgtcagcaccattactactaaattagtgccaatctgtgatgagcaattatcagaacttgaagctgatgggtaatgccattctagtccagttaatgagccaaaagcttggttcttcaaaacacttaacattaatcagcatttggcttcagtttgtgacaagtgttttcaaaacatcacagacaattacaatattcctagctttgcctagtgtaaatacatgatgaaagaaagtcagaatttcataaatgacagtctccagaatggaaataatgagtcccttagagaaggtacaatgtgttcatctttcttgctagccaaaagtaatttgggaactaacgaggtcactgagaaattacaaagtgtgaacttctgctgggtgaggatgaaaaggcctcttttcacagtagcaaagcagagctagcacgtgagatcagccccatatgagtaatgaaggagtgacaccaggcttcatgcctcatcggccacccccacacacacccccttcccccttggttactggcaatgcctcaaaggcggggggctcccaagcatggagtactgaaatgctcatctagggaagaagaagcattccaagaggacttgggaactcattacacagtagcctgatgctgggaaagtagtagaagaaagaaaaccagaaaaaaaaaatggtggtttgtacgaagatgatgtcctcagctccaagctccacgtttcccaggacggttcttgcagaattttgtcccctaggatttctggagaagttgtctatgattgattgattgattgactttctgcaagccaagaacccaactgtggttaatattaggttttctgaaagacagagaattgcttaattaactgggcttaggatagtgttactcattagctagttttatattaataaaaatatgttaatcaattaaccagtcattgtcgatcacctggttaataactaatatttattgagaagtcattgtgtgacaggaacaatgtgaaatgttttcccttcattatctcattcactcctcaccatgagtctttgagatgatagtaatcataattacattcaggaatttattcgacgtatatattgagcacctgcttatcaatagacagttctaggcattggagatacagcagtgaacaggcaaaatttctcttgtctcttggatagattatatcaggtaactatcgctgcctaacaaacctccccaaaacctactggcacaaaacaattaacactaattattgttcataagtgtatgggttttccaagcggtttttctgatcttgatgggactcactcatgtatctgttgccacctggcagattagctggtctaagagggtctctactaggaaaactcatctctactccacaaggtctctcatctttcagcggctctcctaagcttattcttatagaaaaggcaggggtcccaacagaggggctggaaatgtacaaagcctcttgaggcctagattgggagctcatacagtatcacttctgccacactctgttagccaaagaatgtcatgagactagcccaggttcaagggtggggaaatggagttgacctcacaatggacagagttgcaaagtcacattgaaaacacagggtatgagaggtcattgatgcagaccatctactacatatataatgatgactaaaatgacactaaggaattcatggaaatatttcatttgagtctcacaataatccctggaggcaaattctattaccaatctctgctccccaaatgaggaaattgaggcctagggaggttacaaaacttgtctaagatctatgaatatttggtgatggcctcagggttcaaacttaagattccagtgtctgagcactgacccactatgtgattctctccagcctgcgcacttcatgagagaaagtacaggacatggtcactgcccgtaaggcacttatagtcctactggggatagataagtccctgaggaatcagtaaaaatacgtgtctctaacccaaacttggtaattgcccaacaagcagtaagaattaagggggccaggacaagagacagaagcttccataaagagattctccaatgaactgggctttgaagggtctaggcagtgaatagcaaaaggggagagttttctgataatggcatcctctcaccttcatgtaagggcttatagtataaacttccttttctttagaatggcattcagtgctgcaggcaatagaaaacctgattaacagtgacttctcatatagggatttttgtttgtcatgcacaacaagtgtgggaaaaagaagttcaggacttcacaatagccagatgatgtcatcaaggaaccaggttctttctgtctttctcctctgccattctacaaacataccccgattcctgggggtttcataatgccaggatggcagctgtattcatgagtattcttgtgcattctcaaataggaagaaggaggaggtgagcatgctagcacatcctgtccactgaactactttcccatgatttccacccattgtaccctccttactctctttggctagaactcagtcatgcgtagctgcagggaaagctggagaagctaatgtttcagttttctgaaactctgtaatatgggcaaacaagaaaaaaagggggctgtgaatgacttttacataatcaatccacagtgtcgatcccaacccgcccagcaccgtctcccagcactttccccagccactcctatgcaccagcaaacagaagtcctctgcattagtccattttcacactgctgataaaaacatacctgaaactggttaatttataaagaaaaagaggtttaatggactcacagttccatgtggctggggaggcctcacaatcatggcggaaggcaaatggcacatgttacatgatggcaggcaaaagagcgtgtgcaggggaactcccctttataaaaccatcagatctcataagacttattcattatcatgagaacagcatgggaaagacccacccctatgattaaattacctcccattgggtccctcccatgacacgtggaattatgggagctacaattcaaaataagatttgggtggggacacagccaaaccatatcatcctcattccaagtgcacttcaatcaattgttctcttggctcccttttttattttcataatgtcctcttgccttcatggactgttgaaattcttccatgactcttctctgatctcccgtagctggcatgacccctatcttgtgttaggccccttggtccttctgctgctgcccctgctgtagcacaaagcacattctgatttcatagttcctctactagaatgcaaactcttcaagtcaggggtcatgccctgtccagttttctacccacctttagaaccacatgcagctccaggatcatgcagacatgaaggaaattgagtgagcttcatgatttagcatgaggaggatgaggaaaagaaaggtggcacaaacaattgggggactgaaggagctgttgaggaggaaagaaaaagtctcctcttcccatttaggccctcttccaactgggcctaagaattaaactgatatatgacagattgaccggagaaaagcatacaagtttaattacaatttttacacataagcagggaccttcacaagagaatgaaggtctgaaaaattgaccagacagaaagattcttgctctgtttgcccagcctggagtgcagtggtgtgaacacagctcactgcagccccaatctcatggtctcaagcaaacctcccatctcagcttcccaaggtgctgggataacagctgtgagccaccgtgcctagtgtttttgtgccttttagacaaagaaactattaatttgtgaagaaataacaagacaaaagggtgttggccagggacagcaaattgtgaggaagtgactaagatacatagtagaaagaaccagaggaaaataagggttattttggtaactttgtttgtccagatccatttcagcattgattcccagtgcctggtgataagaatgttcctctctctctctgtctctttctctcttttcttctccacaccatgattctgtaaggaatgttcttctcttgctggttcagggtagacacctttctcatgggaaattttatggcctgtttaggttaaaaaaaaatgtggaggggaggggtggtcagaaagcccttcctgcatctgctgtttctcaagtgccttcagctcaaagtcatcaatctgccaaagtggcctattttggggtggcatgtcctgagctcctttagaacagatgacaggcacaatgctggtgccatcgtcagcaccagaacactgctgagttctgtttcagacttgttgagtgtgaggtgatcatggaattctcaaatagaaatttaaaacaggcatctactttcagaagaaaggtcaggatttctttttcttttttttcttttttttcttttttttttgtttgagatggagtctcgctctgtcacccaggttggagtgcagtggtgcaatctcagctcactgcaagctctgcctcccaggttcacgccattctcctgcctcagcctcccgagtagcgaagactacaggtgcccgctaccatgccaggttaatttttttttttttttgtatttttagtagagacagggtttcactgtgttagccaggatggtctcgatctcctgacctcatgatccgccccccttggcctcccaaattgctaggattacaggcgtgagccaccgcacctggctggtcaggacttcaattgtaagtttgatacaaagtggaaaaggctgaagatttcatccacagtctgaaaagaccatatgaaagaggaaggggtgagctccaaagaacaagcgtatgtcaaaagtagtggtgggcaaagactcaaatctaatatcactgaggcttctgccaggcagagagcagtggccgtctgctcaccgcagtggccagtgtgtctttgtgaagagcaatggaggccaggattgaggtgagtattgtcagtaccaactctaaatttcagattagctgtggatggaggcagtaaataagcaaatgcgtttgtccaatttccttacattgcaagttgcaaaacccacttgaagttgggtcgagaccagcttaagtaaagcagaatgtattggctcatgaaagagcaggatagctttggcttcagccatggctggattcggggtccaagtaatgtcctcaggactctgtctctttccatccatctctcatctctcttcatttttgattctctcttaatgttagattcattgtctctcactatggatggctttccccaggtatccaggaaaggtgacagaaagcaactctggtctatatcatctttacaatcttgtgatccaatactgaaaaaagagcctttctctctctctctccgcatttaaacatcaaatctcaaggaagaatctgattggcttttctagggttttctgcctcttcccattccaaaggaatagatttatctgattgactgaacttagatcacatgctaacttctctggaaagtgggggattccccataaaaaagtagttccattagcagaagaagagaagaaggcattctagacagaaaacaaaacaaaacaaaacaaaaaaaccagaagtcttctcttagaaggactgttgcaaacagggtttaatcatttgggtcctgcttccttgtcagtggatccagacgcatggagcttattgataagcacctgtggagacgtgtttgactcgcacccctgctgctgctgcgtgcttgcctgtttagctagaagccattctctacctttcagacgtatccccagcagaggaactgaatggagacttaggccagtcagtctcaaggctggttatttttagtaactggattctgccctagttgccttataattacatctgttttagattatatttggctcccccctccgtgccttcctgagctacatattggattccaactctgtatgctatttcttccaggcctagaatattattttcttctctcctgatataatccccttaccaagatcctatggctgggtctccactctttctttgaatggcagctgtctgtactagagctatctgcaactggatcctgagctctacccacttgccgagacttcttcctatctctactggttggaccacccctgcaccatctctgaaggctggttcagtctctgagtcccactccaccccgcactggccaatctccaattatgacagctgctaacgttcttataaaaacttccttagtctctaaatatagagggtaatcagaccacatggaacagaattcatggaagcacccaaactgtgtttattgcgttataaacatttgatcttctctgcagaaccatgaagaagtgggaagaatgcccagttcccctacttctttagcacactttgccacctgggccctgaaagagtttgtaccactggccaggtgcagtggctcactcctgtaatcccagcactttgggagggcaaggcaggtagatcacaagatcaggagattgagaccaccctggctaatatggtgaaaccccatctctactaaaaatacaaaaaattagccgggcatggtggtgggcgcccgtagtcccagctactcgggacgctaaggcaggagaatggcgtgaacccaggaggctgagcttgcagtgagccgagatcacaccactaaactccagcctgggtgacagagtgaaactccgtctcaaaaaaaaaaaacagtttgtactgctgaatggcagtgtgttagaaccttcataaaacagatcctactctttctgcctgagccttttcttccatagagttcagactttgtcatgggatagctgccctctggcccttccatttctcccatagctctttctaggcttttgtatataaaactcagttttcccttccttcaggaaaagagcaaagaactcatgcatatggatacacacaaatagattttctcaagtctgccccattaatttgccaaacatgcctgatgcctaaagagaaacaccagcagaagaataggttcaggttgaaatctctgcaataagaagagttgtgttactagaaaactgtttcccaatctgggtctatattactaaagcattcttggtatgtgtacgggatacctctcatgtaccacttcacatcctctcagccccacctccaagtgcagccactgctgcagtattgcgctccatgtagtctttgtccagcttcacatgagtgtaatctcatcttgtctgggtccccaccacatacctcttgcttcctgtaccaggtcttctctcatgccaaggtgcagtatatctaggggaacctgcttggcacccaaacgttataatccagaagtaagagcgtggctaaggctgttgggaccatcttgggccaatagatgacaggagttaatggctaggtagttcctccgttcctccttttgtcttccaggcatgctttttttttttttttttttttttttttttttgagatggagtctcgctctctctcccaggctggagtgcaatggcgtgatctcggctcactgtaaccttcgcctcctgggttcaagcaattctcctgcctcagcctcctgagtagctgggattacaggcgcccaccaccacgcccagctaatttttgtatttttagtatagacggagtttcaccatgttggtcaggctggtctccaacccctgacctcgtgatccacccacctcggtctcccaaagtgctgggattacaggcgtgagccaccacgccaggcccaggcatgcatttttgagacacaattcataaggctgctcagaaggttccagtgagatagaagaggagttgtctgtagctgtggccaaaccagtaactcatcctcttttgggcttttcctccttccctgtctcacatcccttgatccccactcctcttctctggaatcactgattttttttttttttttttttttttttttgagacagagtctcgctctgttgcctaggctggagtgcagtggcccgatctcagctcactgaaaccttcacctcctggattcaagcagttctcctgcctcagcctcctgagtagctgggattacaggtacccaccaccatgtccggcaaatgttttgtgtttttagtagagacaaggtttcaccatgttgatcaggctggtcccaaactcctgacctccagtgatctgcctgctttggcctcccaaagcactgggattacaggcgtgagccaccacccccagcctctgagatcacttttcaaataaaatatctcaggctctgctttcagagccacccaagacaagagagtatatcatggcttctttgtaattgtctaacagaaagaataaaattttggtaccaaagagacctcatgtcgaattctaacagtatgactgaaaacaaattatttagccatcttaaaacccaatttccttatctttagtacacagataacatgagtggcccccatgatgtttgtctaaatactaaatcagatagtctctctgagaagcataataggtatctgacacagagtagcactcagtcagtattcattctcttctccttattctcacccgttgttctgatagaaataagaactttttaaaaaagagttataaagtagaaatgaaaacagacataataaacagacggttgtatgttcaaagaaaacatactttaaatatgcatacttactagcatatagatggatgcatatgtaaaaattcattaagctaaacacttaaaatttgtgtgctttatgtaagctatgctgtaattgccaatttatttttttcaagagataaggtcttgctctgttacccaggcaggagtgcagtggcaccatcatagctccctgcagccttacacttctgtgctcaagtaatcctcctgcttcagcctcctgagttgctgggactacaggaatgcaccacgtggttattttttgtagagacagggtctcaaactcctgggcttaagcaaccctcttgtgtcagtctcccaaaatgttggtatcacaggcgtgagccactgcaccaggcttgtaattctttttaagttaaaaattgtatggatgtactaaatactccctaaaatgaaaggacacattattgttctaaaatgcatttaacatacatccacaatgggatgaacaaatgggttcttatttctatcagagtaggaactctttaataagttttaaatgaaaatgcccttattgaatatatatattcaaaacaaagtgtttacgtatactaaaccatccttgtttttcttttcttttgtttttagttgagacagagtctgtcaccttggttggagttcattggtgcaatgatcgctcactgcaacctcaaattcctggactcaagtgatcctcccatctcagcctcctgcataggtgggactacatgtacccaccaccacacccagctaattaaaaaaaaaatttttttttgtagatgcagagtctcaccctatcaaccaggctggagtgcagtgttgcaattataactcactgcagcctcaaacacctgagctcaagccatgagctcctctgcagcctcccaagtagctggaaatacagataccatgcccagctaatttttatcttttgtagagacaggagtcacactatgttgactatattggttttaaactacagctcaagctatccttccatctcagcctcccaaagtgctaggattacaggtgtgagccactatgccctgaaacttttatgaaactaaaagtttcatagtatgaatgacagattctttaagaatctgataaaaagggaacatcacatttttaatctcttgcatacttttaaaaatatgtcaacagagaaaataaaagattggatatttatatcagaaaaactaatcgtggccaggagtgaggcagaggtggtggggccggccagtcatcagagccaactcaggaggcgggacattgacacgaagggaggactttggcttgatctctatggaaatgggaaggaaagccttggtcttattagcggcagataaccaactgagataatcaaccaacagtggggtaagaaattcaacagtgaagtaaaacaaaaaagtgcatgccatagaagtcaccacacagccagagttggcggcgctgcttgaacacctcagagtaagaaggaaacccttgtcaaataaatgctaggatgctatcctctcaggtcttgacttttactgtactagcttctgttcttatcctctttccctcctaacatcagactggggaaagaggaatcatggaagacgggatcccttagtgcaagagcggaaggtgtcaccatctcccctcagttctctctgcccaccacatctaggggagtggcaatttcttgagtgccaccaccagtgccttgcacaggcagggaggcactcacagtctttgttgggtttgtggaatggatcctgtgacctacagacagtgatggggtgcaatgggtgctatcctgtatggaagtagagcggtagatggcccagtccttgtctggaggcattcatgatgcagttgagaagacaaaaaatgcactccagcaggggcccactgtggacaaggcttcatgccaagtgagggaacccagaaaagtatgtgaatgatgaccagtgtgagggtggcccagaaatggaaaaggaaggaaatatcatgggaatgatttgcttacattataagtatctaagggcaaacttgtacaatgattctaagatagtgacaattactgctcgaaagaaaagcacgtatcacttttgagatatatgccttcttgtaacacatctcaaaatgccaagaaaactacacacaagcctagagacaagtcagtagatactaaagagacagagccatattaaaacaggttgtgagggtagcagctatggcaggagctgagggggtaaaggaagcccatccagagagccgaatcttccaggttacggaagtgtagagccaggaagccccccggggccttccaaagacccacagcatgccgccagcctttgggtacctgctacatgggagcacccacaagccaacagagtaaggctgtggcacagcatcaacatcgtgaaaggactgcagatgtgagcaggcagctgagagacactgatcccttcttcttcccctcctccctacttgacacactgaaagagcgtaagaaagggtggagtggaagagagaagctgtgaaccagaatgagatttaaactatgcagacctacttttttaaaacggcaaatttctacaatctgccctagatgttgttggacagaaaaagggattagacatagcaccattgaaagtgctgattaggggccaggcacggcggctcacgtctgtaatcccagcactctgggaggccaaggagggtggatatcttgaggtcaggagtttgagatcagcctgaccaacatggcgaaaccccatctctactaaaaatacaaaatttagccaggcgtggtagtgggtgcctgtagtcccaactactcgggaggctgaggcaggagaatcgcttgaacccgggaggtggaggttgcagtgaaccaagatcacgccagtgcactccagcctgagcgacagagccagactccatctcacaaaaaaaaaaaaaagtgctgattttagggaccaagaagtgaacccattccatgtttatgcccccagtatgttgcaatttcccaattaactgcttcctgagaggtcagtgatgtaagagaggcgtatatacacgcagtatccattcatacaaacaaagaattgatttgaaaagattcaaatagtttcagggtaggataaaaacagcgacattcacagggggattcttattgtgccctggattgaaccaagttcattatcttaatctatttcaccctcccaacaagaattgcattatccccatttctcaaatgaagaaaccaagactttaagagactttgagagctaaggagtctgaagtcctactgtttgtaagtgtctagtaagtggctgtctgccctcaacctcctcttattgcttgtcctaagccaggattcattaaatcagtctagttttactttccattacctgattttataaatgtttaaacttagtcccagagaaattaaaagacttgactaaagtctttagtattcagtagcagaggagagatttctaacataaaaagatcttccaagttttactacagggcttgtaataaaaccattacaaagaaaaagaattattgcaaacttgcctaccaacatgtgataagcacttttgttctgagccgtgattgtccttaccttaagagaaacatagtacaaaaaaggtgactggctctggctgtcctcttatcgagagtgggcaatggaggggctttgtacaattcttgcattctcagcatctagcatagtgcctggcaaacagtcattactcaataaatgtttgctgaatgaatattatatataactcaatattccctggacacaaaaaaatagctcttttcccccttcacattgtggagagaacactaatgaacagattgactttgttttttctgccaactcacatcattccaagttttatttgcgtttgtaatacagatgcatacaagtggactcatcatccatcatctcgtctgagctaaccaccatgacatcattaccaatccccagataccaaggccagatcttctagatcagtctctctacatatgtgtattgctttttcctttgcattacttatttcctttttgtactatagctgatattccaggagctgactcctggaccctctttgcccccagtgactttcaaggtgcaagattctgttgcctctcttttgctgatagatgttgctgaaaggcctgtgtggaaacttacaaaatcaaatgagttttcttctcctccccttctgttaaattctaactcaccatccctcacccatacctgaagcccagctctctcccgcaggcagtctctgccagccaggccaggcctgagcttgttctctgcgtgtctgaagcagggagtcctaaaaggaaatattgctctcattccaaagttgcttcatcttcatgggcaaagaaaaaaaaaaaagcagaggaaggtaaatgcagcaactctgagaaattcttagttgattatttactgttgcttaaccttcaaaagattccactgtagaaagggagggccggtattcatacagttcctagcccaggtaacttctctttcctagacctgctagtccagttagcttgagctcatttgcaaggaggccaattctgtgacccctttcgtttcccagaatgcctcacagtggacactcaaagcagtcgacttgctaacaaggctaaaggagttaggttttacatcattcctgaattattgatgtgctttgcaaattagcttttcctgtgcacatgactctccttagctaatctttacaacatataagacagttgtcaaaactgttttgaaatatgattctggggtttcagagtaccgtttcacgggacttgagttttcagaacaaatctctgtgcagagataggaactattctgcttaataagtattattattattaattatctgaagcaattactcaaaatacctaaatgcaatttgcaaagtagtcaggtaataacaccatgtagaagttcatgttaagagctaccatttcaatgaatgtagggaacactatccacttttctcagagtccttagaaaaatatagtaagtgaaaataaaggccgggcatggtggttcatgcctgcaatccaggcactttgggaggccgaggcgggcggccttatttgaggtcaggagtttgagaccagcctggccaacatggtgaaaccccacctctattaaaaatacaaaaattagggctgggtgcagtggctcatgcctgtaatcccagcactttgggaggccgaggcgggcggatcacttgaggtcaggaattcgagaccagccaggctaacatggtgaaaccctgtctccaccaaaaatacaaaaaaattagccaggcatggtggtacacacctgtaatcccagctactcgggaggctgaggcagaattgcttgaagctgggaggtggaggttgcagtgagccaagatcacaccactgcactccagcctgggcaacagagcaagactccatctcaaaaaaaaataaataaaaaaaaaagtagaatggtttattacacataagaggcaaaggcaaaatgacacatggtatacagactgaaccaaaatatcaaaaataacaatgcactcttttctttttttcatccaacaagaagccataactttatttatgatagaagcagtacaaatttcaaaccaagctgcagtcactcatttgagacaccaataaaagttgctttcagatggttacactgttaattccataatagcatttacaatattattactttgttcttccaggctccaactgcctttgctctggacacattcccttgtgacatgaccaattctatgtccttaacttctacacctgtttcatcaacctcatcctcttcactctccttttgtacagttggagtctgtgtgttttcttgaacatttaagacagcttcaccctgaactttgaatttcgcagcagttgctacttgtgcttgctgagataaatcttcaatcttggcttctgccaaaacgatataggtatccgaagcagggctcttgtagacatctggtttcgcgatgacaaagaggatattcttagatttccagatagtgactctagtaacccctataacctgtcaaagacccagtttggacatagccttctgtgccttcttttcactccaactctgttgtgctttactgactggttcttcatcaatttcagctgctgccaccacaatgcaccctttattatggctataccagttaggaagagcaattggatgcaaatcacagagatacctcaagcagctaaagaaaatcaatggttactatcacacataagaaagtctgaaggtatgcagtcctctgtcttttgtatctgccatccttaacctcatgacccaagaaggaggctggagccctaggcatcacatccatatcccagaaaagaaaatgggaaaaaggacaaaaggggtaggccaggcaaggtggctcatgcctgtaatcccagcactttgggaggccaatgtgggtggatcatttgaggccaggagtttgagaccagcctggccaacaatggcaaaaccctgtctctactaaaaatacaaaaattagccaggtgtggtggtgcacacctgtaatccctgctactcaggaggtcaaggcaggagaattgcttgaacccaggaggcggagcttgcagtgagccaagatggcaccagtgcactccagtctgggtgacacaatgagactctatctcaacaacaacgacaacaacaataaaatgttcattattgactgaaattctaatttaactaagtgttccttatttgatctggcaaccctgaccacccaacatctcctgggatttcattagtcacccctactgtgaaggaagatggaaaatgtagccttttagccaggcactttcccacgctgcttattctaccaaggaagacatggagagtgaatactgggtaaggagccaacagtctttgcaggagtgagggtggttctgggaaaaagtgacagagctacatccatgccccatgccctctgtgaagaatttcttgactgcatcagcctcttgtggtcactgtgacctctgaaagcctatggccctttttgtcttagttctattaatagatacaaagtaaagattactgatttttaattaacatgtaagaactgatgtattcaggtggctactgtcttcttcaaagggttaaacacacaatattgccactcttaaaaacacttttagaacttagagctggtagaagcagaagtctccctttacaaggcatacgggaagctgcaggctgtaggcagggccagggatgcgttggaaatttgctaactctgagtgcttcaacaaattgcattctatgtcaaactcatgccattcctcgtagaaagaccaatttcaaatgtcctcactcatatggggaagccaaaaattataacaactgaactcatggagatagagagtagaatgatggttaccagaggctgggaagcgtagcagggagcaaggggaaaaatgggaatggttaatgagtgcaaaaatatagttaaataagatctagtatttgacagcacaacagggcaacaacagtcagcaataatttactgtatattttaaaattgctagactgtatatgtggctcacgcttgtaatcccagcacttcggaaggccgaggtaggaggatcacttgagcccaggagttcgagaccagtttgggcaccatagggagacctcttctcttggaaagactcaaaaattagccaggcatggtggtgcatcagcctcttgtggtcactgtggcctctgaaagcctatgaccctttttgtcttagttctattaatagaactgcatgggaggctgaggccagagaatcacttgagcccaggaagtcaaggctgcggtgagcagtgatcttgccactgccctccagcctgggcaacagagcgagaccctgcctctcaaaaacaaacaaaaatgaaactaaaagagtagaactggaatgttcctaacaaaaagacataataagtgcttgaggtgatggacaccccaattagcatgatgtgatcattatacaccacatgcctatatcagaacatcacatgtacccctgccatgaatacatacatgtattatgtacccataataatcaaaaattaaaaataaaaacttacactatttctccccagaaccttctcctacctttgtaggaatataggattatcttccaggatgtcaatagctctggccagtggggaccagactgatgagaagcagctggtttaggaaactgatgttggaaagctcatggcctctcataactcagtcatctgtggcctgatcaatgtcactaaagcatggtttgtactctgtggtatgtcctagaataaaggtagggaacaatggaggaaaacaggcctgaattaaaatgttctccatgtctctctcgaaaaattccaacttggaagtcccttttgcctgatagtgactgcttacagttcctacccaatgtaaactacagttccatgtttttccccctggctcttaactggctgaacttgggatgttttataagtgtctgtctgtacttcctatgacagccaatcacatccaacctatcctcaggtcccttccccaaattaactctgtggtccactgacttccaaaagtagggtcaaaattatttttctaagattaagccttaataacgtcacttatatgtttcatcttttcctggatggctactgggcaaaaatatcttcatgcaggtgctgataacagtaaacacatcatatatcttcagcctggggtttaaacacattcatttctgggtttgtcatatgttctctcgctatttatactgctttgggtcagctacttgatacttaataaaatttgcctccaagctgtcctgcagggaaaatgacctatctggggggaatgctgttccaactctataacctctgatgattgcccaatagtcctccaaaaaggttgcagggcaggagcaagggaaggtccatgccacttcctggcatttaatggcaacaagtgctttagtgtaagtataattatatcccctgctttcaggaggcctttccagccaacctctcggacacgggagcaactgtagatggcatgagcaatgtggaaattcggcttctgctcaaggtcagaacaagccgttcaccagcgttgattttaccaacctttcggttattttggaaagccgaaagagaacgcaacagaggcaagaatggatctatgggatggaaataaggagccatttataacccaaaatgagactgccaggaaaaacaaacacacagaaaagtacattttatcagaggcttgggctgcccagggctattggggtacaaagtactgcgtgttcagctccctgggccaagagctacagtaagtcaggcccccctgcaaagctcctctcctgtcagccccatcaagcagccttagccacctggcggagacaagctttagtgtttttaaagtgtgtgctgcgtgaatgtttcacatttttggtaaagatgtggggtcatgttgcaacacttaagtgcttctgcgtaaaccttgcgcaattccgacaggcactgggttcctagcatcagtggcatcctctgctcacatacggcttatgtaatgtgtgatcaggccccccaggtttctccttgtagcctttgaaaaaaatttcaggctctgaacttggccctggtttccggcagttctttgctccgaaggtgcgtggaatggctcagctgtcagcacctgctggtgagatacagaaaagtgccacgggttgatctttctctggcaccagtacacaggaggctggcgatgctccccagatgggcttggcccgccctgaggcaccctatagggaaggagagtgagggcggttcatctaaggaagagtaggtcggaggattgaacgggggctgctaccaataggtaacaaacatgaaaaggatttccccaaagcaaaactttctagccagagcagcagcacagtgaatggtttactcacagctcctttgtctgctgatgggagatttggcactgtgcttgcctcttgggcttacctgagcaaagttacacagtaggtcaagtgtttgatgccttctcacctccagtcactgtgctggcgcccgcctccgtgcctggcttctgtttccatccagacttccatccattcaacaaagctttcgagcacctgctctatgccaggtgctgtgccaagtgctgggcaccaggcagggctttctcaacacctggtggccccctgtggtgcgctggaccagtcctaacacaggcctcctctccagtgtcactctcggccccaccatttcccaaaattatccctccctgcattcacttcctatgactcttgtcctttcttcaaccttagggatgggactatttctttacagtttttatcatagaaatccaacaaattttatttttataaaagaattgttcttggtagtcacagatttctctctgtggaatctgagtttctgcagattaaaaagtgatgatgtgagctgggcgctgcaggtggtgcctgtaatcccagctacttgggaggctgaagcaggaggatcacttgagcccaggagttcgagaccagcctgggtaacagagagacccccccatctctaaaacattaattaattaatgctaattaattatttcaaaaatggtggcatgaagaaacaatgtcttccatggaatgaacaaggcattaattgaaaaatgtgaagcaggaaggaacaggggaggaatacattgtctgagcagaatctacaatttcaccaggtagacaagttgcccctttcacctctccatttattattggtgagctgtatgtgtaatggttaaggaggcaaattctggagctggactacctggggattcaaatcccagctctgaaggttataatctaagaaagctattgttatttgttccttaatttcttcatgcaaaaagagggatggtagaaatacctaagcacatctcacagagtggcttagggattaacataaattaatatgtatgacatttttataacaccgggatgcacagtaagcactctctatataaatattaactttgatttttcgtgaaggcaactctaggctttctactttgcagtcagattctcatggcagttactgcatgcgaaagacagaatttgttatttggcctgcagtttccacatctgcaaagtaggaagaaatgattgaataaagatgtgggggcggaggctgcgttctggtctgtgatctccacttgcttcgtgaccttggacaactcacttactctctctgcatcctggagattggacttgatctgaatttcccaaactcaggtcattcaaataacacttagagaatctttgccatattccagtccactttcctatactcagctactaacttgatgttttcctttagataatccttaaatcaattcactttcatatgtagcctcacaggaagcagtaatatccacgtatgcaagagtccgatatgctacagatttttgtttttcctttatttatttatttattgtgatagcgtcttgctatgttgtccaggctggccttgaatccctgcctgggctcaagcaattctcccgagtagttgggactacagttgtgtgccaccacagagggcatgatacactgtcgatttttctaatgcatgttaaaataaatgcctaatgaaagttttaaatgtttgtataatgcccaaatcatcttgcatcctatcaatgagatgaggacaacatttctggaaactctggatcaaatgttccctctggatccaggcaactgtaaaatctataatgttataccatgttcaggtggctatttaacttagggtatgtttctttataccatttgcctccttgagagctcagactgtggcttaaacctctttgggcacgtagcaaatagaagagtgcttgataaatctgtatttaatgttaaattaaaagcacaccatacatacatacaaatatatccatcgcctactcacccccagaccccatccactgccaaaatgctcatttctttctctccacctcagtgtcactgtgttcctcaagtggctgtctgtaaatgaactgaagcatgtggcgttccaggccttgtgtgggcactcaggaaatgttaccttccctgacccctttccctcttcctgtgcctctttgttcatgagttgccatttgtctgtgtgaaaagtgggccgacttcccaaggagtttatagcccaagctcttgggtcagaataattgttgtcttcaatttcagccctaaaagaggttccattgccaggtgcagaaacttctaatctaagaaaaaaagaaagtatacttctaaaagctattattaaagagatcttgaaaaactgtctggtgatttcctaaaattcatcagcaaaaattgaatacacacccacagtatcatgaccccattgtgggttcacggtctgagaatttcacaaccaaccagcatttactaagcatctgcttgagccctctctgtccataaccttgggagacacaaatctgaataaggctatctattagaccatgagactagaagagactaaaagactgaataccttgaaagcaaggaatatgtcttcatctttgcctccccaagggcttagcaaagcatcatgcatgtggtagttatgcattaaatatttgatccgtaaatgaacaaatggatgaatgacactgctccagcactgaaggagcttacagtctgtttgagaagaaagaagccatagataaacgatgggttaattaacaataaactccacattacaagagataacactggctaataaaaacgttaaatgaaaggggtgctgtcatttactttcccccaaaacaccaaatgttgattcagccgcaggtctcaaaaaagaatgtgtgttggccactcttctgtactttcatttttctgcacatgagtccaactttagaaggaagttgctaggttgttgtcatgtgactgatttttatttaattaattaatttatttatttatttttgggacggagtcttgctctgtcacccaggatggagcgcaatggcacaatcttggctcactgcaacctatgcctcctgagttcaagcaactctcctgcctcagcctcctcagtagctgggattacaagcattgccaccatgcccagctaatttttgtagtttcagtagagacagggtttcaccatgttgaccaggctggtctcgaactcctgacctcgtgatccacccgcctgggcctcccaaagtgctgggattacaggtgtgagccaccgcacccggtccatgtcagtgatttctaaaggccaccaaccttgctggctcctgggaatgagcagggtattatttaatgtaaataaatcagcgagtgtttatccttccatgcattcttctgccatccacaggcaaagagagaagtggcactggtgacttttttagagctatgaagttggaatatacaagagaagctgaaagctttcaattaatgatttcttaggctttaagtcagggtgacccttcaacataaaagggctttagccaccacttgctggggagaagcgctgggctttctacacagttctctgggactccaaattgttagcataaaaatagcagcccaaatcaatgttctctattattcattagttaccgaaatacttttcccaaatatacgcatagctgaaagatgccttctttcaaaatgttttaaaccactttcagcccatgaatcttagtccatctttaaagggcacccattttttttcaaaccatatatttcagtcgatttcattgggcactgataccatcaccagcaaaaccctaattaattgggaagaatgacatttccattaaaattctttttgaaaaatgatttatgcacctggctgataaaaatttcaaacagggcaaaacaatatggagtggaaagtaaacttccatcgacctctggaacccagtctcccaatctttttcatagaaacatccagtgttaaatttctggggtatcctcctagaaatactctgtgtatatataagtgcatacacacaaaagaggtctttaaaaagtttatggaaaatgcatattatgaaaaaactatgcatggattttcatttttcttgcaccaaaataaactcatactaacctgttataacatgtctgaacagaatctagttgaggcagtaagaaggataagacttcagtttgaaaagcgcctctgtcagagcaacatgaattctgctaaaattgaagcaagaacaaacttcaaatctagggtgaagtttgcatggaagaacagtgaaatcattgaaactgtacaaaaagtgtgtggggacactgccccaaagaaatcaacagtttacacatggctaattccttttaagaagagatgagacgatgtttaagatgaagcccacagcagcagaccattcgcatacattttggaggaaaaagttagtattgttggctcatgcgtataatcccaacactttgggaggccaaggtgcgaggatcacttgagcccaggagtttgaaaccaacctgggcaacatagtgagacccccatctctacaaaaaatttaaaaattagccgagtgtggtggcacaggcccgtagtcccagttacttgggaggctgaggtgggaggatcacctgagcctcagaggtcagcctgcagagaaccactattgtgctactgctctccaacctgggcaacagaacaagaccctgtctcaaaataataataataataatattgtttgtgccccaattaaagaggactgacagttaggaacataaacctaattataaacataataagcataagtctaattatagccaacaccatagacatctcaattggttcagcttacacaattctgaatgacaaattaaagttgaacaaacttttcactggataggtaacaaaaccactgcactcagatcagctgcagacaagagcagagctttcaatggaatttttaaagaagtgggatcgagatcctgaagcatttcatttaaggattgtaataggagatgaaacacggcattaccagtatgatcctgaagatgaagcccaatcagagcaatggctaccaggaggtggaaagggttcagtcaaagaaaaagcagactggtcaagagcaaaggtcatggtaacaatttttgaagattctcaaagcattttgctgttgactttctggaaggccaaagaatgataacatctgcttcttatgagggtgttttgagaaagccaaaactttagcagaaaaaatccaaggaaagcttcaccggagagtccttctccaccgtgacaatactcctgttcattcgtctcatcaaacgaggacgattttgtgagtttcagtgggaaatccttagacatccaacgtacaatcctgatttgactccttctgactttttgttttctaatcttaagaaatatttaaagaatacccatttttcttcagttaataaggtaaaaaagattacattgatatggttaaattcccaggaccctcagttctttagggatgcactaaatggccatcactgcttacaaaagtgtcttgaacttgatggagcttatgttgagaaataattttatatttttatttttatcttttaattttttccataaactttttgaagtcccctaatgcagcagtcaccaacgtttttgtcaccagggaccagtttcgtggaacaccatttttccacggaccagcatgggtggagggcagttttgggatgaaactgttccacctcagatcatcaggcattaattagattctcataaggagtgcacaacctggacccctcacatgggcagttcccaacagggttcacactcccataagaatctaatgcccgctaatctgacaggaggcagagctcattcgcttacctattaccttctgctgtacggcctggttcttaataggccatggaccagtaccagtctgctgcctggggattggggccccctgccctagtgtgtgtgtgtgtgtgtgtgtgtgcgcgtgtgtgtgtgtgtgtgtgtgtgtgtgtattgtgtgtgtgtattcccctccccttccttacatatactctaacattcttcagtgaaacttaacagatattgtgaagtttgctgcaaatctgtacagctgcactatatttcataatatgagtgtcccataatttacccagcctcttctgaatagacataatggtggttttcagttttttacttccacaaacatacttttgcacatatgtatgactaggactacagaatcaattccttaaagtggaattacagaatcagaggatatgtgagttttcattctgatagacattgccaaatggtgacacttaacttttgatgagaactgccaaaagtaaagtatttgttcgtgccagaaacagagtgaagatagcattttattttaaagtttaatacctcaggcaagcaagtagcacatttattcatgaaactcatttgcccctgtcttgcccacctaaagcacatacacattgttatgaacccattcaaaatatacttgtgacaacagcttactcaatgaggaacttgctagaaatttcgtatcaccaaattgtgtgagtatttgtcgcaatggggttagcttgcacgctctctactttgccctggctgtgtttactacctttcatggccctggtcagttagtaacactgtcttgtttttcttttgtaaccaaaggtcagtttgtgaccctgctccactccccacctcctctgccttagtttcttcttgccttagtttcctcataagagtaaccagtcttaaagtgtcagggcaggcacattactgatgtatcagtgaagagcccctgggcacaatggaacttgaatttgattttctattacctgtgagggtgagttagtaagcagacagccttgtactctgttcagcggcttcccttgctgcctttctataatgaaaaaagcagagacccagaacattctcccgtttctctagtgtttacccaacacacactctgtgctaccatccccatttgtggcttctttcctatttgctcttgtaacatgagaaacagtgtggaggttttatgcttgttttgtaaccagctataaccatttccttttctctgcctctgattataaacacatttccttcctggtaaccattgaaaatctatatctgaccaggttgaaaccaaatgaagtcattttggttccattggtgacaaccaattaaatataattctgtttacatttagaatgggttgtaaatttaagaaaatgatttaagccctacttaaaatattttttggctcataaaaccatgaaatcatttctgtaatatgagtaatcaagaagcttcatatttacatttacctttaaattgctctaaaagagccagagactggacattaaaaacaaacaaacaaaagattcagagtctgcaaggaagctatttcactatccccatgctgcgagctggttaagctctttagctcagatagccctattttctcagggagcaatggaaaaaacagatctcctacttaaaaataacagtaaaaacaagaaacacactgcactatattggtaaacctcaaactcacgtaagtcagttacctgccccgatgggagtttagaagttggtgctactactcttagtactgccataagatgtcaccagaaaacaggaccctgagttctaggaaaagggataagaatggacaacaggtgggagccaccaaactattccaggccggatgacagaaaccttaaaagaaaagttccaaatacaattaactgaccaaacccctccacacagtggagaggcttcataatcaataaagacaacttcccacctctgagcacttacaacaaagatgcagatgtatctttggcagtggacttttttttattgagttctatctccttttcttcacaagcatgtattaagcaagttttatgtgttatactttcactgggtgttgtgcaaagactaaaaagtcatcagctctgccccatagtgggtggttgttaaatgttgttaaatgaatggatctgtgaatatatgcatgtgtgaatgaatgaataaataaagcttataatatggttatgggagaaaacacagctttaattttctgttacttgtcagggtggtgtgtacagaacacagtggtatgcgtgaccagttctacccagggtagtgtggcaagatctcagacttgaggtgacaattgaatgggcgttggtcagatgaaaggagtttaacgtagacaagtaaaagaccacagaatgagcaaaagcctaaagcagagatcaacaaactacagcctgtggaccaaatcccatctgctgcctgtttttgtaaataaagttttatttgggcagagccatgctcatgcatttatattttttccatggctgctttcacactacaatagcagcattgagtagttgcaacagagaccacatgacccaggaaaccaaaaatattaactatctggccgtttacaagtaaatgtctgccgccctctggcctagagatatgaaagagctgaatattcaggaacctgtagggaagtcgtaatagctgaaacttgtagtccaaaaaggggctcagtgagagaagagacaaaacggtgatcagaggccaaccctgaaggttcttctgtgccatattaagaaattcagttttgccatcgcatgttctcactcataggtgggaaatgaacaatgagaacacttcgacacaggaagggggacatcacacaccggggcctgttctggggtgggggaagtggggagggatagcattaggagatatacctaatgtaaatgacgagttaatgggtgcagcacaccaacatggcacatatatgcatatgtaacaaacctgcatgttgtgcacgtgtaccctagaacttaaagtataataatacagaaaaaaaagaaattcagttttgctcctttaggaaatgggtaacaagagcaattttgcttttagaaatatctctcagggatcaggatagacgagagagatgcaagtttgcagcaggagatcagctctccaaacttcacatcttataaattccttgattcaacaaacattgaaaagcttaatgctgtcattatgcctcttgctctatccttgggaaacagaacctggcacacagacatgcccaatcaatatttattgaataaaggaattaaggaaagaaaaaagacaatattgtaatggcatcattattaaatggttttctgaataggctgcctctgctatgagacaaatagctgagattctcacagatttccagtttccatactagcaggcattgagatccaggcaaaaggaggttaatagtgaaacacaagccagagagaaattcctccccttcatctctggtgccaacatcatcaaataccagtcactggccaaacctgtgtttattccatgccctgtggcctaatgagaggggatgggacaagaagcagctctgctaataactgtcatgaaaataataatatcacttggctgtatgcggcaactttcattggaagctcttgaatcaattttttcctcttgcataactattatttccattttatttccactaaaggagaagccaaaccacagagtggttgtgacttgcccaaggtcatggagcaaatcagaagagcagtttttaaaagctgagaaggatatcaggggatgtaaaatccagttgccttcccagcctagaatgggctgggttcatgactcagtaagacacatggcgttacctaagctcagtgtctctgaaaatgagtcacactaagggagactcagggcctgaggggctgtgtcagacatacgttttcagtagtcactcattgtccctgcccatcagattttaacgtctgtcaccgaagcccatcacagacagggcctcttgggaggtttagcctatggaactgggaaggtctgccttgggggtgtctgtcttttctggatgtttacccagctgtcagttcctatgaagcccaggtctccccattccattatccatcaggagcccatggctggggtagctgtggcttccactcggtccatgatgattctggtgtttgcctgttgtcccagcataattactaataaatcttttttttactctaaaaaaatgccccagtttggaccataaattaattatatggtcactctaactgacaaatcaggaagcacctatgcagaaaccaaaagccctcttttcatcatgatgattctatctcagccacttttgtttcatggacctagaatcttgaacttacaataggcccaaactcccagtcagttaaggaatctcctctgagctatgtaaatgctcctggtcatagagttagctacacagcccatagaccagttaattactaattgtgaataatcacttccttaccttgtaccaaaatctgccttccatatcttttatacaatgatcttagcactattctcaagaagctgaaaagtcaattctccctcctgtcccataagagagcccccttaagtcctccgttgtacagcccaaacaccaccaaccatcaggaacaaattctaaacagcatttaggaatgtagctttggagtcagacatacctggattcggatctgggctccatcactccctagctagatagcctttggtaaatacttaacttctccaatttcactttctttgtctgtaaattttgaacaaacattaactacttaagctaggcatgactggttatggaaccaatagctagttctcctttctttcttactaacaaggggctcacttaaatgctcttggattacccaacttccttgcagctagatgtggtcatgcaacacagttctggacaaggagctgcaagtggaggtaccagctggagtttctgagaaagcctgttagagggcacacatccagcttgcattcaccttgtcagtttgtgctacttagcttctcccttctttcaaatacttcctgcctaaaaattagttgtgaagcacaaaatagaacagctatgctgcatacatgaggaagcaagcctccagcaaaagagactgggttcttgatggcaccatggggcctgcatactcactctgaagtgcttacagctggacttcctattacatgagaaaaataaatccctccattggttaaaccattgaaattgggtttctgccacttgcagtcaaatgaatcctaaatgacacatacttcagaaggttgttttgaacataaaatgaacttactacagtgcccagcacaaaacatatagtgaatggtttgctattatcactatcataattattatcattgctactcattgccatagaccttagagagaggggcaagaacatgtagctatagcaatccttccaacctctgatagcaccagtacaaaaatatctgtgatctcttaagcacacacaaaaaagtcagttgctgatgttttgacaagtgcatctctgttagtggctaatgaagccagttcttcaaagcaccagatcccgagagcacaaagaaatgaaattccacctggctggcaggtcagggagcaagttctttcctgtagtgaagggtgcgcctggtttcctctctggacaggggatccatccatattgtatagtgcatttcctggaagtgctgtcttctctgaacgacaagcaaagcacaacaccttaaggatgtcattatttcatggaaagagagtttctgctcagaaaccaaagccacacctaaaaccagctgagcataggagcacatgttcaaatggagcactgggaagtggaattagctttctataacctcactgaagcatctgccaagatcagacaaggatgggactagctatacattcttccctggagtccatcaagccacagatttgggttcacgggggcctatcatggtattcatcccacctccacctactccctactgcactctgcagatataaagagtggtgaagtgggaaaaaaaaaaaaaaaaacaacaagacaaaacaaaacatcataaatttcagagttcaacagacctagggttcaaattccagtgggtcacttctaaactgggtacctttggacagaccatttgccctttctgagctgcagtttttgtatctgtaaaacagataagagtttcacaagtttgcagaggattgaaggagaaagtctgtgtggcagtacctggtacagggttatcatgagtccttctttccctatcagcaggatggtcttggctgactttttgtattcatcacccaagcccaaggagtggacccagctcaggtcactgccaccaagggcagctcgtttgttgccttctaccccgtgcatcatcatccaagtttttgggccacacttggggagccaaagccttctccaaagctgaggtcataaagcagaaaaagacaaagctctgctttcagagagcaggtttggttggcagtgagcaaaccacctctctatagccaatctgcccttgggtatgggagtgagtccccagtaaatccagcaaaaagtggctggcccgctcagccctcccacctaccacagccacgcgcaacacctggacaaagatctaaggcctgggaagcagctttgcccagcctctccatctccgggcacagcccccttggggcacagcctcaggcaggatggaatatgacagtcacaagattcacacctcaagccacaaaacatattcttctcccaacgtcacctggcaggtgtcatcgtagttggttttatagctacagtggcaaacacagtgttttcttcacctctgtgtcacaggaatggccactgttactctcctcacttttaaccactggagtatctagggacatttgtcaacagggtttgtggatattgagactgaccggatattcatacatacatttctctgtaactccataagctggcaacataagaccatgcagaaaccagaaatttggggtccatacataatggctccacacaaaatgtgttttgtcacagagtataagaatagataaactagtaatagcaaacaatgtgctaactgtactgcaggctctgtgctgagcatgtcactttctacaattattattatctccattttacaaaaaaaaaaatcccttgagtcttcttggtgtgttctagatattaattctttataggtttagatattataaatcttttctcactctgtcacctttttgttaactttgcttgttgtatctaccctttacagaatttttaatttttaaaatatagtcaactctatcaaattttcaacttatggccaggcatggtggctcatgcctgtaatcccaacaatttgggaagccgaggtgggcagatcatttaaggttaggagtttgagactagtctggccaacaaggtgaaaccctgtctctactaaaaattcaaaattacctggccattgtggcacaagtctgtaatcccagctactggggaggctgaggcaagagaatggcttgaacccagaaggcaaaggctgcagtgagatgagatggcatcactgcactccagcctggtcaacagagtgagactccatctcaaaagataataataacaataatttcaacttatggtttgtgtaatgagtaccttctttaacacctctgatattttagctttgtaattttacttttgcactgaattcctctttggcatatgcttgagatagtgaacgaatgagctgtttctccactaccaagtagtaggttttaggcaatccatcccttccccactgattgatggtgccatgtttatcccaaagcaggttcctatgtagactcaggtctggctctcactctttgctctttccctagatgtattttactatgttcttgttccatactgattttatatggaagggtgagttccttctctttgctcttctttttcaaaatgacttaggcatcatgaacatttattccttcatatgaattttagagtaagtatgttgaagtcctaaaaaaaagacttgtaataattttgtctgaaattacattgaatgtataggttaattgtgagggaaattaacatatttatatttcgaagatgtggtgtatatttctatgtattcagatctcttcaaagcaacaactgagttttaaatttttcttggtaagttctttgataggttatttcctacatactttagagtttgggaatcatatcttattttttaaaaaatatttttgagatggttttgataaagaataataattcttaggccaggcacagtggctgatgcctgtaatcccagcactttggaagactgaggttggaggatcacttgaggccaggagtttgaggccagcctgggtaacatagtaagaccctgtttctacaaaaaaaattaaaaattatccaggcatggtagtgggtacctgtagtcccagctatccaggaggctgaagtgggaggattgctttagcccaaaagttcaaggttgcagtgtgctgtgatctcaccacttcattccagcctaggcaactctgtctcaaaaaaaaaaaaaaagcaaaacaaacaaacagaaaaacaataacaattgtttaaaagtgatcaggtattcatcatctctgctgaagtctcttattctatttagtctattgattaaatatgctgatacaaccttttatttcttttttctctccttttccttttttcttatcttcctgtcttgcccagaaactgggtaagcgttatatatatatataagaagcacaaaaatacgcttacttcaaaaaatatataaatgtgcttactcaaaaaaatatatatatatgctaactccaaaagctaataacttatcgaacttctacttgaactttattcccaaagagatgaacatattgaaataacatgattaacccacaaagctgataaagtgtccattgacttaaatgttcctccttagttatgtgccaagcattgtgcctctgtgtaacagcagcacagaaatggcaatatacaaaacaattaacagttaactgttgctaaacagtaacaatgaaagcaggttgtgtctaaattttcttttaaatcccattgtgtgaccctttacaactttcaaataacttccatacccattacaccatttgtgtttcataaacacatattagtagggagaacaggtattggctcattttataattaacattcaatatggttgggttttggaggatcaaaaactagaaaggatcaaaattcatattcaggtctttaaagcttcaagttctctcactataacaagctgatttatatataaacaaaatatataaaactacgtgattcaattcagtaacactgaattttcatttaaatctcattccatcctgaaaaagatgatctgatatcatcctatcatttttaaagaaaactgtatcagctgatattaaacgtctaaacattttcaaggtgtaagagccagatgaccatatcaattagggttgtaattctactaagaatttgggtctataccatggcaaaacagtcagttaatttggtcagtttaggtaaacaggtcagttttgtgggagggagggaaattgggtaagaaatattcatcacattaattttactaacattgcaatacaactaaaaatgttatttggttgggcatatttaaacatttaaaagctgctgtaaagataatattgttacctcatttttataagaagaaaaaactaagtaaatccatttcttgggtgtgcaaaaatagcccaaggggaagtgacagacctgtgaacagaactcatgaattaaacctgagcttggtctaccagttctctgtaatcaagccccatgattcactcatggaaatcaatgcctcttaaactcactgaatgacagacacctcaacagacacacatctgtggattcccatagctcctttaaaagtaaccatcaggaagcaattagggagtgcatctgtctctaacagtcaaggtatttttccttccatttcttgcatcttctcttagggaatgtgtaacggatcgtcctctcttaatggtgctgttacttggaatatacaaagtatgctgacttgtgaaagggtcccaggcttaaacagcaggaaaacacaaataaagctgtattcaaagaagatgaatcaaagtatctcagaagaggaaaccagaaaattgtaatctttcttaaatgcagctttgtgagctgagtaataaaatacaataatgtaactaagcaggaggcttacataactgaaaaaatgaggggcaaggaactgttccaaatccattgtacttattagaacctctgatttcctttgaaatggcacatgcaataaaatttactgtgagctagctaacaaaaaaatctcatttttatgggaaataagtattgtcagaaaaacgaatagattctattttaaatcctgaagattataaaattgaggttttaatagatgaagaaaaaaaaaggctccagaacagaggcatcatggaggcagtgatttctatttaatcttttatctgtaagagaaaaaaaaatcacctcaattgaaactaatatagttttctgtggcagaatataccacgatagctaataatgcactggctgtctgtattaagtgaattttctttttgttaaaaaaaatcagtgcttgttaagcacatgaactgtgcaagtttatatctggccaactcctgtccccgcacctgttcattcaggcattagccctaaggacttacaaagcaaatgaatgtatccgtagagcaatgggtaaaaataaactgaactattcttttaacactatcaaaaatgatctgaccaaatagaagatcacatttcacgaggtaaaatagccaaatgagatgtttcctcacgttttatgattggtttggcttattcactgcgtatgaaatagctgaccttcattccaggagaatgagcagcaaccaaatttaatgctgtttgctcaggggttcaaatctggtttagctggtttaattgcctctgaggcaaagtttctaaatgtgctactgttacacagagacccaatgcttggcacataactaaggaggaacatttaagtcaatggacactatatcagctttgtgggttaatcatgttatttcagtgtgttcatctctttgggaataaagttcaagtagaagttcgataagttattagcttttgcagttagcatatatatatattttttgagtaagcacatatatatatttttgaagtaagcatatttttgtgcttcttatatatgtataatgcttattttatatatatataaaatatatattatatatataaattatacatatataaaatattctctataataagaagttcccggctgggtgcagtggctcacgcctgtaatctcagcactttgggaggccgaggcgtgtggatcacgaggtcagaagttcaagaccagcctgaccaacatggtgaaaccccatctctattaaaaatacaaaaattagccgggtgtggtggtgcacgcctgtaatcccaactactcgggaggctgaggcaggagaatcgcttgaacctgggaggcagaggttgcagtgagccaagatggtaccactgcactccagcctgggtgacagagtgagactcagtctcaaaaaaaaaaaaaaaaagaagaagaagaagaaattctccaggacagacaattataaaatcaactagtactgtcactccctggctcactattctttagccatattggcaatggattccttgaaaaacctagatgtggttgactgaatcattgttcacaatttttcacatctttcctatattagataatgtatccacattcatctacattcttccaaaataccatccgctatgggtaaaatattttccccatcccactgattttgggctgggccatgtggcctcctttagccaatgaagtgttcctgaacatgttaagaggccttaaatgtgcttgtgtgattccatttgggctcttgtgctcctgtcatgtgctatgtaagaaacatgttcctggaagctattggtcaacacagaatgagtaacacacaagggagacctgaaccctggagtccagccaagccccaccagttgcagctggctcacagacccatgtggaaggaataaatgcttattgtttcaaactagagttgtggatagttggttgtagcacactgctatagcaaaatgtcatctcagtgcctcagcacattcccttccctctaccagaaatcatcttccacgaccactctttgcctagttaattcctactcatgcttcagaattcagtttaaatgtcttgaccacaggacagatgtcacaaaccagattacctgccccttcacatcctgggtttcctattttgtgagattcatcacttttgcaatgttttgcttcatgtcattcaactagaatataagcttctttaagcggtgggaccacagtatatttttcattggtattattcttagcacacgacacacaatgctaatacaaagtagatttaataaatatttgttacctgatttttaaaaaaggccatgtggttctactacttaagagttagaaaagaaacttaatttgtatgagttttggttttcagcaactataacatgaacacaataatacctatctcctaaaacagtgaggattaaataaaccaaccattaaatttaatgaatttgaggaaagacttgtaagtatctgacacatgggtgcataaaaggcatttgacaactgacagcttttattatggttggaaagataaatatatttgccctctgtctaagaacttgatttattttaaagagatatttttgcaactcaaaaaagaaaaaaatcagattaggttgcaacttatgattatttaatttggacatttcaaagtatcctgtttacttcccaggctctgagtcccttttagaagcactttcaggtagaattcagctaagaagaaacaggttggcgattgatacttggtttatttcaaacatttgtcattaaatgactctatccttttaaaaaagaatgaaattcatttttgctatttatgtttatttctatttgtattccttcccaccatttttgctatttaaaattttttccctgcttaattaattttttagagttggcacttacttattttcaaaatgtttttcttcattcctacaaatagcttttggaataggattttatacaacctaaatcagtttttttcttttgccaaaaacaatatgtatccactacaaaaaaattagaaaatacaggtaagtgtaaggaaggaagatttaaatgtttgtaatcctgccacccagagatatccactgaacattcctccagatagtttgattcaaatgcatatatttaataatggtggaattatgttgtacatttgcccttttgaagttaatatttcatttaattaccacaattatctttctatgccaataaatattcatctacatcttttattagtagccttccatcataacatcatttacctgagcaattccctattgttggaaatttagtacattttacttttttcttttactgttatcagcagtatcttcatgaataagtgaagagataaaaatgagttactcaaacctttagaaaacaccacttaatggggtcttgcagttcagagcagaacagatcattatcccaactgtaatccaaccctttccttgcatttcttattgtgagtctaggaccatcattggaaaataatcaagtttggtaggtgggctaaactagaatcagagaatttgaggcaacactttcatttctggtctcaataatgaatgtgtaaaccagaacctacaaatcgactcatgatcaaaaatatcataacagaaagcaggaattctgaaatgggaataaaggaaagagaaggagacctacagaccactgttgctctccctatctgcggctaccacgtccatatttgttttgacaaacactcctttaccacaatcgggtctctggtatcataagcactgactttcccattttacagataaaggcactgaggcacacacagaggggctgacaacagtgtccacagtgccacagttagtagcacagccagggtctgagcctgtgtgttctgcctcacagacaagtgctcttttcatgctcacagagttctcagtaatactgggaattattcagaagagggaacaggacgcaatgcagcagggagattagcagaaacataattctcctgagagtcagcatggaggtatttgttagctactcaacactggtctaacatcctcggtaagaggatcataaatacctctatccacctccctagggcaatatgagcattattgcttatttagaaatttgtccctgtaagagctttgatattctcaaaggaaaggtgctgccaaaaagtgaaaatattttctatgcttccactatgcacgtgagagaaaggagatttggatcaggtaaaagaagtattgtcaggcacataaattctttatctaatcatattaggataatactcctgagctccttgaatggaggcatcatgagtacctgctgcgcttagcacataccttacaaaacactgaaaatcttactcaacacaatcagaactgctcattaatgagctcatcagtaatgtcagtcaagaaaaaaaaaaggggatacatttatgttgtaaatgtaatcagtcgacaggttcttcccgcctgatgcacagaagaaatcaattcactgacaccatggtatcggaataaaggatgagtttagttaatgcagggctgcccagtggaaggactggcgttatcactcaagttggtctcccagaaggctcagaggctaaggttgttcaaggatagtttggtgggccagggactagagaatgggtgttcctgactggttggggatgcaatcagaggaatgtgaaaaaattatcttcatgtgctaagtctgcctctgcgtgagggccacaggacaggttgagtcatgagtcacaagtccaggtggggttagtagattgccagaatgcaaaaccctgaaagacatctcaaaagaccaatcttaggttctacaataatgatgttatctataggagcaattggggaagtcataaatcttgtgacctctggccacatgactccttagcagtaagagatgatagaaactctgcctataccttagcagaatccaggccccttccataatcctaatcatgtggcttttcattagtcttgcaaaggcagtttcagcccctgaacaaggagaggatcagttttaggtaggtactattatgatccttgtttcaaagttaaactatacactaaattcctcccatggacagcttggcctacacctgggaatgaatgaggacagccagcctgtgaggctagaagcaagatggagtcagccatactagacttttctcactgttgtaatctttgcaaaggtggtttcataaacattgtattttattttattttttaatctttttaagatggagtcttgctctgtttcccaggctggagtgcagtggtgtgatctcagctcactgcgacctccatctcctgggttcaagtgattctcctgcctcagcctcccaagtagctggtatcacaggcatgcgtcatcacacccggctaattttttttgtattttttagtagaggtggagtttcaccatgttggccgggatggtcttgaactcctgacctcaggtgatctacccacctcagcctagcaaagtgctgcaattacaggagtgagccaccgcacctggcccataaacattatattttaaattaaataaatataaatgtatttaccaaactggtggaaggccatggttctttccctcactatagattcactggcaagggtccaataccaccttttctggcctaaaccacacccataagatctcatttttcatttccaacttttctttctttgtagggggtcagaacttaaagacactcatgagcaaaatactgtagagtttattatttttcctaatctcttactgttaactaatttaacattagtctttccaaagcattccatttaaatgtcattttaataattctctctctcttcaccctcatgttattaaagtaatattaaagtaaatagcataattttaataacaagtaaaaccagcacaaatatgtcagggaacaaacaattctgattctcataaagcacaaaactcaactcctcaaagaagaaagggatcagtgaggacagatggacagctctgttcagtgtgttttgagcaccagcccaagccttacagagggaatggatgctggttccctctatgaatctcttaagtagaagttggtttaaagagtgcccaccatagttttttttttaaattagttaattattaatattaaacagtgtatttgtggacaatgacaggtgacagtcccaggtaggagtttaaatcatatgtatccattcatactcaaagttttaaaatcccatcctccctacccaaataaatttccagagtctgtcaacttgcctgtctacataatagatatgaattcacattatcctgctcgtaggaccataaaagacccagttactcaccagggaagcctcttaagatgagagggaagagctagaagagcaaattaaatctcaacttttattttcttcctactacttacaaacattgtaagctttcttattatttcttattttctgtctcccaactttggaaggtaagttctgcgagaggaaggatttcatctccctcacctacctctgtattcttggcacacttagaagagtgcctggcacagagaagttacataataaatgtttgttaagtgaatgattgatttaatccaggtaaacacaacatggatgtttgctacacaaatttgatcccacttaatggttaactttttgtttttccattttttaaataaatttctacactgttagaaatttttcaaatttcttggcaaaaatataccatgcaaaaggctagccagattttaatcttgtctaaatcaggtcagaaaaatcacttttattccagaaaacacaaagggcaaagtacaatggccagagctgtataacagctacactcaccaggtgtgcaaagcgatttaatattgtcattcagactcagccctaatgagcaatcttgtttatctacaaaactgtgaacaacccactgctaacaaccggacattgtccccaagcccagcacacttcatgtcaactctcgatgcacccacaatctaggaccgttattagaacttctaataaggaccatgatagaactgctgagaaataaagaaaaaaatggatttcatgcacgtgctttaaaactttatgtttagttattttaagcatatgttttgttctggtacacttagatttgcaactgaaaagagaaaggcatatcagaaagaagttttttgttaaagcagactgatgaagaaaccaatgctagatggaaagcacaactcattttaagttaccggagaaagcaacagaaagtttctccaaaagaaagaaaaaataaagaaagaagcagccaattggagagttacttatttttattatgccaattaaaaagatagtcaaggggccaggcacggtgggtcactcctgtaatcccagcacttttcaaggcagaggtgggtggatcatttgaagtcagaagttcaagaccagcctggccaacatggtgaaaccctgtgtctactaaagatacaaaaattagacgggcgtggtggtgggtgcctgtattcccagctacttgggaggctgaggcagttgaacctgggaggcggaggttgcagtgagccaagattgcaccactgcactccagcctgggcgacagagtgagacttcaactcaaaaaaaaaaaaaaaaaaaaagtcaagggcttcatgccacgtctttttttttttttttttttttgagacagagtctcactgtgttgcccaggttggagtacagtggctcagtcttggctcactgcaatctctgcctcccaggttcaagtgatcagcctcctgaatagctgggactacagacgtgtgccaccatgcccaacaaatttttgtatttttagtagagatgaggtttcaccatattggccaggctagtctcgaactcctgacctcaagtgatccgcccacctcggcctcccaaagtgttgtgattacaggtgtgagccaccatgcctggccccacatgtctccacagagtgaacatgaccacgatctttcttcaagcatcacctttgatagcctttcaatatagagttatgggctttacttcaaacattaactcgtcttccacattcagttatcaaagccattgaatacaacctttaaaacattttgcaagttcagcacttcttctccatcccattgatactgattcagactctgctcctcattgcaatgagctgttataacagctcctgaatgatatacttgccagtgctctatccttgtgctaatccatctccatgaagccaccaggcttccctctgacccagactccctggcataccatttaaggctttcaccccaactcaacttacctccgaaatccttttttttttttttttttttttttgctctatcgcccagactggagtgcagtggcgcgatctcggctcactgcaaccttcatctcccgagttcaagcaattctctgcctcagcctcccgagtagctgagattataggcgcccaccaccacgcctggctaatttctttgtatttttcaatagatatggggtttcaccatctaggccaggttggtctggaactcctgacctcatgatccaccagcctcggccttccaaagtgctgggattacaggtgtgagccaccatgcccggcctgaaatcctatttctagtcaatccccctgcagcatatattttatgctttaggcacaattagtagacagtgggctacatgagtctgaagcccagtgggacaatctggagcaactgaacatttgtaaatagagtagttcacgatttctgtggtggatactgtgatgcgccactcagatccttcaagagcatgatgctcattcttccagctgcaggggagtgctgactcacagctaactctctttccaaagaagctgccttactcaagctcacatcccctccaaactggcagcccatatccagtgactggttgaggcagagcacagaagcccagaccccttgccttgatggcagataactctgaagggtgatcccagcttgaggactcatcctgcgccatgggctctgtgttggctatattatagcttaccttctccttctgtccagtcctgcttcccttacttccaaggaattcttccctataaagcttctgcataggaatcttaggcacagggcctgattccaggaaaccccacctgaggtggttttatttacattttactcgaaatattattatcttataaaaatgacttgctttttaattaatgtttatgcttgaccatttcaacttttttaaggtttcattttaattcaaagtgtttaattgaaaggaaggaacatctgtatatatttttaaagtattaattcctatccagctccacaatcagatattgcttaaaatattggagtcagaactctgaaacctggctccatcatttcccggctgtgtaatcttcagtaggttacacagcccctctgtgtttccgtttcctcacctacaaattgaggataataacaacaaaatgatcctaaataaactactgggaagactaaatgagttatcatatataaagcattaagaatgatgcttagcaaaaatacatgtgctaaaattcattagggtaacactagctgctataacaaacagacctaaaattgttcaatgacttgactatataatagatatttcttcctcatttgtctacacggttttacaaggacttaggttgatagatgcacagttttcttcactacatagtttctccatcccaattggccagaaaagggaaagaacatgaaggagtatgtaccagagaattctacggaggtcattcttcctgctcaaatcccattggccggaacataatcacatggccacacctaactgcaaaggaggctgggaagtgcaggctagacaatggattgtaatgactagctgtctatacagcagactttgctgtactgataattattgttatcatctcattattaccaactttcgagcttgggctcttatctccacttacctagaatgttgcaaaagcctcctcactggtctctctaactccaggctatttgccatcccaaatccttcctccacaacaaacccagagttatttatgtaaaacaccaagtctgatcttttccctcaccgtcctccagcttcagtttaatatccttctgtgacctccccactgcctcaggttccagtcaagtccccttcattgccttcgtgactcagtccctccacatccctttagttcatctccaaaatccccgcccaccttgcagcgggtgtttgcgatttgacacccactttgtgcctgcaacagtgctggacataggctactccagtgaagaaagcgggcgggatccctgctacattttaatgaggtagcagaaaaaacaagtaaacaaataaatatgtaatattaagctataaggagtacagtgaagaaagatacagggtaaaaaaaaatgggggcggtgagctaaatgaacaggtagtaaataacagcttaaatttcacgtgcaagtgatagccattctgcagcaggatgcattgtggactttttatcttcactatcattacccacacccctgagactgcatattacaaaagagttcttatcattgacctatatttgcattccttttagcttcttttatggctgttattcagggaaataatatagagcactaaagattgcctaatgtgctatttgtgtgggatgctgagagaatatcatttgctattgccccacggggcagtgacggtacaaatgactcaatttttttccctgcaaccttctttgcaggaaaattcaactaaaaatatttaataaaaccaagttttactcaagtataaaaaactgttgttttttaaagttccctgggctatgttactgtcaccgtggtagcttaaaaagtattacatatgtgatgttcctgtcactttactggatttaggttttcaaattcagagcaggtgaaattgaaggttttctttacagaggctgttcttttaaccagggtgatttgctcccacccgacttagtcatttttaaaattcttatttttattttagagacagggtcttgctctgtcacccaggctgcagtgcaggggcaccatcatagttccccgcagcctccaactcctgggctcaagcaatcctcccacttcagcttcccaagcagctgggactacaggtgcacattacgatgcctggctaattttttatagagacagggtcttgttttgttgcctaggctgctctcaaactcctgggctcaagcgaccctcccacctcagcctcccaaactactaggattatatgcatgagacaccacgcccagcctgaattttttttaatataagaaatcaatataaagacaaaataaaaacgggtaaaatgtgtgcctttaacctaaggtatagacaaacccttattatcctcatctaacacacagaccttaattctactgctgatttccttcccacttctcttcaactcagaagcactttctgaggcaaaacatagcttcagctttctggtctcatggcaacttggcagcacaaggcttctaggctaaaatcccagcttccatggatccacgctgtttcagtcacaaatatttaccttgcctggctccgcaggctaattaaaggggtaggctctgttcctcttggctctcctctaaattgcttttagaggaagaagcagtggcgggaccagaatggcagccccatcactcatctccacagccacacggtgactaccttacaaatatcctgttcagatcagaaaaggggtttgcagccacgcccttgcctctctccagctagatctgaaattgcacatcccaacgatgatttcccctggaagctgacattagccctagcagcgtatgtgactgatggtgcctctgaaagagggactctcaggatcaaatactaagagcttattataccagttagaacacagtgtttcactgtgaatatatacttttattataaaaatgacatatgcttattataaacaattcaaggtgaagaaaagttgggaagttcacagggaatttttcttctgctctcactcagccccagcactgatccaaagactgccctccctctagaaacctcttttatcagtttctggcattttctatgcatccacaagcaaatggatatatacacacacacacacatatatatatatatatacacacacacaaacatacatatatatatatatatgcatttaaataaatcactctaaaggctttaaagtgatttcataataacaagcaagtccacatttgataaaccataaaatggagtcacatagttccagtcagcaaagggcttggcccttcctacaaagcagagtcactgggtgaatcctgcttacaactcacaatcgagtcaagaagccagaatcaaattgccaggcccaggaagcaatcagaacatgaggtgaggttacaactctgaaaacagatactcaaagtctgggcaggggagggaaatcaatggagaaggtagaaatacactctgaaaggcaaggggctcagagtgctgggtctagttggaaggggaggtgatatggtttggctgtgtccccatccaaatctcatcttgaattgtagttcccattatccccacctgtcttgggagggacccagggggaggtaattaaatcacgggagcagttttttcccatgctgttcttgtgatagtgaataagtttcatgagatctgatgattttataaaggacagttcccctgcacatgctctcttgcctgctgccatgtaagacatgcatttgctcctccttcaacttcaccatgattgtgaagcttccccagccatgtgaaactgtaagtccattaaatctcttttcctttataccagtcttgggtatttattatagcagtgtaagaacagactaatacaggagagaaagcaccccagggtttactgtcatcactggggtgatgggtagggagcagaagtggagaagtggcaatttgagtttgccttacaggaagaagcaaagataccactggaaaaacagaacacatccatccacaagttgagaggagacagagaagcccacaggggctgaagctggatggcgtctacctgggaggcagtctccctctgcctcctctttgagagatttctaataatattataagttgcctttcagcttgcttttgttgctttcttcttttaatatagtaaaatgtatatgtaatgtaaaattcatctttttagccaattttttagtgtacagttgagtggcattaagtatgttcacaatgttgtacaaccggcatgatcgttcatctccagaactttttcatctccacaaactgaaactctgtcctcattaataactccccattccctactatattagttcattttcatactgctatgaagaaatacctgagactggctaatttataaagaaaaagaggtttaatggattcgcagttacacatggctgaggaggcctcacaatcatggcagaaggcgaaggaggagcaaaggcatgtcttacatggcggcaggcaagagagtgtgtgtaggggaattgccctttataaaaccatcagatctcatgaagcttattcactatcataagaacagcatgggaaaaactcacccccatgattcagttacctcccactgggtcccttccacaatatgtggggattatgggagctacaattcaagatgagatttgggtagggacacagccaaactgtatcacctacttctcccagcccctggcaattatcattctagtttctgcttctatgaatttgactactctaggtacttcacataactggactcatacagtatttgtacttttgtgactggcttatttcactcagcataatgtcttcaagtttcatctatgttgtagcatttgtcagaatttccttcttttttacagctgaataatattcccttgtatggatataccacatttcatttattcatttattagttgatggacacttggattgcttcaatgctttagctattgtgaacaatggtgctatgaacatgggtgtactttcaggtgcttttctaaatgaagtattctaagccgtgaaaggtgaacagggtttttctaaacagaagacattcccaagtgagggaaagtgtggtgtgaggaagcacagcttgttcaatgaaaggtaggaggccccatgaggcagcgatatgaaagaggggaagaatgacaagtgagataaaaaatgtgggtcaggccattaaacttaaaaatacaaagaagaatagaatatattcaccacctagttgtgctgtgtcttaatatcttgccctatttactcatttttcaaagaaatatggtattacagatacaattgatccttcctgcaaaatccctcatctcattctttcattccccttcataatggcaaccattttcctgaattttaaatttattttttcatgttttataaatttacaacgtatatgaaccatgtcatgttttgcatacttttacattttatatgagtgacatcacactctgtatatatccatttccaacttgcttctttaaatcaacattatgttatagggttttacttagattatttcatattaatacttcatagtataaatattttacactgtatttttgtaccattacaaacagtgcagcaataaacattcttgtacattttccttgtttatatgggtatgactttaggctatggacctaacagcctcaatttgtaaaggcaaatttctctccaactaagtggttatatcaatttacaccccaacaaacagggttcacttgttcccattctgccacatccttaacaacagtgagtattgtcaaatgtttaaatttaacaagttgataaaatagaaggtagttaagaactcagattttagagccaaaccactagtattcaaatgctggctttactgtttactagttgtatgatttcagccctactttccctctctggaagaaaaaaaaggtcgtaatacctacctcacacactcattgccaggaatatgtgtgttaacatatgcaaagcagttggaataatatatatattgttaatactcagtaaagcctttagaataatacacggtgagtgctcaataagtgtgagccttgttttaacattttgaattggccattcaagtcttgtctcctgtgaattttctattcctttccttaccctaggacttatcattttaacttaactattctgaacataatcattcatttgtggttatatgctggaaatatcttcttttagtctgtggcttgtcttttttgtttttatgacattttttgttaagaagttttaaattggaatctagtcaatatatcgttctttgtactcttttttctcttgtttaatcaatccttctctttggtgcggtcatacaaatattctcctatattttatttgtaaaagtttttaaagtttgttcttcacatttaggattttatgatttaatccatgttgaatttaattttgtgactagtgtgaggtaaggagttttttcaatcacttctccatatgagaaaccaaatattgtgatatcattaatgaatttgtaatgtcatttttgtcatgttatttctatatatgaataggtctggttttaggctttctgttctattactctatttgggggggtttttgtcttttgttttttttttttttgcctacaacaaacatttctttttttcttttttttttttttttgtttgtttgttttgagacagggtctcattctattgcccagactggactgcagtggcttgatcatagctcagtgcaacctcaaactcttggcttcaggcaatccttctgcctcagcctcctgtgtagctgggactacaggtgcacttcaccatgtccagctaatttttttattttttgtagagatgggatctcactatgttgcccagggtggtctggaactcctgacctgaagtgatcctcctgcctctgcttcccgagtagatgggaccaccggtgcatgccaccgcacctgctaatttttttttttttttttttttttgtagagacagggtctccctgtgttgcccaggcttccactgtcttgattacaatagctttaacattcatcttgacatgctaggttatttcattaccactttggttgagctaggaattccctttcctgtctggttccaggtccaagttggccaagagaagaccttgtgtgagactttgggatgtggaagtgaagggcagttctttactctgtgaagctcttcaaagttagatggggtgacagacacagaagtacctaacagattccaacttgcccttgttctcctctgctttgcatcctgctgttcttcccaaattctggtcccgcagcccaagacctactaccagatacttggctaagagccacagagaaggtggcttcacaaaggcaacagcttcacacagacatctccatgagttcccttggcaggacaaattcagtagctggatgtgtacttggcttcttagatttttttctgtaaactcgatgttgtccacttatgccagtgctttcaaaagatagtttagactcttctctgagctcccagcttctccttccagatcttcatctccccagctcctcccacaattggataaagtctgctttctagaataaatcccatgtcataacactctttgtggctctagttccttgattgaaccctgactgacatatttgataggttaaagtgagccttcctatcttggtcttctacaaacttcttggtcctttgctcttccacatggctttttaaatcatcttgtcaagtatcaaaaaaaaaaaaaaactgttgggattttgagttgggattgttttgaattcattaattaattaaggaagaactaactttttatgatatttaatattttaaaaattatttattgatgttgatagagtgtaaattatctttatactaatgttgtgcttagtaacttgttgattttttatgttagttccaattgcttgcctgtattttctcttagactctatgagggcaatttctataaatagcgattgttttgttttgtttttacaattagtatgtcttccttttactgccttactgttcaactagaacccccaaataatgattggctacaaatagtaattgtaggcatcttgtcttgtccctcatattaaaggaaataattctaaagatttaccactaaatatgatgtttgctgcaagtttctgatagacatattttactctgtaaagaaaatctgcttctatttgtatttcttaatttttttaaatatgaaagtgttaaattttaacaaataatttttctgcctctattgaagtaatcatgtgctttttctcttgcaatttgttaatgtggtaaattatattaatagatttttctaacactaaaccatccttgctttcctgggaactcaacctggttatactgtattataatatagtatatagtatagcatatttttgtttttaaacaaaatatagttttgttttatacaaaatatagtgtgtttttgtttttaaagtaaccaattttgctaaatattattagaatttatagctttatatttagaagtgaggttggcttacaattttcatttatttatttatttatttttgagatggagtttcactcttgttgtccaggctggagtgcaatagtgcaatattggctcaccgcaacctccacctcctgggttcaagcaattctcctgcctaagcctcccaagtagctgggattacaggcatgtgccaccacgcccagctaattttgtatttttagtagagacggggtttctccatgttggtcaggctggtctcaaactcccgacctcagatgatccacccacctcagcctcccaaagtgctggaattacaggtgtgagccaccatgcctggcctacaattttctttactgtccatgtcttattttggagtcaatcaagcatacgtcagtctaataaaatgagctttggagtactccttctttttgtaatcttgttatagtctctggaatagtttatataagattgggattatacattccttgaaaatctggtaaaactcacctgtaaaaaattatttgtggccaggtgtggtggctcatgcctgtaatcccagcactttgggagactgaggctggagggtcacttgaggtcaggagttcgagaccagcctggccaacatggcaaaaccctgtctcacaaaaattaaccaggcatggtggtgggtgcctgtaataccagctacttgggaggctgaaccaggagaattgcttgaacccaggaggcagaaattgcagtgagccgagactctgtcttaagaaaaaattatttgtatgttatttcataatataggtagctataatcattgatgtcatatctttcaagatcatataatttaggctatttcttcttaagtttatattgattattgttttctggaagttaaccattttgtatgtcttccgaattaattgacataaagtcatacctgattgtctcttgttacctgttttaatttctggtatatttgtagttatgtccctttctaattcacaatttcaatattgctttgaatatcttttgtatgtaacatcatgctgaaactggctgtaagaaagccaagttttaaatagttttaatagctaattcttccgaaaacccagagttgtaaagaggaatagaaacagaaataccactaaaactacttctccataacttctacctactgtccctaattcttcccctgggagtcacataacctcaaatgtgtacttctacatactccttagaaattattactcttaagtaaatccaaagtggtggtgttttgttcagtccgttcaagaaacaagagacaatacatatctctcctgaaatacatcttttgcagtttaaggagcctcagtttttctgaaagttactcaaacaccctgcatcccaagctctttgctagcactcctttctgatgatccatccccaggcatcagcatctggaactgagtcctttagtccaagcgtagtctgaccaacatgaggagaatgagtctaaggctatcctctcactggaccattcccttcatacttcctaaaatacatttcttgcttgttcatcacactgttgactcatgttaattttgcagtcaaccaaatatttgagtctttttcacacgtgctgttgaggaatctttatccccaagtaataaaagaagactccattatataactccctagtctacagacttcaaaagagaattttaagcatgtttgggccttgagcaaagcactgagataaaaagttgagggtgaaggagtagcagacagtactatcctcagcaattagaggaggagttctttctttataaaggaaggcatctcagctgggttataccatagtccaatttccacaaacagggaaggaaagaattcccttttactgagtaccgactgggtgccaagtctaggttaggtgctttatgtgtgtttatctcggctttcgtgctgataacatcattgggtcaaggtgcagtgtaaataaagaaggatgtaaataaatgctaggtaaagttattcccattttatgtatgaggaaacagaaattcacagcatgactcgccccaaatgatacaactaaaaagtaatggggccttgttcaacttctgcactctcagccaggaatgaatgactacaagtagagaggaggcagcaggcaacaagagcaattggatgatgctttgtggtttaatgaaggacaggactttcacctacattaactcttttggatcacctgctccacctaccataagaggctgattctcacaacagcctcttatggtaggtggagcaggtgatacaatctttattttacataaagattacagggctcagagaactgagggacctacccaaggttgcccagctagccagtggtagagacactttgaccccggctttctgacagcaagcacctcttttggcagcaggtatggggcaaggagaacagcagggacctggggcaggtgttgacagatcaatgtggacatggggaaaaaagccccaaaacccctcaccaaggaaatgtaatgctctgttatttatttaaaaaaaaaaaaatttttctcaagcctttgagatgcacagaagaggcctggcgtggtggctcatgcctgtaatcccaacactttgggaggccaaggcaggtggatcacttgaggtcaggagtttgagaccagcctggccaacatggtgaaaccccatctctgctaaaatacaaaaatttagccaggcatggtggctggcacctgtaatcttagctacttgggaggctgaggcagagaattgcttgaacccaggaggcagaggttgcagtgagccaagatcacaccactgcactccagcctgggctacagagtgagactctgtctccaaaaacaaaacaaaacaaaaagaagatgcacagaagaaagcaagcccagtgtattagtctgttctcacgctgctaataaagacatacctgagactgggtaatttatatggaaagaggtttaatggactcacagttccacatggctggggaggcctcacaatcatggcagaaggcaaaggaggagcaaagtcacgtgttacatggcagaaggcaaaagagcatgtgtggaggatctctcctttataaaactgtcagatctcatgggacttattcactatcatgagaatagcacaggaaaggcctgcccccatgaatcaattacctcccaccgagtcccttccatgacacatgggatttgggtggggacacagccaaagcatatcacctaggtcgatgacagaagcagcagaggtgcctaggacagaacacatcactccttctgccacaagcatgtgctggaaatgcctccagtcaagtatccttagaacaatcgttttcccagctatttaaactccactgaagtcaagcaccagcttattccaggccaggctttgcctgctaattaacaattcacctgctggttactagttcccacagggcctcaagtgagaccaaatcccccagctggaaggtcctctttttttttccagcactgctaattcagctctgttgcccatctcaagcctggctgagaagttgttcccctgcagcccccttagttgccccagggattctagatgccctctatattcaagccaacattcatcgtctgtcaacaggtggtggacatgtacttttatgattgtactcaggttcctctgagttttgttttttcaacccagacattaagaaatccttatttcctatagaggatttaagaaatagaaaaatggcatgaacctgggaggcggagcttgcagtgagccaagatcacaccactgcactccagcctgagtgacagagcgagactccatctcaaaaaaaaaaaaaaaaagaaagaaatagaaaaatgaaattaaaaaaaaagataaaagacattaagaaatccagaagcagaaacacaacttctccagtattttccaagcctggctatggatcaaattcacccaagcaccttaaaagaatatacagatacagaaaggattctgcagcagagaaccacgttaaacattacttggatgccatcagcaaaatgcagactctggaaaaaaagaaaaaagagagagagagagatgaaggaagatgaagggagaacttgtacattaaaagagacttaagaaacgtaacaaccaatgggatgtttgaacttagttggttcccatttcaaaaaacacaaggtaaaaacagacaaatgaaaaaagaaaatttgggacatttgagagacagttaaaattttgaacactggctatatgatgatattaaagactttttattatttctgtttagatgtaataatggtattgtggttatattttgaaaagatttcatatcttgaagagaaatgtactgaaatatttttggctaaaatgatgtgtctaggaattgcttcaatatggaggagagcgagtggaaatccagacgaagcaggaatggccatcagtcgatgatttttacagctggatgttaggttcatggaggaaagtggggttcattatactttttgttctacttcagtatatgtttgaaattttctgtaataaaagtttaatctccccagttttgtgaactattctatttattttatcctcatcctttaacacacctatgtacacggaacttcctgtgtaaaatgtttattgagtgtttattccccagaggagaagcaaagaggaagtaagagtaggatatttttgaactatgtacaaatacaaccagtttcagacccttttatatgatctatactcattctagactgagccacatagaagagctgttcctgaagtcagatcagcctggttacctctaaaagaccaaaagactaaactaaaacagccttttttttcttctgtggaagcgtacatgtgtgtttgcatgtgtacgtgtaccgaacagctgtcatggacctttgtgcaggctgtgcactgcacaagtttgtcacatctaagggggcatgcttcacctcatcaacacattgcagatctatatatttattgtgacaacagtcttgtaagtggcagcaaaatgtcttcttctaacaaaattggtatttttgataactttccaaaagatggaagcaaaaatatcttaaagtagggacttcttttctaattatgtacttatggtatgggctagcagtggacctgaactgactgtcttgcctgagtttgaatctcttcccccaaactcactcactgagtttgttatttaatagccttgagttcaagtttcttcatctgtaaaatgggatgataatattatgtaccctgagagcactgttcagagcattaaatgcatatagacagtatctggcccataggaagccttcaaaaagtgttagagattagctattaccatatctgttcacccatatcaaattttataggtgtcggtatgttgcgttattcataaactcaactaataaattttgcagtggactgaaaaaagactgtctccactatttcatgaatccaaactattttaaaaagaggattttcccctaaccatcagttctgaaaaatgcaaggaagctcaagctccaggtaagcagccagggtttctaagcctctctgcgcacagaagctgtgtgcatatgctaatgaggaacctttgaagaaaagtgctggggtttttccaacgctctaactacttggccagtaagcctttaatgatgggaaaagacccagtgggagttgccagccacaaaaggggttttacctcacaggcagaatagtcaaaatgcttcaagacgttaaaagcctatttttaaaaggaaagaacacagagtatgtctttaacttgatgttaaaaataaactcagccgcctcctctgcgtttcccaccctctcccactgtccttccgtcccctgcactgccctaaaggaaagaaagagtgcttttgtttcatttttatttttctcatgagcttttctttcattattatttgtttactcttagccaaacttgtttttccgttcacaaaacaagttgcatttttctcttaaaaattcctcggggattcccaggaagcaagacggattatcaattagaactagcccgtgtcaggatgagtaaaagattcgcgcggagataagcaaagtggagcccttacggcgtcccttgtgcccagaaagtatctgcaggggacgttgttcaagcaagggggccttttatttattttttatttttttattttatgtatgtatgtatttatttatttttgagatggagtttcacttttgttgcccagactggagtgcaatggcgcgatctcggcttactgcaacctctgcctcccgggttcaagttcttctcctgcctcagcctcccaagtagctggaattacaggcatgcaccaccacgcccggctagttttgtatttttaatagagacggggtttctccatgttggtcaggctggtctcaaactcccgacccccacgatcctcctgcctcagcctcccaaagtgctgggatttgaatgctttttcatattggggtttaagtacagacacttcctgaggcatgactagacatagcaacactactttgctgagctgccttcaataaattccattaagcagccataaaattccaatagatcagatgtgccagtttttgttcatgaaaaagctaatctgtgtagcagaaaagctgccagctggagtggaaaagctggatttcttattgtatattgatggcggagggatttcaagaccccagtggaagccaaagttgttgaaagacaaggagacccaggcctgtgcatagtactatgatttcactggagggaaatataagagatgaaggggtggctgaaggcttgagaccctgtttacttaaaaatattaaaaaaaaaaaaaaaagaaagcccttaggcaatataagataaaggaaaaaacagcaaaaatcattttaagaaataaaattctgccagtgtggtggtaaacacctgtaatcccagcactttgggaggccaaggcggaaggatcacttgagcccaggagtatgagaccagcctgggcagcatggtgaaaccccgtctctacaaagatacaaaagctagctgaatgtggtggcatgcacctgtagtaccagatactctgagggagtgggggaggctgaggcgggggatggcttgagcagggtagagagagacctggaaggaaggaaggaaggaaggaaggaaggaaggaaggaaggagagaaagagagaaagaaaggaaggagggagggagagaggggaggaaggaaggagagagaaagagaggaaggaaggaaggagggagggagggaagaaaggaaggggagggagggagggaaaggaaggagggaaaaggaaagaaaagaagaaaagaaagaaaaagctctagctgggtgtggtggcttgtgtctgtagtccagatattgggcaggctgaagcaggaggattgctggagcccaggagtttgaggccaacctgggcaaagtagcaagaccccatctctttagaaaattagaaaacaaagttcctgtctagggttggcctctaacttgcagcatgacctcagtccagtgattttcttccctacaatttctttttcacaaaatcagatccctctcttcttgaatctgttctttaataggaatatataattgataaattacatataattgaaaacaagatattacatcagagcgcttaataagtgaaaatcacagtacaaacgcatgcttaaacactgttgaaatttaatgaagtaattttgacacatgtctagaaagtcagaagggaaattttgttactaaaggttgagtttgagccaattgttttccaattttcatgaaagcgaagcactgtaatacaaaagcatgcctaggaacactagcacctaactcaatatgccttaacaaatgagtaaaggaagaatgccaagatttccagcctgcaaagcttcacctctagggaatctatggccttcttgcaatggatcttctagtttataagctcaccaacataatttgacacccagtgaaaatgatattttcaccatatgtatatgccaccattttcaaatgtgtgtagattggttgtgactaataaaatacaataaaaaattataaatttatcatttgtatatgtattaataaaatacagactcatttaaaacattaccaaaattgagtcaattgtcaacatctatttctggatcaaccaactctaaaattacaatttcttccagctgggaactctggagtttaatatactatagctttttgtcataaattgatctctgctgtattagttcattctagaaagtgatggaacattgatactttgagtaacttgtgtgccagtaacaaagtgcttccctaaagcacagccaggaatcaagtctatgattaaaaacatctgagtcaataactatttatttacttatttgtgttgtcctgggaaggcttgaggatggcttaccaagatgcacaaaattcagcaagataccatcagttaaataaaagtaatgggggaaaaagataggatagaaaaatgagtagcagggctgtggttaggacataaaaggcgttctgtgaaatcccacattcttccaagtgctggcctatttggctctgccctttgtaagcagccaaagggaagaggaaaccattattagatacataactcatattagctgttaataaatatacatcaacttcttataagaagcccaactctttctgctggaaagatgagagaaacttcaagaaatggcagcgtccccaacaacataccagttgcaacagatcaaaaactcagttttagcccatgtcctcatgccagagccagattcagtaactaattttttacagactttctctaatgatgaaaaagtacttttccaacactccgtgaaaatgatctcttccctcttgtttaagtggggaaacagaggcagagaacagtgaattgcttccacttcatatactaggtcaattgctaagataaaagtagaaataatttgtcctagctggatataattacctccagatgtgcatttgcagattacatgatgattatgaagtgctcttgaggactccttaaggtgtaatggtgacctttgactccatttcattttctcttccatccccctgatgcaattttcctcaccctgactcttatcctcttgccttggtcaccactgagcactcaaggatgtagaaaatagatggcctctacaaggcggaggtccaggggaagccatcacagagatggatgaaatagcagagctggaacactcgggcatgcactatggagatggcctggaatgagtttctgaaaagagtctgggcctccagcacctcactgctgaccaagaagtccagaaacacgtctgtgcaacttccacttccacggcaccagcaaatcaccaggccatttaataattcaccaagcaaatacgtactgagtgccttccaagacaccaggtgctgagcctgtgctagggaatcaaaggcaaaaaaggcacaggtgtgtccccatagaaactgtagcttagctgtaagagagtccatcacacaggaattttaatatggcatacacacattgactctggaatcaaactcttgagtcctacttccacttttgctatgtgagtaagtcaaactcttggggcttcagttttatcgtctgtaaaatggagatagcaactaccttctagagaaagagcctagaacagtgctggacacagttcccatgcccagaccactgccttctcctgggatccttatctctgtaagaatgaccaaaatttactgtgcgtgtgatattccaggcactattcaaaatatttgaagtgtgtcaactcattttccctttatcatagccccatacagaggatatcactattattttcattttacacatctgagacatgtgattcagtgcctggccccaggttctcagagtggcagtgtacatcagtggttaaggggacacactctgggaccaaactacctagactttgcaacttagaagttgtcagagcttggaaaaagtaatgaacttctctgggcctatcttctacctatttctctcagtttgttccccatctttaccgcgacctctgcagactacattttcccaggctcctgcccatgagtgtctggttagctcagccgacaggaagcagtggtggagcttagcagtaggatgagggaatgtcagggtacttaagcccctctcagtttggggtggctgctctgacagtggctgcacctcctctagagctccagttcccgctgggcagtcccagtgcctcacctctggtgacatccccacttccttctgtccctccaacctggagcagcagcttcctactgtttctcatctttggattgtcttgcatcctccatttgttttttgtgttcttgcaacagacttatagtcagagccccatgtcagacttcctctggtgaactactagagtggcagatgcaccgtgctccaacagtctcatctgctaagtggaaataataattgtgtctacctcatatggtttttgcaaaattaaatgagttaatatatttaacgtgcttgggacaaaccatggcacacagagtgacagccatactgtaacacacagccaaggcaccaaagtccctttctagaccccagagaggagatccccaaagcctttgagaatgaataagactcaagcaggtgcagagaagatggaaggacattcgagctgtcttagtccctttgtgttgctatcaagaaagacctgaggctgggtgatttacaaagaaaagagatttctttggctcatgattctgcaggctgtacaagaagcatggcgccagcatctgtttctggtgaggtctttaggctgcttccactcatggtggaacatgaaggggagctggtgtgtgcagagatcacttggtgagagaggaagggagcaagcagaagagaaggaggagccagactctttttaacaaccaaatcttgtgggacctaagagtaagaactcactgattaccacaagaatggcaccgtgccattcatgagccatctgccctcatgacaaaacaccccccacgagaccccaccttcaacactggggatcaaatttcaacatgtgatttgaaggagacaagtatccaaactgtatcataggcaaagggatcagacaactaagtggccaagaggtaagagagagaagggggccttccgggagccaggaaagggaagaaacacaggaagacggggcatgctaacagagcaaggggaggggatggagtcagggagaaggatgaggctggagaaaacagagcccagagcatacctttttaggcatattggagtccagactttgccctgacaatggggaaccattggagcattttactgaagtgacacatttgaatttatgttttagagaggtttctttggctgcagtatggaaaatagatggggtggaaaggagagatgagagaacagcaggaagagctgttaggaagccatcgtgagtgcccaggcaagagataatagcttggactatagtagtgacccaggagcaaaaaaaaaaaagaaaaagaaagaaaggctcaagttattcaggaggtaaaaggaactggattggcattggattggatgtgggagccaggggagaagatgacatcaaaaatgatgctccagtttttgacttgggtaaatgtacaacagcaagcagcccagccgagtgattagaagcatgggctacagtttcaacagcctgcattcaaagtctggctctgtccacagctagctgttgaacctggggcaaggcaccgattcactgggtgcctcagagtataagagagggataataattgtatcttctgtacagggctctggaaaaggttaaatgaggtaaagtatgtcaaatgcttggaacggagcctggaatatcacaagcacagtaaatcttggccactattacatagacaagatctcaggagcaggcatagtttgtgggggtgggagcatcatgagctaggttcaaacacactgattctgagacatctagggaaccacagaacaagttctgggctggagatgtagatttcatttgagagctgccagtagtagagacggtaattgaagccatgggaatggaggtgattgtccagggagtgtaggtaaagtgagaatagataagtgccaaagggcacagtctgggtatgtcaacatttaagtgacaatttcagaaagagaagccaaggaagaaaccagagaaaagcagttggagaagcaagaaggcaaccagaagtggccttggtacagctgtgatggggagacaatgacgaaacagcaggaactggcactgagagttattggtgtagcttgggctctcccctcatcatcctctccagctgggagtcatgtgacagaagcaagaagcctgtcacagcgcacatgtaaaagagcaaactccagacacacacgtcttatctgtgctgacggcccaccttggtgactggaaatgacaccatccaattttttctggccgcaatgttgcacccctgattttttccttcatatgacagacttcacagcaaatactcctactgagtccaaacaaccgctacgattgagaacaagcatgaatccgccacccaccttctcctggaaataaggtgatgtgtaggttcctcatctcctttccagtgtccacaaacccatctgagtaattgcaacttcaaatttttcttttctttttttctgttacagacactgattccagaagagtgttccatatgctatgcttttttaaatttattatttattatttttatttttttgagacagagtctcgctctgtcacccgggctggagtgcagtagcacaatctcagctcgctgcaacctctgcctcctgggttcaagcgattctcctgcctcagcctcctgagtagctgggattacaggcacacaccaccacacccggctaatttttgtatttttagtagagatggggttttaccatgctgcccaggctggtctcgaactcctgacctcaagtgacctgtccaccttggcctcctaaagtgctgggattacaggtgtgagccaccgcgcctggcccatatgctaaatttattagaacccccaagcctggccaaaggcctcactcctaagattctggtggcaatgccagcatacactgggctcagaggaggtcttcagataccaggaggattactctaattcaacgcagaaatgttgtgaaactgctttatattctgtctagcacaagcaagtgggggttactatttttgtaatcattataagagccttcaactatataattttgggaagtggtgataaaaaacagagtacttctcccttgaattctaccagccccaaactttcattaacatccaattaattttcttaaaaaagttcagcatgaaactctctgcagcactttggcacagtagtatctatgcatttggaatgacacagtaatttcttatcctagggaaaaaaaattactctgtcaaaatgaatcttttagcctaagatgaactggttccatttctcatttctcttttctcaaggttattgggttgctgaactcccatgaaccaaaaagaaaacactgaatggtatccaaaccagcctggaaaggacagcgagaaaagccagaaccaaggctgaccagcctgaatgctggtaaatgttatcaaggtaacaacttctcatgtatcggtatgtgaccaataaaaagggaatgtgcttgattagcaaaaagaatctccatgaaaaataaggcatattagcatgatgactttattatacagcaataacataaatggcaatccactcttgtagaatatttgtgttgaaattaggaaatggcagcagattcaaacacaagagttaatggaagccctaaatatagatgatattccatctggctgccaagagcctgcctcagcacattaaccagaagaccaaaccagagaagggaaatagcttttaaaagtgcaaaagagaaaagagattcacttagaattttatctggtaaaaaaaaaacatctagtcataggatgaggagtcatctgtttcatggactatttatgactcagatgttaattcggatgctgtctttaaatacatggagagaagagagaaattttccccctttatttaggcttgaaagagttttgttgaagcaggtagctcacagctggtaagtggcattcagttgtttaaaataatttatatgatttggctttcatatttgctacatttgtgcaacaaacagagctgctgttttgattcctccaaaaccattttaaactctagcaccatggggaccatgtacccttagcattttgcaagagttatactttgcactaaatgaacagcaagcctgtgtttacaaaacaaaattatttttttccagtttcagttttgcttattaacaaagtagatatttctcaagtcaaaatttctcctttgtttatggttggagatcttggccctgatgaaaaaacaaaaatccactgatgagtacagaaaatcaccaccatgcagacatctctctttacaacaatcctgtggctcacagagccatcatgattgccagtgtcctcgtagaaagtcaacaatagctatttgcagttgattcggttcctctgtttaggagattttttgtagcataaatagattacagtgtttgcaaaaatgtgtgtttatggttgacccttatgcttctcagaatctgtttggagtactaaggcatgctatcctgggtgtgttgatttctctttgtgcaaactctgctgaaaaccaagggcaatcaacaggatgaagaaagtttaattcaggaccccggttgatagagattacctctgggtctaaggtcagggatgctttagtcctccttgttagaatctccagggaaaccctaactcccagatattaatcagatctgtagaaccctgcttaaaaccttccagtggctctgaattactcttaaataaaactccttaccctagctgataacacagtatataatctgacctctgttcagaccttaccagacctattatgcgctgtttatcctgaggcctctcaccttgacctgcagaaggctgtcttctccctttgtcttcacatgacctttcctctgtgtgtaactgtgtcctaatctctctcttcttagaaggacaccagtcttactgggtgagggcccacccagaggacctcttttttgccttaattacctccttaaaggccccatattcaaagacagtcacattctgaggtactaagtgttgggacgtcaacatatgaattttggggggctataatttgcctattctgcacatttcatataaatggaatcgaacaaaatgcggcccattgattctggcttctttcacgtagcacaacgttttcaaggttcatccaagtggtagcaggtatcagtgacagagcaggagcaccgtcatcttggacaaacatcgccatttcaagttccggctccttttctaatctcaggcatttcaaggaaatcacttctcttctaacaacaagcagccagaaagagcagacagtaaaacacagataagacagctcaggcacagaaggtggggggaaagtctcttgggtaactgccaaacttcacactcatacaatgggccccagtaaaacagtgggccctaataagcacattcctttccctttaggtacactaagatagggaagctaaaagcaggcttgggtatgcctgcagctgaaaaaaaaaaaaaaaaaaaaaaggatagaaacaaacacaaaaactccctctcaaataagcaagacaaagaaacacagaaatattctgagcctgtgataagctctcctgccctaaacccttaaatactcttagtctgtaacagagagtgcccctgacctaattcagccagaagcccctctcgggtttattctccaaaataaacctgtttttaactgtgaagccacttttcatgtttctttcttccttattcaactcttactatcagtactttcttcttttttatgactgaatagtatttcacggtatggctgtatcacattttatttatccattcctcagctgatggagatttggattgtatttgctttttgcctgttataaataatgttgctataaatgtttgtgtacaagtttttgtatgaacatacgtcttcagttattgtgagtatatacctaggagtggaacattctgggtcataaacacacataactttgtgtttccctttttgaggacccaccaaactgctttccccagcagctgccagctgcatcattttacattcccaccagcaatatatgagggcatgtttctagagattacataatcacaaacgaagggcattgtcctttatagcctgctgaagttcaaaagagagaggaagagatgttcaagtaaggaagagatgttttattaggaatatgaagggttcacaaagtcctgcttactcattttcagccaactttgccatggcattatttaattagcattttcacctcatcttcaatcttaacatgaatagcctgggtctcaaggccatcttttcccaaccagtataagcaccttcgagacagcattcaatatgtgtcaatttatttcctattcaataaggaaaattaggtcttgctttgcccactcagctttattcctggaaatacacttttcaaaaagtagaaagttcagtcttgctttaaaccaccaagctgcctgaatggatttcatccattatttgggctttattttaaactttgcttttaataggcacagaaccaatgcatattttaaacttttgacgcaggcaaattttatatgtccaaaagactcttggaagttaagcagacataaggggtaccgtgtgtgtgtgtgtgtgtgtgtgtgtgtgtgtgtgtgtatcacagaatgaggggcacatgctgccaatttagtaattaattatcaactaacagaaggccactacctatactgtctgtggcagccagagcctcaccacactgacaccaagttgctgtgcctccttgacagaaagtaacacagattgccatcaatggatagacaaaaaaactctgaatctatggttatacgtgtgcatcttacaaatggagtaacaacaaatagaagaaatatatttacaaatgaaaatgaacccgcatttatttacttcactaaaactgtttttttttcttctcatcaaagatttctctattcatgctactcaacatcccaaaaagaatcagcataaggccacaaactcaacaaaattccttctcctgttcattaaactcctgtcctgactccaagttcacacctaaataaacaggcaagcctgtgctctgcaccctgaggaacagtctcctaggctttgtccttgcagagagcccatttccaaggacaggccgtccatctacccagcttttctcaaggccacatagctcctctctaaagacagccatccccaggggttcagttgatcctgacagctgcgcctacagagaaagaagggaagagagatgggagaggaagatctcccaggagtcaggatgcaaggtgaagccagctgttgatcagcggtcactcagcagctagaccatgcgacactctccttctgaaggctgcaggctgtgagagtgttctgagtggcatttaaggatagctcccatgcagcgtgccagcttcggcagggcctcctatggtaagccctaaaacacagagggaaaagaataaccaagtggaagtggatcatcatgccatctatcagagacaatgcatgtgagaatgctgctactaaatgaatgaaaaacgctttgtaaactcaaagtctgtggttctcaaacttgagcatgtatctttttttttttttttaaattaaaacgctgatttacttggccttattctagaagttggattcattcggtctggggtaggacctagaaatttgcatttctaacattgcatttcccagaggatctgatactgcgggtcagcggccacacttggagaactagttgctaaaacacaggatccatgtcagctgaagctataatgggcaatcatgagccatgcccagactgagcagtaaaaggaaacaatgttactgtctaaaacaagcaagaaaataatagaatatttaaaaataacagaatatataatgcttgagttgccagtagcaaagtgttatgattaggtccttgaagtcggaaaaagcagagattaactagacatttctgaataagccctgtcctctaactcagcagaaaggaagagaccaagtccatcatcctctcagtaaaccattagccctggagcattggctttccctcttcacagatgaggagttccatcttctaactcacacagagcagggagaggataagagctgaggaaatgccatcagccctcagctggtgactgtctctactagtagtgcctcatatgggtataaggctttgtggttttgaaaagctttccagtgatcaaaacaatgtgacatgggtgaaagaatagacaaatggaccaactgaacagaatagagagcccagaaaaagacccgcccaaatttagtcaactgagctttgacaaaggagcgaaggcaatacagtggagaaaggacagtcttttcagtaaatggtgctggaacaactggacatccacatgcaggaaaaaataaactagaatctaaaccaagaccttacatctctttcacaaaaattacctcaaaacggatcaaagacctaaaggtaaaaatgcaaaactgtaactggtgacagccagaaagaaaaaataataattgagtgactactagtgccagctatcgagttaagtacttttaatagcttatcgcattgattctaaactctgtacacaatgtattattcccaaattgcaaatgatgaattttttgccagtgataaagtataatttctctatgttattccctatagaatctggagcaggagcctcagtctcctatcaaaaggagaagaacctgaagaaaacacttctcttccttctctctgcctaggggcagtgaccttggattcaaccaccatcatcccttccagacaccagaggggggagtcccacaaggcagaaggtgcccctgtgacccatccacttctcttccatgttctttacctccttgctcaggaagccataaagttgagctgagtggaaggtgaatttcattgcaaagtttacacaggctctgctgacaggttcatgaaaacactactgaatatgttacataccaccaaggctcacagcacatcctgtgttggaagtgatacttttccattaccagtaaacctccttttgtcctaggagctcactgaacagctaaaatcaggtgatatttttatgtggaacatgcaacgtattaagtccttttgctcagtgacccaaaaaggaactaaacggtacccagactagaaatcaatgtcaaattattcaaataaattccacttaaagaatggtggtttggaaagcgctcagtcagaaagaattctcccaagattagtttactgtgaagtagaagggaagaacgttttaactttggttggaaatctgatgacattacatagaaggtgatgaaacatcctctaagaaacggttctgatccattgtatggcacccccctctcacattcccccattttacccactaaagaagttcttttacaagaggctaaggaaaccaagcaatataagatctaatcaaaactgagtgctggaaatgtgtggggagaaatccataattaaactgagcaattaactccagaaagttaactggggccaactctgacactgctataaagttataaaatctccagcatctcatttctttgtccctctacccaatttcccctcaaaggtaagcctctctttctctctcctctcttcttcatatttaataaaactgtttgccagaaaggaaagaatcttaggttagtcatttacactttagtgcgaattaaagccagtgtgtcaactctcacaggaatgagaatttcaagccatacttctaattgtggaatggctgtcattgaattcttttaagggtatttcatggaacaactaaatataaggaagaggagagaaactgcccaagtctgcctatgcctaaagtcagccttaagttcaatcttgagggtgacagctttcatctgccactcccaattgaaagtgaattcagattaattcctagatgtttgtttgttgtttttttttttttttttttttttttttttttttttttgggacggagtctcgctctgtcgcccaggctggagtgcagtggcgggatctcggctcactgcaagctctgcctcccaggttcacgccattctcctgcctcagcctcccaagtagctgggactacaggcgcccgccactacgcccggctaatttttttgtatttttagtagagacggggtttcaccattttagccgggatggtctcgatctcctgacctcgtgatccgcccgcctcggcctcccaaagtgctgggattacaggcgtgagccaccgcgcccggccaattcctagatgttgaatgagagttataatttatcctttcaggatctactggttttcttttctttttttcttttttttttttttcagacagagtcttgctcttgttgcccaggctggcgtgcaatggcatgatcttggctcactgcaacctccacctcccgaattcaagctattctcctgcctcagcctcccgagtagctggcattactggcatgtgccaccatgcccggctaattttgtatttttagtagagatggggtttctccatgttggtcaggttggtctcgaactcccaacctcaggtaatacgcctgccttggcctcccaaagtgctgggattacaggcgtgagccaccatgcctggccggtttttctttcttttttacttttattttacgttgaggggtacatgggcaggttatgtaggtaaatgggggtttgtttacatatattttgtcactcaggtactaagcctagtacccaatagttattttttttctgatcctctccctcctcccaccctccagcttccaaaaggccccagtgtctgttctcctctttgtgttcatgtgttctcatcatttagctcccacttagaagtgaaaacaggtggtatttggttttctgttcctgcattagttttctaaggataacggcctgcagctccatccatgttcctgccaaagacatgatctcattcttttctatggttgcatagtattccatggtgtatatgtaccatgttttctttatccaatcagtcattgatgggcatttaggttggttccacatctttactgttgtgaatagtgctgcaacaaacattcgcatgcatgtgtctttatggtagaatgatttatattcctttgggtatatccgggatctactggtttcaatatccacctcttctcctctaggcccagaaaacaggttaatttctgatggcttttaagtgtcagccctataggacccattctcacttgacaccaggtatctccactccagatgcccttccccctaccaggttttacttgaaaagcacaacatgagtggcttgggccaaatgtggccataggtccttcaacaaatgttgagtgagtgtgacccttggagcagaaagttgacagggatctgacacatggctcgtcccccagaggctctcactgctctcttagctggaagaacttcaaactctcagacagtggaaaattcagtctgttccaagcaggagacacaaatgtgctcttaaaattcatactggcgtttggaactgcccagggtattataaatataatcgttctgaagtgtgagtgtgtgtcagggagagaaagagatggagagagagagagagacagacagagtgtgtgtgtgtgtgtgtgtgtgtgtgtttgtgtgtgtgtgtgtgtgtgtgtgtgacgacagaaaggaaagtgagagcagacccagggccagcaagtatccatgccaagaacacaaggccaagcccagagaagaatgtccaccagatgcccagtgactacattttggattttctactgcttcctcctcagagaaaaggggggaaataaattagagagaacgcaaagggagagagagagtgagcaagatgggtggggatggagagagaaaggaacaggaagtgggagccttactaaacatagagcaagaggcccagactgagagagagaggctgtcagaatgaggaactactgagagatcacaggcttctccaccagttacaagtgattaatatctacatttattgtgttttgaagccatcaagttctatgtccaaatgaccccacccctcccataatgcagcaccaagactaatccaccatccacagggcattctgtttcctgccaaacagatggggcttattgaggttggtcttacacagcctcttccaggtcttggacacacgctggccagcctctgtggctgaggaatagaataaagttaagtgaactgaccctacacgtgggcccctatgaccttcattgctcttgaactaactgagctgaccagccagcctgaagcaacatggccccagggcaggggctcttaaccttttatgcaccaggcttcctttggcaggctggtaaagccacagactcccttctcagaataatgttattaggcataaaatgaaatacataaagctacaaaggaaatcagttacaacatcaaatattttaaagattacaaatacagtaatatttttactcttttatcagtgctttaaataataggatctggtgagaggtcaaataacaaccatcatttcaaagagtgatgagagaaggagtgtttccattgtctacaacaactaccaggtgatatgaaaagatctgttatttctgtggcaagagtcataggcgctgctaataccagtgcagtttcttgcctacattcttaatagaaacaaaaagctagatttcagtgagaggttagataaaataaagatgcaatttttccccatccaaatttatgaaccagaacaaaggcaataaaaggaagggagctgcaacaacagtaatcgtagtgacaaagcaacatctgctacaagaacaacagcaaaaaatggctgccatctctgctctgtatcaggccctgggttaaatgctttctactcatctttctctttcattctgagggaggcatcattttgcccactttacagatgaggaaactgaggctttaggacattagggaacttgtctaggaccatagccaataagtagctgtggcaagaatggaagtcaaggctgtctgacactgaaggccacattcgctgtgcactgtgtcttcagaaagagatagggtgtgtgtgtgtgtgtgtgtgtgagagagagagagagagagagagagagagagaaagctgtttcctttttctcattcatgccagaagaattggactggtttaagcatctatactttcacccatcttgactatccatttccatctttttaatgtttgctcttttcagttcaaagacccttatgcttcatacattcatagccagtacatatatgttgggtactggctatgtttactgacaccaaaaattcaaagataaatatgttctctgactttcaggaagcttataacttattggagaaaacagatatgcaaacagataaattataatatgcagcaattagaattcaaggtaatttgcacaataaggagaatttattgactcatataactgaaaagtccagaagtagacaggcttcaggcactgtttgattaggtcttcatcagcagtgtgctaggaagtatgtcacaactaactgactttccagagaaaaaagagccatgagtttgtctatttccatggtgtaaatactcccaccacgacctatttcaagctaccaacatgaagtcactgaagatagaattaggaagagatgtgcgcagtcaccccttgcctgatgcaggctagctccagcatgctatgaccattctcatttcttcacagttctctcagtttttccatcctctgtatgctggttttgtcctgatgatgcaaccagcagctgggactgtacactttccttctagtgtctagcaagcttctcttctactaatcaccaaaaaaaaattcctgagctcttctgaaagaatcgctgtatccaaggaatatcacccagctggcttagccttgggtggcatattaaaataagcaatagctaccttctctcaaggctcttcatttcacctatcaagtactccttgttggacaaagctacggtctgaatgttcttgtcccttcaaaattcatatgttggaacctaatacttaaagtgatggtattaagaggtgggggtctttgaggaagtgattaagtcatgagggctccaccctcatgaatgagattactgccctcataaaagaggttgaagggagtgtccttgtcccttccaccatgtgaggtcatagcaagaaggtgccgtataaggaatgggcccttactaggtgccttaattttggacttcccagtctccagaactgtgagcaataaatttctattgtttatgaattacccagcctaaggtatttgggtatagctgcctgaatggactaagacaggcagaattagcaccaaaaacctatcctctagaaggtggaattatcagcaagacaagaaaatgatattcttgtttacccattttagtgcctgtgtcaaccagatgttcccttcagaactgagaccctcattttcccactctggaagtattgatggctgatggctcacagctgagttcctcccaaagcattgctctgaccaaaaggagctgccagactcgaggatattgtcccccttaagaggacactgcctctaatggctgatcaatgagtgagtataaaagcctgaggtcacctcaattcaggcatgtctgaaggatcatcctggctccagcgcttccaaaggggaatcagataaagcctctgttgaaatcatatactgggtcaatttctccctctgtgccatcatccttccctctcttgcctacatcattcctatgtgtcctccccactaaacctcctgcatgcaatctcagtgtcggtttccatgaaactgaatattcaatgcctatctctaaacaagtcaccagatgttctagacaaatcagggcccatcctggagctgggagtggaatcagtcccacccacatcccatggctgccccacggtgggagagggttgggatgtatcttgagaaataactgcactgtctgctacataataaggcatactgggtgatgtaaaagacgtatgaacaatatcacagtccaatggctgagccattataggcatagagaaagaaaaaagcaggccctgacatccagaaatagtcaccggtagacctcaatattattacaagctgatctgacactcacagccaggctatagttctcctgttggacatagacaatctcacagaacaccaacctcagacaagcttattctgaaccacgataaaatgaaacaaaacaaggtcactacctaattttgtccatgcacaaaaacaaggtcactctgccccctgtaatgcactcaatcatagaattgcctggatttctgatggtatctgacctagagcaaatctttaatttcttaagccctccacaaatcacccaaccaaagtccaaatcttctagtagtttctttctaacacagttgctaagatagtgtccttaaagtatgttctccctaaatcaatgagtagtaagcccagcttgtttaattatcagtgtgttcctggtggtctttggctggagggcattggtagccttcaatcagtgtttgtatggtgaataactgggtgtgtaaatggctatgttgcccctctttcaagaaaggcttaacagaagacctttgagctggttcttaaaggaagattgagcttttccaagcaaagcagggtcagagagaagtcattccaagcaaaggaagcaagatgtgcaaaggttggcatcactgaaatgaaggatgaagagtccatatgggtggggtgttgggtggaccggaagggtgctaggaccaaatgtggatatccttgtaagtcacaactaatcttttaggcaaagaggacagagaagcaggagagagacagagagctcgaaatttgaaatctgattgcagagagtattactggagtagccataactatttttcctccaaccctttctttcttttttggagagaaggagaagacatttgctttggttgaagcaaaattgcatattttgagttttctcagttttcccaacctgacatttaaggcgcacacctaacaacactgagcccttaattccctggatattgtgaatgcttcgaagacatcatggccttctctcaaaggtttgataacttgcacttcactatataattcctcttgcttgtcagaagtgcaattcagctggtcacttcctctgttatttataattaaatgacttaccatacattccttaaaagagacttccagatgccctgatagaaaatgccaatgtcttcccacttccttgtgtgtgtccacctttgactctccattcgtggcgcccccaagatgaccttcatcgtctaggggtcttatctctaggacctcccaggccgtacgattcctgcagtccctccgtctgtgtttaagtcttgcttgtgctccacaaaatccttctgccttaacagccctacagctgcacggcctcctcttctgttcccttctgtctgtcttgccctgccctgccactgagcactcagattttataacatcttgccttgccaactggttttgtgagtatcatataagtatctgttaattatagatcttttacaaataacatatacctgatacagctgaaggagactgaaatgtccccactcttacaaatccatgttagtgctgccctagactacccttaaaaagaattttgtgtatatttgtgaaatccacattttctacttttactctctctatatatatctcaataacctatgtattactttgtgcttttaaacataaagataatcatagtgttgtatcattttattctatgctttttatactcacaattatgttttaagattcagttttgttaatatatgcaaagcttttagaacagtgcctgtaaacaccatataagtattagctactattattttcagtattattattattgttattttgaggcagcatctcattctgtcacccaggctgagtgcagtggcatgatcacagctcactacgcctcaacctcccagggtcaagtgatcttccaacctcagcctcctgagtagctgggactaactacaggcatgcaccccatgtccagctaatttttgtatttttggtagagatgagatctcaccatgttgcacaggctggtctcaaactcctgggctcaagcaatctgcttgcttcagcctcccaaagtgctgggattacaggtgtgaaccaccacacccagcctattattttcaatattattaataaatgtatttacatcattccttgtaattatagtaagctaacattgatcatacaacattttatttatcccattcctctcttgatgtgttgggacttagaaaacgacaccccagagtgaaggcctctgaagcaaagtctctctctgaccttctcctactctcctgtctcttgcccctcattcttccctaaggcaagccatagaaaatgtgattcctcttccccaaggcagatcttagaaaccaaaacagattttacatgaagccagtcataaaacctaaaaatattactgtaatcttcccctgcctttctgtgtaagaactggctgcaaagaaattaagaccctcgtcccagagggttcctattccatacctgggagaaagaaatgctgcacagagaggccaagaagaagctgagctgacggggcttgataggtatcgcgactcggtctatttccattagattattcctgtttcccccaattgtagttctacatggctgtacattcttcattgaacctaagcataaaaaaagggatcaatttttcctggatctttggtctccattctgaagactctcatgtctcataaaactgtgatcaaataaatgtattatgcttttctcttgttagcttgtctttgttataggggtgttggccatgacccttatgacagggaggaaagggatcaccttctttctgcccctaaggtacatatttaggttgtttccaatttttcacaattaattatcagcagtatcccaaagaatatccttaaatatgccatgttcatatgttcaagagttggtatttgcttaaaagtggacttgctgggctgtaaggagaatgtattttaggttttgctagctattgtcaaattgtttcccaaaatgtctgtaccctcagcagtgtatgagaattcttatttttctatctttgccaaccaccactgattttttcaaaagtttgtgagtacaaagtaataatcttgttttaacttgcattcttcttttcattaatacgtgatatttgtacattttttttctctccatttattggccattatgcactgggccttaacctttgctggggtcttagacgcctttgagaatttacttcagaaaaatacacacatatatatatatacacacatacactttataaacacattgaggggcttcacagagtccctgaagacccatccacaaagccccttcagagcagagactctcgagcttttagtagatatgagaaccttctgggaagtttttaaaaatgcagattcctaggacccatctttgaggatcctgactcagagggccctagctaggaactgaagggctggtgcaggtgattaaaaaaagaaagaaagaaagaaagaaagacaaccaagactatactttcaggggccatttctgtagttcgttaagaaagacaatcttgagtttctggattcccagtaagaactcctatttctgctttccaaaacgttcccttctcctacagctatgaagcaaaggataaagtcaccaagtttaatgtactaaagctgtaacttgcctttaaattgatgctgtagctacttttaaatccatggttacttctgcagatataccttgtgcctctctcctccttagctggaaaggtcggtgagggaatgaataaatagggtgacatgtgagacaaagaaaaacacaaggaaaggaaaaaaaattaggaaattcgaagctattcagaaaatgctacataaaaagcatcatcctactaaatatgaacagcttgtgtttggaatggtttgtgtttctaattttatttcatgagcaagctcatttttttttctctgccagatacttcaaagattctcttgcaaaaagaaggaaataaatttattttcctcttggatccaaattcacataaatgattctgttgtaagatgaagaaaattgattgcttcaatggcaaataagatacttttttaatttaaaaatttagtactaaggaaatcatgtgccagggaattctcaaaacattttgagagaggttgagaatcccggtatgatgagatgatgatgttactcatgcacatattcccccgctttctttttcaagcctgcaagtgtcaagacagagttaatccttatttttgactcagtcacacgcaaatgcgttcttctctgagctggtcagtggccagtatcctcttgaacctttggtggaattcaggtccgtgaatgatgccaggaacaagaattaggatctgattctaggactttataatgactcactcggtacctttgtccagtaacaatagaaaaatgactcggttgctctatccatgaaactagggcagtgatgctggctgcctgcctcacacagggttgaggggaaaccaggcttacaaaatgacagaggtctccggagcacgggcatcacatgggaggaggtgggggtatcttcacagagccagaagacaacagagggggcaacctgacacagaaccaaaggaggtccttgaaccctgccacaccagcctgggtggagggtattctgtatacactgtatacactggagaacatggaatgaagtcaacttacatcttttgtctttctggagaccatctttttactttcacacattactcatggattaagaagaaaagtggtggccatgacattttctaacattttctggtatccattatcttgttcgcttggccatacagtgcttcttacactctagattttcagattctagacagtatgttcattaaaagcaggaattaaaattgacatatagatatacatagacgtgtgtgtggtgggtaaggtgcctggcactcaatataaacactggatataataaatgagtgaattcctacacacagaaaaacacaacacacacaaacacaaataagtcagcatttttccaggacccaagccacaaggaagaagatttggggagtgggagacttctgctgccaacctcattcctgcctgtattatttaggatataaataccattgcagtaaaggagactgagtgaccataacttaaacaaaatagaagtttgtttttctctcatataacatggctgctctgtggtatcacaaccccaagttccttccacccttcttagagtgttatctccatctgcatggtccatgtagctcaccgcagcatctgcatcccagctgatagaataaggaaaggaaggagagcatatcttccctttcaaaaaggctgtatttcttgggccagaacttagtcacatgaccacatctagctgcaagggaggctgggaaatgtagtctttattctgagtagctgtagatccagttgaaaaataagcattgtcttaaaaaaataaaaaataaataaatattgggggaagtaactgtccctgtcacactgaaaaaataaaagcacaaagatgtaggtttctcagaatcactagaaaaattcccagtaaacctaggactagtactaggctgggtgcagtggcttgcacctgtaatcccagctacttgggtggctgaggcagaaggatggcttgaggtcaggagtttgagactagcccagtcaatatagtgagactctcatctctaaaatataaattagccagtcatggtggcacacatagaacaagatcctatctctaaaaaggaagtagctaatacttagttggtctcacaagcatgtcaatctactaagcagatgttcactccagagaaagacagttctcaacttcttacatttgccttttaaacaatttacactttcctctattaatctctgataaatttaagcttcatttcccataccaaatttgggttttcatactgcaggtagaattttatattttctgacctctaggagaataaatgcccaacctgatcaccacacatacaaggctagaagatgaatacatttggtgtgaaatcagagatctgccagcattcagcttgggaaataagaataaaaagccaaggagcctgtccagaataggtaaggttacgaatgatcagacaacctaatagtgataattaacgtaaccataacatagttaaaatctatggaggacttactttgcatcaaatgctttgcccacatcattttatttagaattttcttttaatgttggagggtgtattagtctattttcatgctgctgataaagacatatccaagactgggcaatttacaaaagagagagatttattggatttacagtttcatgtggctggggaggcctcatagtcatggtggaaagtgaaaggcacatctcacaaggtggcagacaagagaagagagcttgtgccgagaaactcctgttttaaaaaccatcagctctcctgagacccattgactatcatgagaatagcaccagaaagaccgcccgatgattcaaccatctcccaccaggtccctcccacaacatatgggaattatgggagctactagatgagatttgggtggggacacagagccaaaccatatcagagggctatcctgttactaaccctatttatagtcaaggaaatgggcttagaaaaaagttgaggaacttgaccaagatcacacaaataccaattgacagagcctggaccttaactcaagaatctaactctactgttggtacctgaaatcactgatcactgtggagtctcaattaaagaaaaagacaggctggtgggagcagggaaaagcaacaaaaaaaggcaaatacactataagtctgcctttcttcatggtccaggacatacagacctcctgtgcaaataattcataatcttcctgtgtccagctatcaccagaccctcagctaatacaaaaaatgcaagttagctccctgcaaacttggtattagcagtactgcacgtagcattctgcagcccaaaaccgtcctataaaatctccagcaagcctttgtctcctggcagtcagcttctgttctgctgatttgcccgttgctttcttgcaatgtattttcatactttctctaataaatttacctttctttatctacaactgtcttggtaaattcttttacctccacgccactggcccagataatcatcactccccagcaataatctctaccactacgctgatggcaaggaggacagtgagcaatgtcccacgcatccttcccgcccaccatcacatggataggtatcaatcttgttgttcatcctatctgggagtattgagtttggtgacctaaaaaagaatataaaagttccaaccatcagtatttaagaagtgatctcagaaatttacttaaatctccacataacctttgtaaaacaaaaaaatccagaaaaaaattgaaatatattaaaagagacttcaaactttgatgaaaatgttttgtaattactaaagtttacaaaatctacactattgcagatggtcatatctacaaactactcttttatggcacttactgctattggaattcatcacgtaataatttgtgtaagtttaccttgccagtggagagaagactccaagaaggtgtttgttcctaaatcgggaacagaataggtgtccaataattatttactgagtgaatcaatgtttttctttcaacatatctttttagaattatttgccacttattagaaatagttaatataaataattatattattagatgttgctgtgcttcaaaatttgatactaagagcttgcactataaaaagttttgcttaatccgtgttaacttatcacaggaatttaatatcccactgacttgtgtgtgtctgtgttccctgtgggatttcatttctattaataagtttgtttactggactactttttgcccccaacatttcgtgtggtcggttttaaatttgacactgctggatatgaaggagtcaagtcattaagaactcaaactgctttagaacatggtaattatgctccaagtggaatgaaccgtggatccatctgactttaataaatccattcttgaaaagaaatctcttctccctgagatatataattaatgtaacatgaagtctaaaactaaatttctccccagaaattccaggtgaaaatttcaggacactttttaccctagaattttgattcttcgtcacataggcagacagattcttactaagtatgcacaaatgcttaacgggcccaagagactttgacttccttaaggttttctaaatggttgctctctcaaatgcatgttcatgttactgtttccttttgtgagcaagccctccctccacagctccctctcaatccagcctttcagctgcaggattgtaaagaactgaggattccccaatgtgagaattgaccaagagtttatataccccactaccttttataggttgtgggagccattcgtctcaaaaggagaacagcgccctggtgtctttgtgagtttgcatcaagggctcctcactgaacagaatgtttgctagaaaaagacatgcagattggttagctagtttttttccatgaagatttccccccaccccaactttttattttgaaaattttcaagcctacagaaaagttgaaagcacagttcaatgaacacccataaacctttcacaaagattaatcagttgttaacatttgtcatgtcccaaagaacattttctacctctttacatatctgtatgtgtgtgcttacaaatatagaaacagggtcttgctatattgcccaggctggagtgtagtggcaattcagagccccaagcatggctcactacagtcccaaactcctgagctcaaaagatccatgatcttcaccttcctgagtagctaagactacaggcatgtgccacacacccagcgtgtgtctgtgtgtgtatgtgtgtgtgttattgaaccatttgaaagtaagttgcaggaatcatgatgctatacccttaaatacttactcttatttgtcctaaaaaaaaggatactttcctacatagttataatatcattgtcatacccaagaaactttcctttgattcaataacattatctaatatacagtccacaatcacatttccccagttgttctataatgtattttacagttgggtttttttaggggagtgcctatctgtattcattcaagattcatgcattgcatttagttatcatgtacatttagtctcttttaatctaattctacctacctccagccctgcctttttggttttgctctgtcctttcaagttttttgaagagtttagggcagttgtctggcagaatgtgccctaatctggttttatgtgattgtttccttgtgattcaattctgcttaagcaattttggcaagaatgatacaatgagatgctgttcccatgaactttgaataaactcaaggacagggattttaccaagcctgagtgatcagattcaaagaggcttaaaaaaaaaggcatttttgaagatgagaatttagtaagtatatggctcttcatagcagggtgagatgtcccaagcaaaatgaaaaaatggagcttctaagattagtgtccaagattattcatgacttgaaagaggcccttgttatgtcaaatctagcaacctttgttgaatcatcaggactgagatttgggcagagtcaacctctgctgttgtaaagtggataattactaacttggtgcaatttcaggaatgcagaggccactcttccccactcagctacactgcctccattatgggagtggtgacgcctgtctgctattattaaagatcagagctgctctctaatgactatctactatatgtcaggccttgtgcttagtggtttattaatctgttccttacaaaaacctcatgaggtaaacattattattcccatttcctaggtgggaaagtgaggcttaacaatgtaacttccccaaggacccaagcagctaatttaagatgtgaaccaaaatctccctccataactaaagttccataattccatgttccatgtgatgctcctctattccccagtcccagtcttacctcattccctaaatggcttttccttctctctctagagcatacattacactggacatctgattaccccattttatgccaatagatccttctacaaatgctaaccattattgtgtgtgccaggtccagtttgtgccaggcaccttgctgaatgctctacacacccaaactcatttactcttcccaagaaccccagaaggaaggtgtgcatcagtaatgtcctgtgaccactctgatagtagatggcagaaagagaatctgaaccagatctgacttcaagcctgagttcctaacaaagataggaagaacaaggcaaccccggatgatacagtagccagacacttgctagtaaaggccagaacactgactcactaagctctgaactcctctgcccccatgctgccaggggcacaaccccaacagactgcccagcacactgccctaatggccattgactcatctgctccaacgagcaagtcactgcacaaaactcctcccccacagaaaggtgttggtcctccggcattcagaaagaaccaggagccaacataccactcacaggaagaaaacgcacacactgtctctatttgttattcctcctacacaaactctttaaaatgattgagtttaataaaggaagatgtttccctgcagctgtagagaggaaatgttctaaagtaaaaatcagaacacagtctgactaggatcactatgcctatagcaaggatgtcctcaagcggggaaaatgaactcggctaaatgcatccagtctgttcctctggcccttctaatgagcaggacctgcagaaggcgaggaaggttatggtcgcacccataaacacctcttggaggcacctgccttatccatgccccgttctttcacaagtgcaccccactcccgaccccacttccctgacaaagctgacagcaccaacagtagacgcctgttagggcatctttcctagattctctcctagagactggtatttagcaattcctgctcttgaaggttcttgaacttagagcagtagaaaggccaggaggaaaagccagtcttggctgagcagaataaagcagcctcagtgagagatgagatgagagacagacacgagcccaggtggacccgtcacagccccgtctcaacaccgcccagtgaatctatcacacatgcctagtacatttgtctccccatttccaaaatgaacattctcctctcttgaaaccccagcccacccatgcccgccctacccttcctttgagtcctgaattgtattccttattgccttctccgggactcctctgtcataattatgccccctcatggattattcccatgaacatagagtaatactgcccatcttttaaaaacaacctccagctgggcaccatggctcatgcctgtaatcccagcactttgggaggctgaggcaggtggatcacttgaggccaggagttagagaccagcctggccaacatggtgaaaccccatctctactaaaaatacaaaaattagccaagtgtggtagcacaagcctgtaaacccagctactcagtaggctgaggcaggagaatcgcttgaaccctagaggtggaggttgcagtgagccaaaatcgtgccactgcactccagcctgggtgacagagagagactccatcttaaaacaaacaaacaaacaaaaacacacacaaacaacctcccttttccacacattttcttctagcctccacttcattttctgctcctcttcaaagcaaagagttgtctctatttaccaccttcacattttaaaaaattttctattctgtcttcagtccactttagccaagcttctttcccaatcaccttgttgaagtcaaaattaaaatatagagacaaatctctacaagtaatgttttctttggcaagaaaggatcccaatgtggggtgtacacacagtctggttggtttttggtatgtccaaagaacaaatagaaggttggggattttataaaaaagagagaggattgttatgtgtggtcctgaaagaaagttcattgtgattagcaaagatttggggagctggcaagctccaattggtgggcgagggtggtgggcaaagttagtcctagaattgcagcaagttatcttagcagctgtagataaaactggtttcaggttacaaccagcagtttcagctgctgggcttgcagaaagtaacatttctagagcaagttgagcatgacaagaatgacccaattcatatgatcaactttcacgaccccatgaagactggtgtcattaaggttactaatggctttgatgtttgcctaatctaaggatcacacactagtcctttctcacttggatggcctgcagcatttgacaaaatgatgatcattttctcccatgcaagatttgcatgacactcccttctcctggccttccttctccttttctgcctccttttccatcgcctttactgtgtccatcttctcttgttctccaaatattgagggaagggagagtgaggcaggaaaggaaggaaaacaaacacaatgttgcatccctgagctggctttctctcaggatcatgcatggccagttactccatgtcccaggacttttcgtccaagagaccacaggaatgaccacatctgagcactggctgtccaaggagaggaagagggaggaatttatccaccagctcccattccccaatggtcaaaagtttactccacagggtgttaactcctcctcacttctcagtcacttctacagaggcattgagcacgtttctgtcatcaataagaaatccccgagatggaaagtgacacccacaaaaggtcagtgggagcaacacagagccagccacagaggcagaacaaatctgcaaggcccctgaggcacgtgagcctgagagcacctggagtagctcatgacaggtgtctatgacaccccagtcctctgtgcacaacgccagacttgccaacttcacatttcctcatgaatgtctaataggtatgtgaagctgaacgtggccaaaagagaacttttcttcctctattccccaacttgctcttcctatatcttccctatcttggtcagtaacatcttaatccagctagttgccaacctaaaaagtgaagggttactatagacccctcttgcatcctcaccccactcatctatcagtaggtcttgttggctccagctacaaaatgtatcccaaatccatccacttctcctgtctatactacaaccaacctaaccctgcccatcaccatatctcagatagattctgcttttcttaactggtctgcctgctctttgtccctctaaaacacagtctccacacagttgcaaccagagatactttcttttttttttttttttgcaacatctcattatttaaaaatttcaagcatatatagaagtaaaaagaacagtaaatcaaaacccccactacccaccattaacaagcatccaatcatggccaatgtcattcacctctatctctaattttgaggtaaatctcagatattacaccatttggtctataaatgatctgattttgcatatgtttgcgtctcttaaagataggaactttaaaaataaccacatctaaggaaaaaatcaataaaaattccaattaaaaaaacacaaagtgttttttttgtttttttttgtttgtttgtttgtttgttttttgacagggtctcattctattgtccaggctgagtgcagtggcacaatcatggctcaccccagcctcgacctcctgggctcaagcaatcctccctcttcagcctcccgagtacctgggactacaggcatgtgccaccacacccagctaatttttgtattttttgtagagacagggtttcaccatgttgccctgtctggtctcgaactcctggcctcaagctacccacctgcttcagcctccaaaagtgctgggattacagacatgagccactgcacctggcccagaatggtcttttcaaaaagtaaagcagaacatgtcatttctttgtgaaaaccttcccgtggcttcccatcatgctctgaacaaagccaaactccttcttaagactgctttcacatggctcctgcctatgcctctggtctcatttccagccaggctctccctgtccgtgcacaccagccaccttcgttcttccctgggagcccttattctagtcgttctctctacctaggaggctcattcctgtcatcttcctatgcttggctccttcttgtcactcaggtctcagcttatataaggacatctcttatcacctgtgtcaagtagccacccagccctcgccacatgactctactctaattctcgccatagtcttttgcccatgacatttccagtgtgtcctggacaggtttactcttattgtcaagcatgactattaatagcacctcattcactctcaaaagtaggcaacaaggctggacacggtggctcatgcctgtaatcccagcactttggagggccagggtaggaggattgcttgagcccaggagttcaagaccatcctgggcaacatggtgaaacctcgtctgtacaaaaaatacaaaaattagctgggtatggtggcacatgcttgtagtcccagctacttgggaggctgagtgggaggatcccttgagccagggagtttgaggctgcagtgagctgagatcacaccaatgaactccagcctggtgacagagcaagaccctgtcgcagaaaaagaagtaggaaacaaattttatgatcactctacttataagaaacttatttttatttgactttgactagcttatcacctatctccttctatgaggatataagctctttgacaggaggtctctctgattagttctttactgtatctacagtacttggctcataggagatgcttgataggtatctgtggaaggaaggaagaaggagggaaggaaggaagcaaggaaggtaggaaggaaggaaggaaggaagggaggaagggaggagggagggaggaaggaaggaaggaaggaaggaaggaaggaaggaagcagggaagggcatgaggaagggaggagggtgggtgggctcaggccctgacttttcagttcctggtttcagacatcttttgtagtacgtactgggcttccataatctcccgttaaaattcctgttttgcttaacatagatggaatggttttctgtgagttataaccaagcaattcttgacacctgctgatttcttttaataaattgtccactttcctcttcatgctatactttacttctagtgaattgctttatttaataaagaaaaagaaacttttatcagcaccatccttttaaaaagtgttttctttaatcgtaagctgttgagaagtctggaattgcaaacaaacaatcctaatacaaggtaattctttctgctccaaaatctacaataaatattagtgacactggcaataaagcttcagatcctgattatgcatgaacccgtttttacaaaaacgtttcagtggaagatataaatgcattgtcaaaacagcattaaacccttgaaataagagccagattttttttttataattcaagtatgtaaagcatgtgtattgccatggcctttgggtcattccatttcaggaaattcatgctttaaaatagtcattgtcaaataagagccattcttggaggaaacgaaaggttgggtattattcattcaaagagaacaatccaaatatcaaaactcattttgttttgtttttaataggggatgctgggggttgggggttttctctgaacttcagataacagataatgacaggaatgttgattcatagtgcacaatattgagaaaaaataaataagctcattccccaagtaacagtaacagtctttgaacaaagaatgaggaagccaagcatggaaggagataaagaagttttactaaagaaatgtgccccataccacttctccaacctcagctctgctctctttcccaaaagaaaagattatatttaacaaccaaagaaaattagaagatcatcgcacctccttccagtagcccacccccaaaagcaacaagtgccatttctgtaagaaaggcactataaattcatttatttcatgaaaatccattgtactgaaatgtgctaggatttggatgtacagtgtgagtaaaacagacaaaatctctgctttcttggggcttgcaatcttcttgaaccctcagaaatggcccaaatcccagcctatgtgatttttccatcaaggaggcagcattccattggccctatagtcagtcaaggggcctgggtgaaaatcctggctttacagtttacgagctgggtgatctcaggacagttacttaatctccctatgcctcagattcctcatctgtaaaactaagatggtaataacatctacctcatagggttgttgggaggattacatgaggtaagcaatgtaaagcagttagatcagtgcctgacatagattaagcaatatttaagagtttgccatttttatcattagtacagcaaagtgggattgaccaaaaaggtctgtatttagaacagttaatcaatgaatataatgcaccaaaacatccctgtacatagtttcctggtagccaggcccagacaggaattatgaggtttcttatttggagaaactgaatggctccagagaaaagaccttgatatggttaggctttgtgtccccacccaaatctcattttggattataatccttataatccccataatccccacatgtcaagggaaagaccaggtggaggtaactgaatcacaagagcagtttcccccatgctgttttcatgatagtgagtgagttctcaggaaatctgatggttttataaggggctcttcccattttgcttggcacttcttcctgccaccttgtgaagaaggtaccttgcttcccctttgccttccgccatgattgtaagtttcctgaggcctccccagccatgtggaactgtgagtcaattacacctccttcatttataaattacccagtctcgggcaattctttatagcagcatgagaatggactaatacagacctccataggatagcattcagaaatttctcagttcacaaagcattcagctccttaatttaaaaagaaggaaaaaaaaatttccaagtattgcggccaactccctgctgccaatcgtcctaaaacaactaccctcagaaagttagccccaatgaggtctgaagcatccccgctccactctccagcagctcacgcttcattatgcatgaagagctaagggtgaccagaactttgataatagagagacaccaagaaaagcaggcatctcatcagaaacaaagaaaacataagaaactgaagagaacctgaagcccctgaaagatcaggggaagatattgcaactataaaataacatcaaaattctatggggacaaaaaaaaaaaaaaaccaatagagaacaagaaagtttggggagcattaaaaataaaattgctcaaattgaaaattcattagaacagttggagaataaattaaaaagcacacacacatacacacacacacacacacacacacacacatatatatacatattagtcaaccctgttcccctcccttaacagtggcatcaagagtctatcttccctaacccacttttcttccctatcccgtgccctgggctatattagagtgctcttgacactagagacatctggcagatgaggctggaaaatgtccaatgagggatggaaagaaggagtgatggcagaagtggagcccaacttcatacctttgcagccgcctgggctcagtttctgctgcccctccctaggtgctcttcccctctgcatagaggcgacacctgatgaagttttcataagtacacaaacactggactggaattacacagactggttgtgtgtccaggctctgctatgaagtttccaaagaggcaagaagcatgtccatcagaacagctattggcttgcaatcttgttgtcaccattaaccaaaaagaaagtatcaattttatttgaatggcctttggcaatgttggtctgagaatatgtggcatgaaataataatgattactattaaattgattataagtacatacctatatcaactgatatataaaagaaatgattgagccaggcacagtggctcatgcctataatcccagcactttgggaggccaaggcaggaggatagcttgagcccaggagtttgaggtcagcctgggctaacatagtgagatcctgtctgtacaaaaatttaaaaattagttgggagtggtgatgtgcacctatagtcccagctactcaggaggcttaggtgaggggatcacttgagcccaggagatcaagtctgcagtgaactgttataatcataataataataataataataataataataaactgataatgtgaaagaaaagattaatatgtaaaggattgatccaagatctcaaacatttgataggagttcctgaaagagaaaaggaaggggataaaataatcaaataaagaactttttccaaggtttgaagaacataaatcttcagattgaaagaacttagcacagaagaaaaacctataccaaagaaacagcatcatgaaattctagagcatgagacacaaagagaagaaataacattcctacttcacacgatacaccaaagttgatgccaggtagattaaagacttaaacgtggaagtcaaacttgaaaactttaagaatagaatatagcatagtatcctcatgtccttaggatagagaatgatttttcaaataagacatcaaatgtacaacatataaagaaaaatctgtggctgagcaggttggctcatgctgataatctcagcactttgggaggccaagactggtggattgcttgagctcaggagttggagactagcctgggcaacatggcaaaactccatctctacaaaaaatacaaaaaaacggccgggcgtggtggctcatgcctgtaatcctagcactttgggaggctgaggcaggagtttgagaccagcctgaccaacatggtgaaacccactgtctaccaaaaatacaaaattagccgggcatggtggcacgtgcctgtagtcccagctcgggaggctgaggcagaagaatcacttgaacctgggaggtgtagattgcagcgagttgagatggcaccattgcactccagcctgggcaacaagaacaaaactctgtctcaaaaatacaaataaataaaaataaaaacaaactagccaggcttgctggcacacacctatagtcccagctactcgggaggctgacgcaggaggatcacttgagcctgggaggtcaaggctgcggtgagccatgatcgtgcaactgcactctagcctgggtgatagagtaagaccctatctcaaaaaaacaacaaaacaaaaaacacccaaagtgacacatttgactacattaactttaaaacttatatttaatcaaaggagtctgacatgatttggatatttttcctgcccaaatctcaaattgaaatgtaatccctgatgttggaggtggggcctagagggagatgattgggtcataggctcagatccctcatatcttggtgcagtcctcatgatactgagtgagttctcacgacacctggttgtttaaaagtgtgtggcaccttccctccctctctcttactcctgctctcaccatgcaacgtgcctgctcccactccactttgtgccatgattgaaagcaccctgaggcctccccagaagctgagcagaggctggcacaatgcttgtacagcctgcagaaccatgagcaaactaaacctcttttctttgtaaattatccagtctcaggtattcctttatagcaaaacaagaatggccaacacagagaacatatcaaagctgcgtgattgttcactcatccttttgtcctttcctcctgtactctgactgcagttctcagccttacttgcagcaagtgtagccatgtgatgacatagtggtcaatgaaatgcatccatctgggacaaggcaccctccatcacttaaagatacacagctaacagggcgtgtgttttgttttgtttttgtttttgtttttttattctcagtgttcaagacatatttgaagggaggaggaggtagaggttgccatgagctgtgatggtgccactgcattacagcatgggtgacagagagagaccctgtctcaaaaataaaaataatatggaactcagaatagcagcatttaactgttcctagaactttctagaaatggtcatcattcaacttcagcaacacgtatgcattactactacttcacaccaaaatccccatagttgcaaataaaatatgaaagtgctttgcaaatataaaaggtaacataaacagaagtgtgctaagaggaaagaagtgctaaaaagagagtgaaacccacaaaaaacattattttaatttcagtaagaagaaacaattgcaatgtccttagcaattcacttaccctcacttgttcttcagtgtctaagtctgtaacatggaggtaataataatacctcccttataggattggcgtgacaattaaatgggtcaataaactttggagcttagaacagtgtctggcatttcagcataataaatagtttgtttttttaataatattgccttaaaaatgtcaatgctcacagccctcagtaaaatgaaaaaaaaagagaatgaattgagagaagagggggctgaaacataaaaggagctgggcattttttacaggcaatctgacttgaagcctctctacaaaattatgaagcagataacactgtgcctgttttatagataaggacaaagagtctcgaaactatatggctattaagtgtacttcaggcacattttcatttcattttactttttttcctccttttattttatttttccataatttattggggtacaggaggtatttggttacatgagtgagttctttagtggtgatttgtgagattttggtgcacccatcacccaagcagtatacactgcaccatatttgtagtcttttatccctcgcccccctccagtccttccttcgaagtccccaaagtccattttatcattcttatgcctttgcatcctcatagcttagctcccacatatcagtaagaacatatgatgtttggttttccattcctgagttacatcgcttaaaataatagtctccaataatagtctccaatctcatccaggtcactgcaaatgcgttaatcattcctttttattttattgctgtgtagtattcgtatacacacacacacacacacacacacacacaccacagtttctttatccactcattgattgatgggcatttgggttggttccacgattttgcaattgtgaattgtgctgctataaacatgtgtgtgcaagcatcttttttgaacaatgacttcttttcctctgggtagatacccagtagtgggattgctggatcaaatggtagttctaattttagttctttaaggaatctccacactgttttccatagtggctgtagtagtttacattcccatcagtagagtagaagtgttccctgttcaccgcatccatgccaacatctgctgcttttttatttttttattatggcctttcttgaaggagtaaggtggtatcgcactgtggttttgatttgcatttccctgatcattagtgatgttgaccattttttcatatgtttgttggccatttatatatcttcttttgagaactgtctattcatgcccttagcccactttttggtaggattgtttgttttcctcttattgatttgtttgaattcattgtagattctggatattaatcctttgtcagatgtatagattgtgaagattttctcccactctgtaggttgtctatttactctgctggctgttccttttgccgtgcaaagctctttagtttaattaggtcccagctatttatctttgtttttattgcatttgcttttgggttcttggtcatgaaatccttgcctaagccaatctcttgaagagattttccaatgttatcttctagaatttttatagtttcaggtcttaggtttaagtccttagtccatcttgagttgatttttgtgtaaggtgagatatgagatccagttttattctcctacatgtggctagccaattatcccagcatcatttgttgaaaagggtgtccttccatggactactacacagccataaaaaaggatgggttcaggtcctttgtagggacatggatgaagctagaaaccatcattcttagcaaactatcacaaggacagaaaaccaaacaccgcatattctcactcataagtgggaattgaacaatgagaacacttggacacaggaaggggaacatcacaccagggtctgtcgtggggtggggggagggggagggatagcattaggagacatacctaatgtaaatgatgagttaatgggtgcagcacaccaacatggcacatgtatacatatgtaacaaacccacacgttgtgcacatgtaccctagaacttaaagtacaataataaaaaatgataataataaaaagaaaaggttgtcctttccccatgttacatttttgtttgctttgtcaaagagcagttgactgtaagtatttgggtttatttctgggttctctactctgttccactggtctatgtgcctatttttataccagtaccacgctgttctggtgaccacggccttagagtatagtttgaaatcaggaagtgtgatgcccccagatttgttctttttgcttagtcttgctttggctatgcatgctgttttttggttccatatgaattttagaattgtttttttctaattctgtgaacaatgatggtggtattctgatggggattgtgttgatggcttttggcagtatgtagattgcttttggcggtatggtcattttcacaatattgattctacccacccatgagcatgagatgtgtttccatttgtttgtgtcatctatggtttctttcaggagtgttttgtagttttccttgtagagttcttttgactcctttgttaggtatattcctaagaattttattttattattttttatttttttcagccattgtaaaaggggttgagttctggatttgattctctgcttggttgctgttggtgcatagaagagctacggatttgtgtacattaatcttgtatccagaaactttgctgaattcttttatcacttctaggagctttctagagaagtcctaaggattttcaaggtaaacgatcatatcgtcagcaaacagtgacagtttgacttcttctctactgatttggatgccttttatttctttctcttttctgattgctctggctaggacttccagtactatattgaagaagagtggtgacagtgggcatccttgtcttgttccagttttcagagggaatgctttcaacttttttccccattcagtgttatgttggctgtgggtttgtcatagatggcttttattgcattaaggtatgtcccttgtacgccgattttgctgagagtttttaatcatagaggatgctggattttgttgaatgctttttctgcatctactgagatgatcgtgtgatttttgtttttaattctgtttatgtagtgtatcacatttattgacttgggtatgttaaaccatccctgcatccccagtatgaaacccacttgatcatggtggattatctttttgatatgttgttggattcagttagctagtattttgataaggattttagcatctatgttcatcaaagacataggtctgtagttttcttttttggatatgtcctctcctggttttggtattagggtgatgctggcttcatagagtgaattagggagggttccttctttctctatcttgtggaatagtgtcaaaagaattggtaccaattcttctttgaatttctggtagaattctgctgtgaatccgtctggtcctggacttattttgaaatggtaatttttaaattaccatttcaatcttgttgcttgttattggtctgttcagggtagctaattcttcctgatttaagcttggaaggttgtatttttccagaaacttatccctctcttctagattttctagttaatgcatgtagaggtgttcatagcagccttgaatgatcttttgtatttcagtggtgtcagttgtaatatctcctgtttcatttattagtgaggttatttggattttctctcttcttttattggctaatcttgctaatgatctatccattttatttatcttttcaaagaaccagctcttgtttcatttttcttttctatttttgtttttgtttttttccatttcatttagttctgctctggtcttggttatttcctttcttctgctggatttgggtttggtttgttcttgtttccctcattccttgatgtgtgaccttagattgtctgcctgtgctttttcagacctttggatgtaggcgtttagggctatgaactttcctcttagcgccgcatttgctgtatcccagaggctttgatagattgtgtcattattgtcattcagttcaaagaatttttaaatttccatcttgattttgtttttgacccaatgctcattcaggagcaggttatttaatttccgtgtatttgcgtggttttgaaggttccttttggagtggattttcagttttattccactgtggtctgagacagtgcttgatataatttcaattttattacatttattgaggctcgttttatggcctatcatatggtctatcttggagaaaattccatgggctgtcgaatagaatgtgtattctgaggttggatgaaacgttctgtatatatctgttaagtccatttgctccaaggtatagattaaatccattgtttcttcgttgactttctgtcttgatggcctgtctagtgctttcagtggagtattgaagtcccccactattattgtgttgctgtctatctcatttcttttcttaggtctattagtaattgttttatgaacttgggacctccagtgttaggtgcatatatgtttaggactatgatattttcctgttggataaggccttttaccattatatactgtccctctttgtctcttttaaccactattgctttaaagtttgttttgtctgatataagaatagctatccctgctcgcttttggtgtccatttgcatgaaatgcctttttccacccctttattttaagtttttgtgagtccttatgtgttaggcaagtctcctgaaggcagcagatggttggtgagttcttatccattctgtggttctgtaccttttaagtggagcatttaggccatttacattcaatgttaatattgaaatgtgaagtactgttgctttcatcatgctctctgttgcctgtgtactttggttttttggtttttgattttgctttttaacttgtatttttgttttatagatcctgtgtgatttatgcttcaaagagattctgttttgttttgtttcaagatttagagtttcttttagcagttattttactagtggtttggtaacggtgaattcactcagcatttgtttgtctgaaaatgactgtatctatctttccttcttacatgatgcttagtttcactgaatacaaaattcttggctgataactgttttggctgaagataggtccccaatcccttctagcttgtagggtttctgctgaaagatctgctgttaatctgatagattctcctttataggttacctggtgcttctgtctcacagctcttaagattctttcctttatcttaactttgaatgagctgatgacaatgcctaggtgaagatctttttgtgatgaattttccaggtgttctttgtgcttcttgtatttgcatgtctagatctctagcaaggccggggaagttttcctcgattattgccccgaacatgttttccaggcttttagaattctcttcttcctcaggaacaccaatcattcttaggtttgatcatttaacataatcccagacttcttagaggctttgtccatattttcttattcttttttctttgtctttgttggattgagttaattcaaagaccttgtttttgagctctgaatttcgttcttctacttgttccattctattgctgagacattccagagcatttcacatttctaaaagtgtgtccaaagtttcctgaattttttattgttttttctttaagctgtctattcccatgaatatttctccgttcatttcctgaatcatttttttcccttgcactgggctttgcctttctccagtccttccctgattggcttaataactaacctcctgaattcttttttaggtaaatcaggaatttcttcttggttggacccattgctggtgaactagtatgattttgagggggtgttgaagagccttgttttgtcatattactagggttgtttttccggttccttctcatttgggtaggctgtctgaaggaaggcctaggactgaaggctgttgttcagattcttttgtcccacgggatgtacccttgatgtagtactctcccccttttcctatcgatgtggcttcctgtgagctgaactgcagtgattgttgtctctctgctgggtctagctgcccagcgagtctacctagctcagggctggtactgggggttttctgcacagagtcctgtgatgtgaactgtctatgggtcacttagctgtggataccagcacctgttccagtggaggtgatggagagtacaatggactccatgagggtccttagctttgtggtttaatgctctatttttgtgctggttggcctcctaccaggaggtggcactttccagaaagcatcagctgtagcagtatggagagggaccagcagtgggtggggcccttgaactcccaatattatatgccctttgtcttccactaccagggtggatagggaaggaccatcaggtgggggcagggctaggtgtgtctgaggccagactctccttgggcgggtcttgctgcggctgctgccggggatgggggtgagattcccaggtcactggagttgtgtacctaggaggattatggctgccttttctgagtcatgcaggttgtcaggaaagcaggagaaagccggcagtcacaggccttaccagctcccaggcaaaccaaagtaccagtctcactcccaccatgcctcccacaacagcccaagtctgtttccaggtggagggtgagaagggcttgaaaacttgcccaaggctatctgcctcccagctgcaagagaaaaaagctttagttctgcccttgcctgtgaagtctgaacacctgattcacgccctccccttagttctggccaggaggcttcttgccctgtttaaattgttacaaagttcaactagagaattccttctccctgtggagttttaccctctgctcctctggccaccctctggatggatccctgtggtgtcaggcaggaatgggctgtctggggacccagcaagctcccaaggcctttctgctgcttcctctacccctgtgttttgctcagctctctaacttgactcaggatcatgtaaagtcagaagcttctcccacaaacagtacttcagtttctccagtgggggtgtgtgttcgggaaaggaggatctccctttcccaattcaacagttggggcactcacagtatttggggtgtctcccaggtcctgcagaagcagtccacttctttcagagggtctgtggttcctctcaggattgctggtttgttcttgcagttgatctggagataaaattcacaatgcaagcctccgcatgctgcattttcattttaaaaggcactacaagtgctttacctttcagagaagccatataattccatagacacactccattatcatatgctaaagattatttaagctgttcattcttgctaaattgaaccataatcaaactgtcaagaaggcatagaaactcaaagactgctgttaaatcacccttttgccccctcattagcagggaaactgacctcagatgttttcatctcaccccacaagtgttatttctccagcctttactcactgccccttccctctacagtcctgagcctaggtttctagaagaagagaagctgctttggatgggtcccttctcccatatgtcccaccctctctctctatttaattttggcaaccttggctaatgtcaccagagatgtgtctgattttgtcagttttctcaaagaagcaacttgccattattgataacttttattttatctttgttttctattctatgtaatttacatgtattaagtttttagcctttgtagtgtatagttctgtgatttttgacaggtacaatcatgtaggcagaaccatgaagatataaagcattccgattatctctaaaaattccttacaaccctttgttgtcagctccttccctcgcctccaacccctgaaaattaccatgtgttttctattcctccagctttgccttttccagaatatcatataaatgaaaccatgtggcatatacctatttgagtctggattctttcagttagcataagatatttgagattcacccagttgttgcatgtatcagaagctagtttctttttattgctcagtggagttccattgtttggatggactacaggctgtttatccactcaccagttgaaggacattggggtttgggatgtgatatggtttggctatgtccccgcccatatcgcaccttgaattcccacatgttgtgggagggacccagtgggaggtaattgaatcatgggggcaagtctttcccatgcttttctccggatagcgaataagtctcacaagatctgttagttttaaaaaggtgagtttccctgcacaagctctatctctctttgtctgctgccatccatgtgagatgtgatttgcccctctttgccttccgccatgattgtgaggcttccccagccatgtggaactataagttgattaaacctctttcttctgtaaattgcccagtctcaggtatatctttatcagcagcgtgaaaacaaacaaatacagggtgcttatgaataaagcttctataaatacttgcacacaggtttttatgtgactatatatttgcaatttgcttggataaacatctaaagttggtattagtgggtcataaggtaatgatattttaactttataagaaactgccaaactttttctaaagtatccataccattttgcattcccaccagtaatatttaagagagagttccagtttgggtacagtggctcatgcttataatcccagcactttgggaggccaagggaggaggatcacttgagcccaggagttcaagaccagcaggctccatctctattatagttaaattaaaaagagagaggctgggcacagtggcttacacccatcatcgcagcactttgggtggccgaggtgggcagatcacttgaggtcaggagttcaagtccagcctggtcaacatagtgaagccccgtctctacgaaaaatgcaaaaattagctgggtgtggtggcacatgcctgtaatcccagctacttgggaagctgaggtgggagaattgcttgaacctgggaggcggatgttgcaatgagccgaaatcaggccactgcactccagcctgggcaataagagtgagactccatctcgggaaaaaagaaaaaaaaaaattaaagagagagttcctctgcatcttcatgagcacttggattttttatgtttctttttttgttattattatttttattttttatttttttctgagacagagtctcgctttgttgcccaggctggagtgcaatggtgcaatctcggtgcactgcaacctctgcctcctgggttcaagtgattctctcacctcagcctcccaagtagctgggattacaggcacctgccatcatgcctggctaatttttgtatttttagttgagacagggtttcaccatgttgaccaggctggtctcaaactcctgacctcatgtgatctgcctacctcagcctcccaaagtgctgggattacaggcgtgagcgactgtgcctggccagcacttgggttaaaaaagttttttttagctactttattttgggtttagtggtatctctttgtggttttaatttgcattttcctaatgatgctgaatatcttataaatgcttattgggcatttttatatttaagtttccttttgagttgtttgcccattttttaattgggctgtgtttttcttattttcgagctttaagagtccttcatctattttgtcctacagcacatattgatttcctgcttccttttttatcctcccaggggccacatctaacatttttgagatgagcatacagattgtgttttgcccagagccactagtcacaagggaaggaggggtccagatattgataaaagatgggaaaggccttgattgtacagtaatccaaagttttccactgtcttcatctaagttagaacaacacagtgggtctatgataagagaaaataaagaaacaacatggcacaaaagtcttaaggaatgggccaagctagtgaaagaagttagtttagtagctacttcactctgagacaggaccagaaggtacaattttcattctaccctttgctcaagattaaggatttattgtatgcccctcatcttcagtttcaacaggactgatctgattggctgagcactggagccaaaacagagaggaagaggtagcgtccaaagacgaggagacactggaaggagaggaagaggagtgcccttgcgcacaccagacagacagctcagtatgtactgagcaatgattttcttttctttgcttttttttggttgttgttgttattgttgatacaggatctcactctgtcgcccaggctagagtacggtggtgtaatctcagctcactgcctccctggttcaacctatcctcctgcttcagcctcctgagtcactgggactacaggcacatgccactacagactaatttttgtattttttgtagaaatagggtttccctatgttgcctaggctagtctcaaactcctatattcaagtaatccacccgcctcagcctcccaaagtgctgtgattacaggagtcagccaccatgtccagtaagccaccatgcccagcctgagttatgattttctatgttgcaacattatctggactccttgtgcacacttggtcaatagaaagatttttaggtaggaaaggcttagaaacggtaatctgtttaggagtaaaagaaagagcaggaggggcatgccgctatgtttgcaaatctcctcccaaaagattacaaatatcaatactccatatcaaagaagagagcagagatgaatctttatgctaatggactgtaatatcaatcttctagccattcaggacaaagtgaggataagaattagctcaactccccatcactgtttccactacatttttactttcacaaaggagaaaaattttaaatattctataaattataattatatactataaaatataattgttatatgataaatataatatataattataatatgcatatttgtatattttaatatatgtactcaatcactggcttttaactttagtcaaataatcgaaaccatcttcaaatttctgactccatattacttacttgacctgagaatatgttgtgattttgaagtactcacagcatccaggaaatgaaaaaagacaacctcaaattgcccaatctttctatgggaaacataagtagtatatttttatttcctttctctatgtcaaaagagacaattaaacctgcaatacagaagtctgaattccttcaaatcgacatcaaattactgtgccctagtaagtcaccaaatgtcttgacctctgcagattttttgttgacccctatactttggattatttccttaattatcagaatttacatagggctgttccacattgtggcactctatgcaagatgagtggttcagaaaacacatcatcatgggtcatcgtttataatgagaagtagattaacccaggggcatgccatcagatgatctgccaaaggtacagttgacaaagtcttcatcagtcagtactgatataaataccatcctcctcagcagatcatttgcaatgtgtctctcagagctaaatcagtactctaattgcaacatcagttaggggccctacttggtgatgagaggggcaaagataagaggatgttctcaactgaagctatttatacacaccacgtagtccttaattatctgtagggagaggagggaaataaagagaaggttgacatgactgaaattgaatccacccaccgccctttgtgccactccagcaagagaaaattcttactaagtaagaaaagtacttactttctaagagaaaaaggtaagaaacctccagttctatgagagtacagcctactcagttgccaactgatatttaaatgctaatactcctttttattgtgtgagtcttacaaccattcaagacttcaggagacttaaaaaaaagaaaacttaagttttatatccccaaaattaaacaagcagtctaggtagaatctccttttatcgttatagaaaaaagttgtggattagaaaattgattcagctatttcagaagtttggtcagtaaaaaatccagacttaaatacaagaaaacttcctggaactcaacatacaattattgataactgttggggctcaaaaaccaataccccagaatatgatgttttgccttcctgagctgaagaagcgtcagggtctctctgaccttccctgcccccgtccaagcgaagctgaagtttctttagctgcctaagatgcagacccaccaagaacaattgttttttcttaccaagatataaccacacctgagcagacccctttatcatttaaattccaaacagaactatttacaagttaatcctgcattgccccttaatagaattcctcttccccctcttctataacctgttttaccaggatccaagcccccattccttctgtaacctcaagatggtttataagcttctataccacactgagtagctgggccttcattctgaaggctcccgtgtatacatggcaaatagatttgtatgctttttctcctactaagcaatctgcctcatgttagtgattttcagtgaacctttagggggccaagagcctatggcccccacattacatattcataaattgatatatgccaggagattcaaaagatagtacaggatcaaacataaggtacacttgggaagaaataactgtaataataactgcctttatttagtgcttctatgtgtctgggactgtgctaaaaattttgcctatattttctcaataaattctttcagcatctcagtaacagatacagaattatccatgtattactgataaggaaactatggctcagaagattaatcaatccaagccacatagcattaaaggagaagtattaatattcaaatactcatctgactccaaagcctatatcctaaaatactactctttatggtacatatttgtatcaacctcatggcttatcttacccatacttcttgtgttcccataatgttgactgacctttttgttgatactggcccaattgtcccatagaactgatgtttatggttttttaaataaacagaaattgactctccttgatcttaaaacttgaaacttacattgttttatctgagttccttcctcaggaaactgactctcaggtaagaaactgaaactcatcagatcactgcatccagccagtgaagatgccagacccctcatccgtcatgattgcttcctgacccctccatgatttctgttttcccctacacagctaccttcataccctgctgtataaccactaaataaacccccaattttatttggttgggagagatggacttgaggctgatctctcctctctccagctaacaagatccaaataaaaagttttcttccctggcaatactggttgtctcagtgattggttttctgtgatgtgagaaaggtgacctagactgaacccctggcatttcagtgacattatgacctttgaaggcatctcttgccatttccccatgcatctttaagctgtgaatccactgtgaactgtttaactttctggttatttcccagctccaatctaacaatgaggtcattgtaggtctacatctttccagtctgcacagagactttgcactgggcaccctgacaatccagtgattgtgcatgtgtcctatacctagtctcattccaatcagccagtggctggcagagagggagcaggagaggaagggtaccctgcccttttagcaggggttctgtgtgggccagctttccttggcaaagctacagaaactgggattgacttgggtaacacaaatgcagactagtttgaaaccatcaaaaatgatactgtaaaataatatttaatgacatgaaaaagtccactaagttaaaaaataaatatatgcatttgtatatatgcactcaaagtctaaaagaatgttcattaaattattaacaattatcttgagaaccaggaacaattttaactttcttttttattcctttttgtgttatttgaacttacaataataaatgtatatatttgtaaatgttaaaaaatatgtaaatgttttctcttttggaaagaaataagaatctatgcataccatttgatgaagccatattattattattattattattattattattactattattattatagatggagtctcactatgttgctcggactggtccaaactcctggcttcaagcagtcgtttcacctcaacctcccaaagagacatattattttttaaatttatcataaaaaataaagatgaacttaaaaatatagccaggaaaacattcattgccatattggcaagataaaatttcaaataaaagagtccaacaacacaacattgaataaatatatccatcaatggatattttgtaattttaaatatattttattttaacagatatgacatggaaatatgtgcacaatatattaattgaggggaaagttacaaaacaatagagtatggatctgttttatagttaaaattcacgttaaatatatttacgcctagaaaataatctaaatttaacaaaaagtaggtgggattatagattattttaatcaccttaaatttatgtatctatatattttttattatcctacagtgaaccttcattacctatgtaattgttagaaataaaggtgggggtttgggggctttatctggttggggttttcttttcttttcttttctttttgtttttttttatacagatgaggtctcactaagttgcccatggtggtcttgaactcctggcctcaagctgtcctcctgcctcggccttgcaaaacattgggatcataaatgtaagctactgtgcccagccttgggtttctattttatttaaatatcaatggctctcattgggatttaggagttttcttttttgtcatctcacttgaccttgctgagagcacatgggaaaaccatcagcagttaaggttgtatagtcccaaaacaaaacagactagactaacgagtgtacattttaatagagaaggcagaggcaatttctcaatcaccatattaggttttcttaatgagtgttcatgtattcatcattgagtggcagattgtccccagagcctggttctactctataaagtcctgtgcgcctcatatccatggtaacaaaatatctgagagtttttatttgcaaacttggcaggctgctggaaagcaatggtgaggaaacatgaatattctaaggtagtacattatttcacagtagctgtaatatgaaaattatacctttatgaaaagtattatcttcctcaaaaaactgaaaataggattgttactggtagctaatccatatgggtctgcagcaacctcaattcttgccaccacagaagaaagaatttgaggggcataaggcagaaggagagactgaagcaagttttagagcaggagtgaaagtttattaaaaagctttaaagcagtaaagaaaggaaggaaaatacacttggaagaaggccaagcaggcagcgtgacctcctgatttggggttttataggttggcgtgcttccaggatcttgcattacttcttctcactcctgagatcttattgggaagctgctgatcagtttcaaatgttttctatctattaggagactgcctttccctggcaggagctgtaaccaattattactttacagaaacagttaacgatgttgcccaacactcctggtgtgtgtgtgttgcaggggctggggccctctcctgccctgctcatacctcactatcttcccactgtaacagggttaccattgatttggcagttccacttctaagtacctacccaaaagaattgaaggcagggacttgaatagatatttgtacacccatgttcataataatattatttacagtagccaaaatatgggagtaacccaaatgtccattagtggatgaatagataaacaaaatattatttagtcttagaaaagaaggaaattctgcacctgctacaacatggatgaaacttgaagacattatgctaagtgaaataagccagccacaaaaggggaaactgagtatgattccactcatcgtggaactagcccctcactcaacattgatgtaagatttgtccatgtgaatacctgtaaatccagttaatcattttaactagataagtcatattcatagagacaggaagtagaatggtggttgccaggggctggaggggaggaatgaagggttagggtttaatgtctacagaatttcagctttgcaagatgaaaaagttctgaagatgaatggtggtcatggttgtacaataacatgaatgtacttgctactgaactgtacacttaaaaaatagctaaaataatatattttatgccatgtaaattttataatttttaaagaaaaatctatataaactaaaaaatcattgtcaggcatgtaatttctcatgtagctcatttagctctaagatatatttcaaaattgtcttctttccacttccatggtccctggcccagttcagaccttcttcctcttatatgacctgaattactgtaatggcctccagaacttggccatgtctttctcccctccaactcattcctttacctatctccaactttatctttctttttccattttatttatttatttcaatagcttttggggtacaagtggtttttggttacatgggtgaaatgtacattggtgaagtctgagattttactacacttgtcgcccaaggagtgtactttgtactcaatatatagctttttatccctcatccacctcccacccttccctcttcttagtctccaaagtccattataccactctatatgactttgcatacccacagctttgctgccacttacgaatgagaacatatagtatttggttttccattcctgagttacttcacttagaatgatagccttcagctccacacaaatttctgcaaaaaacattatttcattcttttttatgactgagtggtattccatggtgtatatagatcacattttctttatccactcattggttggtgggcacttaggttgtttccatatctttgcagttgcgaattgtgcctcagcattatctttctattatcctttcatttacgaatttttttcagacccacagaagataatataagcacccacttacctgccactcagattcttaaagattattatcagtcacatctttttttgtattctgtggtgaccccatttctctccttccccagagtaaaaactattctaaagctggtaagtatcattctgtccatacttttacacttttataacatacatatatatgtgtgtatacatatttatgtgttgtctgtacatgcatatgtatatatgtatatactcatataatatgtatatatgtatatgtatatatgtatatactcatataatatgtatatatgtatatactcatataatatgtatatatgtatatactcatataatatgtatatatgtatatactcatataatatgtatatatgtatatactcatataatacataatatgttgtttcatgtgctttaaaaatctgacacaaatgctattatgcactatacagctttcctcaacttgctcctttcactcaacattgatgtgagatttgtctgtgttggaacatgtagacccagtttatttattttaactgctctagagtattccactgtagaaacagtaccatgatttatttatcccttcctctactaatggtcatctaggttagtttccattttttgttttacaaacaatgaataatccttccaaatatgtaagttcctctagggtgtacacctggaaaggcaattactagatcttaggatcaatgaggagcatttggatacagcaagggaaaacctggctcacaaaaggtctagagaagaatgttgctggaattgattcaatggctaagagatcagtgcctttattaatcttttgaccttcccttcattgtctcaacatgactatagcagttctaaacaccacttcctcagaccatactcaaaatcaggcagtgagggagagtacataaaaccatccagcagacatcctatttctcattggctagaaatgagtcacatagcaaccactagatgcaagagagaatgggaaagttagtatttgggttttccagcctctacagtgggagatgagaagggagaagttgttggaaatggcttttgggtacccaaccaatatatctaccacatcattaagttaactagatattgtgaaattgctcattcaatatagttgaacaaatttacacagcctcaagtaatatatgagttcccatctcccaaaattctgtcgatattgttagatgctttattttttgccaaaataatagatgtcaaattgtattatctcattgtggctttaatttgcattgctttaattattagtgaaatacagtgccttgtcaaatgttattgattatctagggttcctattctacaatttcctgattatatgctttatcccttttcccttgagtttttttgtcctttttttattttgttaaagaagttatgtttttttaaatatagtctagatactggtatttgtcagttttatgtgttgcaaatatcttctcccaattagtgaatttcttttagatttgtatataatgtccttgtctttatgatttacatttattatggtcttgttttaagaaatctttctctactgtgaagtcataaagacatttcctatattttcttccttcattttttaaagtttctgatctgacaaataggtcttaaatctctctaaattgatatgttcatatgaacggatattcatttttccatgtgaactatttcagcattgtctattgaataattcacaattcattgatttacaatgtctttccatcatatattatcatatatgcttgaatctgagtttatatgtcagcaataaattttttaaattgtgttatttaaatagtctatacctttactaatttttggtctatttgatctaccagtttctgagagagatatgacaaaatctcttccctttttatcataaatttgttgatttctactggtcaaatttttctgttacatattttgaggctaagttgttgaatgtatgtaagttcaaatgtagtaatattttcttggagacatgtaccttttattaatgtcttctttaatccccaagaatgattattgtctaaaatttttttgactgatggtgatattgttaatgcagcttttttttactcagtatttttgtataatttttttccattctttgattttcaaatttttgtgtcatgttctagaagtgtacattatattcctttttcctccctatttgaatgaaaactttatgttctgttttattattttcatagttaccctttaattttgagcaatactgaactaaaattctaaaattaatcaatttccctattgctctctggaaaaaactattagcttcttaaaatactttaattctaatccccccttccattttccatgctattattgtctagcattttcattcccccttgctttaaaaccctctaaacatgtctacgtttgagcagtcaatacccatgtagacttatcagcatgtttaccaatttgcttgtttaccattcttgcatcctactcttatgaggttattatatccaaagtatatccattagcaattctttcagcaatggtttgtgactctcaatgtttcatctttctttgaaaatctctttagtttgccctcatttataaatattttagctcagtatacaattctaggttaacaattattttccctcaacacttcgatggtatgagtccactgttttttgacatctattattgctgaaaaggtactgctgtaagtctatttacaactattgttcactagttggtagcatgtctaacattttatagctatgaagtttttcatttttgcctttggtacttcactatggtatgtctaggtgtgaatttgttcttagtttttattaatgctgctttaacctgagaagatatttttcttcaagctggaaaattcgtcattatcttttcacacactgcctctcctacactttttctattctctcctgaaactcttattagatatctattgtaccatctcattctattcttcgtgttttcatcttagttaagtaaattaagatattttcatacctttatttattttttttctttctctaagctgtattctggatgatttccttgaatctgttttccagttcattaattttctcttcaactctatgtaatcagatattaaatcagtcccaaatgggtttactttcaatgaacataattttcatttctagaaattctatttgtatccttttcaaatatatgaattttacattaatgttgccctattctttcctacactttgaatttcttattattaaattatatttatttaataatattaaattatattatatttattattattaaaatataaatattttaaaaatatttattatattctcactcagattattctttcatctcagtttgttgggatgttatttttcctattcattgcatctgttagttatcttacagtgttttgttttttatgtaacttgtaaatattcttagcattttgaattcattttcacctggaattgccttttctaagggaatggtctatatcctgagttatgggtgcttatgtgcagtacctaataagaggtgaaagtttcccaggtccaggaacaaagtacagtagtcccttgttatccatgggggatacattacaagacccccagtagatgcctgaaattgcagatagtacgaaatgttatatatactttgatttttttctatacatacatacccatacctatgataaagtttaatttataaattaagcacagtaagaaattaactttctttagcatatatttggcttttctttggcatatcaaaattgccagcatcactactattggccttcggggctgttatcaagaacaataaggtttacttcaacacaagcactgcagtaatgtgacagtcgatctgataagcaaaggctactaagtgactaacatgtgagtagtatatacaacatggatatgctggaaaagggatgattcatgtcctgggtgggacagagtgagatggcatgagatttcatcatgaagctcaggacagtacacaatttaaaacttatgaattatttatttctggaattttccatttaatatttttgaactacagtagactgtgggtaactgaaattacagagagtgaaactgtggataaatggggactaccgtattacagaggtagcaggagctggccacagagtgttgcagggggcggggggtcatcatatgtgcctccagccacaaggtatcctttttggaatttgacagtgtataaatatcattactattataccctagattttcctaatacagtcataatttcagacattgtcagtcctcatgttaagccagcgtttttcgctgcaggttgtgaagtatcagtgggttgtggaatcaatttagtgggttgacctgcagggcttttgtttttaaaatgaaatgcagattaaaatagaataggaaatgtcagagttgcattatgtaagaggaagtgttgggatttgaaatgttttgcagttacaaatgtatatgcatgtatgtgatgaaaaatgtatttcatgctgtgggtcatggtcaaaattgtttgaaagcctctaagttagataatatgtccagatatgagaattagaaaaaatggaataaattataaattagttgattttgttaaagtatttctatcagtaatcagagaagccagcaaaacatggtggaatgcaagtccttagtgttcctagtttatcactgcccttttcagaagcatatttctttctgaattcactccaacgtctccacaatctcgataggattttcagctctcttttgtgataatcacgtagaagtatgtctgtatgtgattatcataaaaggaaagcctaagtagtaaagaatatcaacaaatagcagattgctttaatattttagtctacttaagtaaacaaggatttttcctacccctctggctctttaaacttataagcttacatgttgatatgcctcagaaaattttatcttctcaacctcttgggttaagagaggcctagtgaggacaacatgggcggtcgacacgcttgcccaggatgaagcagtcagctagttgataccatgtgaaaccatgggaccccgtgttaacaaatctaattttcaaagagaaatgagaaatttttatttttatgtgaaatatcctgtttttaaatgttggggccaggtgcggtggctcacgcctgtaatcccagcactttgggaggctgaggtgggcagagcacttgaggtcaggggctcgagaccagcctggccaacatggtgaaaccccatctctactaaaaatacaaaaattagccggatggctgggcacggtggctcatgactgtaatcccagcactttgggaggccgaggcatgtggatcacctgaggtggggagttcaagaccagcctgatcaatatggtgaaaccccgtctctactaaaaatacaaaaattagctgggtgaggtggtgtgcgcctgtagtcccaggcactcaggaggctgagacaggagaattgcttgaacgcgggaggcagaggttgcactgagccgagatcactccactgcactccagcctgggtgacagagcaagactccatctcaaaaaaaaaaaaaaaaattagccaggcatggtggcacatgcctgtggtcccagctacttgggaagctgaggcagaagaaccacttgaacccgggaagcagaggttgcagtgagccaagatcatgccactgcactccagcctgggtgacagagcgagactccatctctaaataaataaataaataagtgttggaaatttattcaaaataatttcaaacactgtgaaagacaatgtgtccacaggcagccccatttgtgatctcttcccccagaagcatactagataaaacttcacaacgattactcctcagagcctccctaactttaccccattctcaccttccctccctcaccctcacgtcaactgctctccactttgagttactaacgcaattgatatgtgcctctgttacactgcttatgacattatatggtagttatgttgttgctgtttgctgttgttttcttttaacatatccatcagctctgctaaaaaataattaataattcaatgtggaatcctgaggttggggctgtcatagtttgaggaaatcagtttgaatcccagccctgatgagacaactttgggtgggttttcacatctaaaatgtgagtgaattataataatggataacatggttgttgcattgtcagccttgcaggagaagccatcacctcgaattcacatgtgcaggggacactgcaatagaactttctttgccttgatgtaaactgatgtcaattggacagatgtttcttggataccatctattcccttttgctgcagcctcttaatggccctctcaagcttctcaaactaggcatgttccatatgctgggaaaagtcatgctctgtttgacagtcaccttccgagggcctctgatagcagaactcggtgaggattatggagatagattgatggggagatcagccatcttgctgccacacacaccttgacagagagatttactgcctctccaatatcgcttccgaatcaactttttttttttttttttaatgggttctcactctgtcgcccaggctggagtgcagtggcacaaacatggcttactgcagcctcagcctcctgggctcaaggaatcctcccacttcagcctcccaagtagctgggactacaggcatatgccaccacacccagctaatttttgtattttttgtagagacagggtttcaccatgttgcccagggtggtctcaaactccttggctcaagtaatccaccagcctcagcctcccaaagtactgagattacaggcctgagccactgcacccagcccaaatcaatttttgctgttcattcccaagaggagaaaacattaaaaggttttccttttttccatttttcctttcttttcccctcaacctcccttcttcacccttataccatcctccttccttctggcactggttccccctcaagcaaaaagataacgtgtacctccaggattcttgataatcaaacaccatatgatttctatcagctgaatgcctggcaaagcaatacttccctcatcaaaaattaaaactggagtggcatttactttcctccaatatcacctaagaagttatagtaggacacgaagccagaaacttctcaatctcagcttttagttgagattattttgcccattggattatggagctctttcaatggtgaagttagtaaatttaaattatcgggaaattaacctttaaccccattgaaatggtcagagtaattctcaatctacagaaggaaaaaacaaaacatggcaactgagtgatttgttctattacaaatcctgtacaaggaataatttggaaactgggtggcttgttccaactgactataaaagttgagcaaatagtcaaaatgcctattatgctaatttttctttttttctggattctatgcataaggccagtgtgaacttaaagctctagttctttcatgcctgtaataaaccaaaagtttctgctcagagcagagtacagaattagaattgcccatttgtccttttttactattcttttaagacttttgcaggttcacaaatgatataacaggacactcatgaacgctgagctacagcaacagagacacatgtgtatctgtagtcagaccttcccacaaggcttcaggaagaaaccttgagtgcagactgatttttttaaattaagattatgggtagtaggccaggcgtggtggctcacgcctgtaatcccagcactttgggaggccaaggtgggtggatcacaaggtcaggagtttgagaccagcctgatcaatgtggtgaaatcccatctctactaaaaatacacacaaaaaaaattagttgggtagcgcgcacctgtaatcccagctactcaggaggctgaggcaggagaattgcttcaacccgggaggcagagggtgcagtgagccaagattgcgccactgcactccagcctggggcaacagagcaagactctgtctcaaaaaaaaaaaaaaaaaaaaaattatgggtagtgggtggaatattgagagtttatatgagccaggcactttctagatgctttataaggtcccatcatcttcacaacaactccaaaaggtaaatactagcattatttgcattttgccagtaaagaaaatgaggcatagggaggctgaaaggcccctctactatgtgtctgaattggaaccaggaaggcccatttcaaagcccacaatcttgaacactccgcaggctaaagcctcagaaccatgtctttctctcaatctggttggttagtgatgcaagaaaatggatagtcacatatacctttgtgtcatttatattccttttgtggagaaatatgcttgcatttatttatgacaaaaatctggctgggtgcggtggctcacgtctgtaatcccaacattttgggaggctgaggtgggcagatcacctgaggtcagaagatcaagatcagcctggtcaacatggtgaaaccccatcttactaaaaatacaaaaattagccaggcatgatggaacatgcctgtaatcccagctactcaggaggctgatacaggagaattgcttaaaccagggaggcagaggttgcagtgagccaagattgcaccactggctctccagcctgggcaatggagtgagactctgtctcaaaaaaataaataaataaacataaaataaagtaaaataaataaataaataaaaattaaaaaatctagagtggctaacctagatggaagtttgcctgtggacacacgaaagggggctggccactccatggttttaggcaggtttctctaaggggacaaggtttgagaaaagctctcaacaaagagaaggatgggggttggcagatgtggaaaaagagcttcctcttgcctgttcctggcacctcggccccaacccagatgtagagagcttgacttcagagactgctgccaaccaggcaggaatggggccaggggtgacagctggcttgggaaaggtggaggctgcccaaactttaggaaaactctttatcttggcaatggcaggtcttcccattcatcatggaaaggtaaatataggaagccatgagataaccatctgctaatgagggtttactttactaaggcagttcttacttacagatcaatccctggcaagtagttggtatttcccattgttagggaaaatagatttgtcctccaagatactctcaatacttcaaatctgacactaaataaaagaacaaacagtgttttctatgctcacactcagcacagaacacttctgtgaccagatgtgtggcctgttcccatgccagacaattctccaattcccacgccagacaattgtaggacaactgggtgtcctacaatttaattcaattcagacactatgtacctggaagtagcgtcagatcccacaggttcagggctcagtaccacaagacttctccccacctctcccccacacttcagacaccaatcatgagcccaagttgtcactggtgcctctgactgattggctgtaaatcagagcttcccagaacccatctcaggttccatcgtttcctagaatggctcacagaactcagaaaaacattttgcttactagactaccagtttattacaaagggtactgatagggacaggaggcagagaaattctaggcagaaaagggcagggtccctggtgaagccccaccttcaagcatggaaccataacctaaagtgaaaacgtgcattcctgctttcccgctcaaatgttgccttttccaaaaccacacacggccctctccaccccccatcctgtacccataaaaacccctaacccaactggtggagggcagagaaggggagaagagaagaagcagatggacgtcagagactgcggttgcacatcagagagaagcagcttgactttagagggacagcttgacggtgttgcttcagagaggagtccagctgggtatggctgtactccaggggaagatcaccttcctgctccatcccccttccagcttcccttcccactgagaaccactttcattggcaataaaatcctccacattcaccacccttcaattcgttcatgcaacctgagttttcctggacaccaaacaagagcttgggtgccacaagtgcagacactaaaggctgttatgctgatcctctgccctcatgaataggtagagggcccactgaactgtttaacacttaaggcatctgtggacagcaatgctaaaagaccactgtaacacacgccctctggggcttcatgggtcacagggaccacaccccctctccgcccagatgctgtcacagggcctcacagagttttgctcctgctggcgcccaaaaacgcttactccagctcctgcacccgctcacctgcatgctccccctccctcaaggggttaagagctgcaggctgagtaagggaagcaccccatcacaagggtcaagggaaatttcttgtctcagtacaactcagaaacagccagatggaacagatatgttgcccttgcatatgggaagatactggacacagggtgcagagcttccttgccctctccaggtatgccacccaccaggcacctccgcaaggtcagcaacccacaaactctctgagcccatccttctgagtttttaaggaagcttcattactgcataggcatgatcgattacatcacttgccatcagtgatcaaccccctcagccttcagcccctctccccttacctggaggtaagagttgagtggtggggctgaaagtcccaaccctctaatcacatgattgtttcccctggcaaccagccaccctacctccaccccaccctgcttgtccagaggccatccagaagcccccagccttcagtcatctcattaacatacaaaaagacacttatcactaaggaaattccaggatatttagttagttagttagttagtttttgagacagagtctcactatgttgcccaggctggagtgcagtggcataatctcggctcactgcaacctccatctcctgggttcaatcgattctcctgcctcagcctcccaagtagctgggattacaggtgtgcaccaccatgcccaactaatttttgtatttttagtagagacagggtttcaccatgttggccaggctggtctcaaactcctcaagtgatctgcccaccacggtctcccaaagtgctgggattacaggcatgagccaccacacccagccaattccaggggttttaagagctgtctgccaggaaatggaggcagtgaccaaatatatttttgttactatatcacaccatgtacatttttaaaggcctgagtgtcatttctaaagaaaggagggggtagtaggggctgtcagaagtgggtgcaacattctaaacacagttgccctcactggcattataaatcattgctgttcatttttaaataactgtgcacaagaaaaaaaaacagctttagaaacctttacaaatttaggtaaacttgtctggagtttttggttgtttcgtttgtgaaaagctgttttcacaatcccaagcattgataaatgaaagctacagcatgcctgcataacccaggaaggctctggacagatgacctagctgagaatgagccagcacttgtatccacagtttctaccttctaaagatagaaataactgggcacggggcagggaagggtgtcccacagggacattttgaccaatgctaaagaaataaagaggacaggagcccccaccacaagttcagccagattcagccagatgagaatggtaagtgggacttcaggggagccagagccaacaagagagaagtcctcggtcatgagggcatgaaatcagagggacaccttagggtggcctattggccagctttcagtgtcccattgaaaaagcatgggttgttccaagccactgagcagctgccctagggagcattcagatacttgcccaatagtccacagggtgacccacatttttgttgctgttgttgttctttcaagaggattgagcaaggcagtcgactgacaacttgaaacccagcccagctcactggcctcatgggggtagaccagcctgctttgtgtagtacatccaactctaaactagatttccttgcttcctactgggccagtccaatgtgatgcccatgtcttacagtcttccaatagttttaaaaaaaagaaaatggaaacaaaggaaggaaggagggaaggaaggagagaaagaaaggatggacagacaagctggatttctgcacctaagtattccagttaggagacaggccaaaggctgggcttactttaccctcaagacaatctgtaattgcccaaggggttcagcttacccactgcctggacagagttaatttctcaagacagggggattgcaatagagaaagagtaatccatgtagagccagctgtgtagactggagttttattattacccaaatcagtctccctgagcattcagggagcagagcttttaagggcaacttggtgggtggggggtaaggcagtgagccaggagtgctgattggtcagggatgaaatcatagagagcagaaactggcttcttggctgggcacggtgactcacgcctataatcccagcactttgggaggctgagacaggtggatcatttgaggttaggagttcgagaccagcctggccaacatggcaaaaccccatctctactaaaaatataaaaattagccaggcatggtggtgcgcacctgtaatcccagctactggggaggctgagacaggagaatcacttgaacccaggaggcagagattgcagtgagttgagattgcaccactgtactccagcgtaggtgacagggcgagattctgtgtcaaaaaaaaaaagaagaagccagcttcttgcactgagtcagttcctgggtgggggccacaagatcagatgagccagtttatcaatctggctggtgacagctgatccatcaagtgcagggcctacaaaatatctcaagcactgatcttaagagcagtttaggaagaatcagaatattgtatcctccagctgcataactcctaaaccataatttctaatcttgtcgctaatgttagtcctgcagagacaacctagtctccaggcaagaaggaggtatgctttggggaagggctgttgtcatctttgttttaaactataaattataaactaagtttctcccaaagttagttcagcctacgcccaggaatgaacaaggacagtttggaggttagaagcaagatggagtcagttaagttagatctctttcactgtctcagtcaaaattttgtaaaggcggtttcaaatcctatgaaggaaatactattccttttgtctacagataagaacatcaaggcacagagtgcttaagtaatctgcctcaacctgtcaatatttttttaaaagtctatgtggctctagaatccagatgtttaaacactatcctgtcctccctctcaattagatgattaaagtggtttgacagtacctgctttatagaaagagttcaataaatattggctacaattattattctccttttatacatggaccttcatattttagttaaaattatcagctaagattatcagttaattaaaacatttaaaataataatataataatttgtcaagtcatatttcctaggaatttctactaggtttaggaagtatctctggtagccagcctccaagatggccgccaacaatccctgcctcctggtattcacacccttgtatggtcctctcccatatggtatcagggttgatctgtacaatcaatggaatgccacttctgagactaagttataagaaattgtgacttttgcctttctcactttcacaataagatccctaactcaggtgggataagttagctgccatgttgtgagtagctctatggaaaggcccctatagtgaagaactgaggccacctaccaacagccatgtgaacgggccatcttgaaagtggatccttccccagtcaagccttcagatgggcacaacccaggagagaccctgagctagaactactcatgtattagtccattttcatactgctatgaagaaatacctgagactgggtaatttataaggcaaaaaaagtttaacgaactcacagttccacatggctgggaaggcctcacaatcatggtggaaggcaaaggaggagcaaaggcacatcttacatggtggcaggcaagagagcgtgtgtaggggaattgccatttataaaaccatcagatctagtgagacttattctctatcataagaacagcatgggaaaacctgcctccatgatttaattacctcccaccaggtccttcctacaacatgtggggattatgggagctacagttcaagatgagatttggatggggacacagacaaatcatatcaacctagctaagccacctccagactttcgagcccttaaaaacaatatgagataacaaatgtgtattgttcaaatccactaagtttggggtcactgttatgcagtgatacataactaatacatcatctcttctagaagccttcaactgacccccagcattctgtgccatatcatagcacctactatattctgacttacatcttttcccttcattctcccattctagataatgagatcaaggacagggactagctcatactgatttttgaattcccaggatctagcataatgctgcaattggtgtggacttcaataaatgtatattattgagctgaactatcttcacttactgtacatcctttgtccttaaaatatagtttgcatttcagatttctcatgaattcaggtagttcctgccatctaaacaattaggcctggtttcactcaactagtatttgattattaaagtcaatattaaaattgtactatccaagatcttagacacatcttttttatttttgcaatagaatcatatcaacttgtaacagaagaggtttgatagtacgtaaggtagcaacattcctctgttttcaaagtaattgtgccattagcccagaatttttcttttttccaaataggattaaataacctggagataaaagtagttctccaaaggaaaaggtaaaataatttcacagaaaatatttcctgagttggtcatatgacatcagagattgggattaaagattttatttttttaactcatttaattcatggaatataaatttattgttatcaaagatatcagttcaattttattattgaacctgtaattcattctatactttgatcctgtgaagaccaaattcatcattttcttcaaaaatgtcatataaaacttgagtgatcagtgacattctttattttgtttttgtaaaataaggaagacattaaagccatatgaacttcctcagtaaatggaaagcagtccacatcaatgcattcctcatcatggtcattaccaagggattcactacttctaggaggctctatcctcagcaaacaaacaatggcccacttcatcatttccaagttgaagttccttgccccaaaatatactacaatccaacaaaggaatggacatcattcttgctgatatgtccccagatgacagcattcttaagagaagtttcacagctctggataatgtgagtttatctgcaagcattgacacaatacacattcaagggaagtggtggtggtcttggcattgacacacagtggaaactcaacagtgacgtagactacagtcaacacacatgtaacatcctcaggttatatcccacttcagtctagcctggcagaaacaactaaaataaaatacataagcatgcaacatccatataataagttcaggaattaaggatgagaatgaaaaccatctatcccatatacacagcttgggaactaaggacttgacctgtctctctaactctctccctctcaacacacacacacactcacacactcactcacacacatacatacactttctttcctacattaacgtaagtttactactccactgtcttcattagcataactttactattccaggagattctagcctaagcaaataatttgattattcattacagaaacttcccaaaaagatccttcactcttcaacaggaagtaccagcagacggttaacaccctaaggatcttcaaatccctcaactcaaaatcctttccttgctgtttccaattctacactgttgtgttattatccttattcaatcttcatcaagctcccttaccgaaagatcaccttaaaccaaactcccaataaaacatattttttaattcaccactgatcggaaggcataaaataattttttaaataataaaatacaaccttgcttttttcccctcagagatattaccaaagctctgcctaggaggtgatcttccctaccacaataaacaatacagatagctttgacttatcagcaggttgtgttggtgatatttggagagccagcatttgacaagtacttagtatggatcgagcaataagctaaaacatttggaaactgatatatggcttaatctaagctaaaactaaagcatctggaaacttaatctatttccccctagaggtcagaggccctcactgtttaaacaattccacatctggacatttaaatttctgcctggtccagcatttgctaccgtatgttaagaggaattatttgtctaaatgaaaaaacgtttccatggtcaaacaatttgaagactgatgagttaagaataaaaagcatcatttcttcactgtgggacttctcagggcctttagggtatactactgggtatcaaaaatatccaagagggagttattaatatatagcctacgcaaaatgtatatagatgctttgtcctacagtaactccctagattctcactggatacaacagggatgatggacagttttatctaaccttccatcctgccgtttattcacaggccatttccagagaacatggtcagaaaggaagataaatgaccacagctgtcttagccctcagcaatcagctccgtggtaattttagggctgccttgatctgtgggcaggggaaaatgaaggaaatgaattagcctgagtcctgccagcctttaaatgaggatgcctgtgtgccctgagctatgcttagctaattccagcccttctccccaaagggaatgctggtctttcaatatactgccaggagttccttaaacctttcccacatctgtgaacaccaggcagaagttgtccaaatggtccaagttgctgatctttgctcaaaggaaggccctgctggcatggacccctcagtttacaaagaggtggcatctgacatactctgccccactaacagctaaaatcctcatgctgttatctttcttgactgtacccttctgctaagatctccacttaaaggacattgttttggtcagcactctgacttgcttgttttgggtaaaggagaggaaattgacatttactagacactttctatgcgtctgatgtcacataagacactttacatgctttattccatgtaattctaacaagtgcaaaaaaatcataatagcaaatgtttatctagtgtttcccatgtaccatgcactgttgtaaatgctttacatagtctcactctctcaaggctcaaggcaactctacgtggtagatgctgctattacccccactctataaatgagcaaatagaaggataaagaggtgaaaataatttgtgtaaggtcacatagacagtagcagagccagatcggaacacagtcacagtccatgcatctaaccacactaccattgtctgccattatctgtcctgtcagatgagaaaaccaaagctcaaagaagcagctctctcaaaggcacaccggaagtggaagaactggtaccagaacccatgtctgtctactcccaagtccgtgtttctcctctagaccacaggctctcagagcatagttcccagaccagcaacatctgtaacaactgggaaacttgttagaaatgcaaattcttggccccactccagatctactaaatctgaaagtctggcatggggcccagtcatctctattttaacaggactccaggtgattcccatgcagactaaagtttgggaggcactcctctacaccatgctgccttctgtagagcactgaattttgattttaccggcaaggactagagatagtgctgtctagtggttagaagctctgggaagctaagaaacaacttggtcatgacccagcatatttcactgtccttgacagtagacaggccaggggttgctttttccccccttagcaaattcatggagcagaaaaagaacagctgcactgtggtcaagaggaagactggattctgtccttggccatcctttaccctgctgatcacttttcagatccagagattctcagtgcctttctgttcaatgttctgctgcttttgcctgccagctttgtcagctcctacctgtgacccttcttgtctttcaacccctcccacttcaggaggaagcacttctgtggcaatatgttcagctgatgagctgccctcctggttcagatattgtgcaatgcaaaacatttcttaacaattccggaagcaaactttttttttctcctttattgctgtcaggatcagttcagtagctacactaaagctttcaccactcactgcttcactgaaaagtttaagaccagagcgttctgctgaatcaagctgttgttgagaggttcagtgtacgtatataaaacagaacaataattgatttttatagaggctgaaagaaagttaaggaatcttggatggctcagggtgggagcttgaaaggcttttgactcaggatgaaggatcacatggtcctcaatttgtgcttaatagctacaacatggggaaagagagagagagagacacggtatataggggaagaagctaagttagcgccaagctgagtattttgcagtcagggatcaaaaggatactacttttaaaaaccatatttcttctttaacaaacattaattcaagctcattgagtttctgtaggtcatacgtttcaatccaggatcagcaacacagagtgtgttatttcactttcaatgctgagggtggggacctccccctgcgagaacatgctgtatgttgattaaagttgcaaggagagctatgaaggatctgcccaaatctccttaatctctttttcttccttcttgataggtttctagggatctgttggttgaattgttctgtgcttgatatggaatcttggtttttattggcccacagtaaaactaattactactggaaagggcaccaaattaagattagcaagcctgacttgatttatcaaaatggaatgtatgtatgtaatgggtgagtgtgtagatgttagaatcaggcagaacactcctcagtttatgacctctccaaaacctggtagcggccgggcgtggtgctcacgcctgtaatcccagcactttgggaggctaaggtgggcaggtcatttgaggtcaggagttcaaggccagcctggccaacatggcgaaaacccatctctactaaaaatacaaaaattagctgggtgtggtggcacatgcctgcagttccatctactcaggaggctgaggcaggagaatcacttgaacccgggaggcagaggttgcagtgagccgagatcgtgccactgcactcctgcctgggcaacagagcaagactctgtctcaaaaacaaaacaaacaaacgaaaaaaacctggtggattatcttaaggattaagtgggaaaatacaggtaattcccaacctgcacagctggggcattcaatactgttaactgttatcagtgaattcgcactcatcggagtctagttggtgcccgcccctgtgctggcgaggccctgcaggatcacagagggactctctgttgggggcaggcctagttgcagctgcactattgtcagcacacctgcccccaacctagccctgtgactttcgagaagctctgtaaacccctaatcctccataccttctcatctgaaaaaacccacatcctcctggggcttacagagagcaagtgaatgaaattgtctgaaaatttcaaattgctcttccaggctaataagagagtatcataatttgttatataaatagaatatacacttttaaatttctcaatctgattttagttgaacttttagtgctgtggcataatagaaagaattccttaaattgggattagaaaacctgaatgtaggtcctggttctgagatactgccatttattagctgtgcaactctgggctagtcacctaaccaccccggacctcagttttcttatctaaaaacctggctaagattatctaccccttaggcggattttttttcttttctctccacactctgcctaccccacaggtttttgtttgtttgtttgttttttgagacagagtcttactctgtcactcatgctggagtccaattgcgcagtttcagttcactgcaacttctgccttccagattcaagcgattctcatgcctcagcctcctgagtaactgggattataggcacgcaccaccatgcccagctaatttttgtatttttagtagagatgaggtttcaccatgttggccaggctggtctcgaactcctggcctcaagtgatccacccacctcggccttccaaagtgctgggattacaggcatgggcctccgtgcccagccccctataggtttttatatcaaaaacatcactccagcctggtcgagagagtgagatcctgtaaaaaataaacaaacaaacaaacaacaacaacaacaaaaaacacctcacaactctacaggcaggaattactcttcctggcttgcaaatgggctcagggacttaattatccagaagtcacacagtgaataacctgagatttcaaaccaatacctgagcccacacatgtaatcactattattatcactgttcttttattgtgcgtgccatttttggaagaacaatgaagtctatttgggttgacgatcccaaatcctccatcttaaatcttcttattaaactgtgtgaaaaagttaccatgtaatctaaattatgatctgttttcctaccttcactcctccaaaataattgcaattataaaacacttgatgtaaattaatctctgttcctcaaacttgagagttacattaaaaagtctcaattataaatgacagatagatgctgttcctagagcgaaatctatcttggtttgttctaggattttaaaaaatatttgatgtaggccaggcacggtggctcacacctgtaatcccaacactttgggatgccaaggtgggtggatcacctgaggtcaggagttcaagaccagcctgaccaacatgagaaaccctgtctctactaaaaatacaaaaattagccgggcatggtggtgcatgcctgtaatcccagcaactcgggaggctgaggcaggagaatcacttggacccgggaggcagaggttgcggtgagccaacatcgcgccattgcactccagcctggtcaacaagagcgaaactacgtctcaaaaaaaaaaaaagaaagaaaaagatgtaaaatatgccacagagagagagagagagacagagagagagagtctttaaagcttccctcaccccattcctgacaaaagcaacagaaaaaaattttcccaggacccaagctcgagatattcctgataccagccacctccacaagcaaggctgctgtcagtggaactgagaagctgccaagaagctaggccatttctactccacatttggtctgaggccagagtgttgtctttcagtttttagacaaatctcccagggtgatgtagacccagcaataaccatatgtgaccatcacagcctgcaggaaagagaagaaaggtaaagacggctttcataaatggccctgatcttatctgcaaaagctggacagctctttttccaatacagaagcagaaacagtcgagattaagctttgcttagggaggtagggagttctagttcaatggtccaaatcatgctaatcaacttctgcaaaggacagtgtcctggagctgtgggccttgaacagcaagctcgggtccacaggtttggccacagtatgactatgcctgtgttatttaaagtttgtcccaaggagtgttatgatgtgcttggtatgggcttcacccccagcaggcacaagcatgtgcatgcctcattggcactgtgtccgtatggagcattgtgaagggactatgtggaaggaacaggaaaaaagagactacttaacatcctttgctttgctctgccacgttttatatttacaagcttctgtgtagaaggatactgatgtatgttcttggcttccataagacagtgggggtgacaggagtaaaaaggaagacgcctaaagacactgaagtttcctggtctatttggtcaacaactatttaataggggcccaccatgaatcagataaggtacacatgctgcagatacaaatgaccaagagcaagcctgactgctgcccttatggaacttggtatctagtaggggagtcagccaacaatcgaatagtcacataaatgtatggaaaatggaagctgtggcaagtgctaagaagacatggtcatggtgccgtgagcaccattaatggaatctgacccagtccaagaggtcagcaagggcttccctgagaaagtgatgcttcaactgagaccttcaagatgagtaggtgctaagtagtgaaaggaatgaggatgggaggcaaaatcctggccaagtgaatagcacatgcaaaggccctgttttgggagagaaacagcttggtggaaggtaggagatctgacctaagtgttaccaggaaggccccccaacccctaaacacctctgcctcctaaaattccaccattattaaggaatgctttgggttaagattgtttttctcttgaaatattcccttttttttttttttttttttgggcaggagaccagagcttattattactcaaatcagtcttgctgaacatttgtggatcagagtttttaaggataatttggtgggtgggggaaggccagtgagttgagagtgctgattggttgggtcagacatgaaatcgtagggaattgaagctgtcttcttgggctgagtcagtccctgggtggggggccacaagatcagggggccacaagatcagatgagccagtttattgatctgggtggtgccagctgatccatcaggttccgggtctgcaaaatatctcaagcactgatcttaggaacagtttagggagggtcagaatcttgtagcctccaactgcataactcctaaaccataatgtctaatcttgtggctaatttgttagtcctacaaaggcagtctagtccccaggcaataaggtttgttttgggaaaggattgttactgtctttgttttaaaccataaactataaaataatttcctcccaaagtcaattcagcctacacccaggaatgaacaagaacagcctgaaggttagaagcgagatgtagtcagttaggtcagatctcttccactgtctcagttacaattttgcaatggcagtttcaatccctccctttgggttttataacaccttaacctcaagatgttggcaattgaagatggaaaaagagcaaagactgctctaacttcttcctgctgatcaagggcatagtgagggtaggtgtcgaccccaaggtaaggggagtagaactgctttgcaactgtctgaaagtactcatgcaggcctggctggggtcccaaggcttgcatggcaaaggcgttagtattattatttgcagttttagtaccacgtttgagggaatagtatgctataacgtaaataatgagtactagtgtaaggaatgcaattcccagttttaaaagcaaaaattttaaagcattactttgggaacttgtagcccacaaagaatttaggatttagccaaactgaagaaaaaactcaagaacagctaatagcagatgtactatagacttttgttttgttttggttttggttttggttttggttttttttgagacagagtttcactcttgttgcccaggctacagtgcaacgacatgatctcagctcaccacaacctctgcctcctgggttcaagtgattctcctgcctcagcctcccgagtagctgggattgcaggcatgagccaccatgcccggctaattttttctatttttagtagagatggggtttctccatgttggtcaggctgatctcgaactcctgacctcaggtgatctgcccatcttggcctcccgaagtgctgggattatagcatgagccaccgtgcccggcccagatgtactatagttttttgaagcataatttttttctttctagtttccatttttattaaaaacaaattatgatagaactgatttgtttgcaaaagtaaattttagtcttattagatttggtctgattatttgcataaagtgtagcaagaatgattatttcccacagaggctttttaaattggctttgatggaactctattccataaggaatcttagataagactttttaaagctgagcccagccatgggtttgtaagcttaaatacctataagttgggtaaatttctcttgacatcccaagataacttggggctcctgagcctgttagaaagtgacatttttttacttactacaggtcgggaaccctgtacagggattgtgtagacaaggtatgaggtcagttttcccaaggggcttttattggctttgtaagtcaactttgatttttttttgtttgctttttttttgttttgctgagacagagtcttgttctgttgtccaggctggagtgcagtggcaccatctcgctcactgcaacctctgcctcctaggttcaagcaattctcctgcctcagcctcccaagtagctgggattacaggtgtgcgccaccacatctggctaattttttgtatttttagtagagagagcgtttccctatgttggccagctggtctcaaacttctgacctcaggtgatccacccgcctcagcctcccaaagtgctgggatgacaggcatgagccactgtgcccagccacattagtgcatctctaatgctaaaggtagttttcaaatacaattttataaatctattcagttttaattaatttgaccagaaggtaagatttccataaactttttagaaccctttacaattttccattaaacagcagattaattttttaagaaaaccgtattatttggacacatgggcccataaaatcagtatgattttaatgttttaacctatagaaacaagctaaataatctcctttaaattttagccaacttgcttatacccacagaatgttttacaaggttaaccctttacaaacccttttttaatttgcttaaaccttcgattttgtcccattactcttctaggttaagacaatcttttaaaaccctctgaactagacaaaattacattctctttaacaaaaagcatattcccatatcttcttataatctcccaccaagattatattctgcttttcttctatacctgacaacttatatgtaaaactgtttctccagtagtctcaattgtatgttacaatgttaactcttagcaacttttatttttggtgaaaaacctaataagtaggcgatttatttaggtacgaggtgtggagcctaggacatcaggagtactgacccttttcagcatagctaggggacatggctttccatatgtccccaggccttatctataatatcatactccaaagtaggtaaattgaacaattttcaaaagtcaaagaagcagtttatgacttaaagcatttagcaaatctaatatctgaccttaattgagaccaaatgtctaaattttgaagacatttttattttactaataatctttaaaactgaagggttacttcttgttgttacttcttgttgtgaacaagaaggcattaaagtttctatttttctgataaaatatgatttaagtgctttttttctaagccaattaatcagctcttttatatataaacatcacacacacacatataaatacacagacagacagaagatccagtagttgtaagacttttcatttgccagttttttaattggattactggcttcagggtggatcccttggatgagcagggccaggaaagcatgcagtttttaggacctaataagtaggcacagctggaaggcaaagacaaatcctcaaaattaaaggtgccattttatactggatcctggatccccaaaaaggagggaaatactacaagagaagatagtgcagtgcttctaccatgcatttcattgcaaggcaattcaaagccaatcagcccattttttaattagcccatccccaacgggagtctcatctttcagtgggggttggggatgtttccatatcccacttccaagtggccaagagcatgcttctttgacccaagcaagtaaagagataagtatctcttcataactgacattagccatttcttaaagtatatatatattttttacctagttattacacaccaaggctaaaagctttcccataaaataatttgattattatttcccataaagtaatttgataccctcaaaagtcaaaaccattagctaaagcaaggcaaaacaaaacagagccttagattttgagagggatttattgttttcaattcctggggttccatgaggaaaagaagtttttcccagaatggggtctgtggtgccatctctgtttttccccaggagtcccaggttgttagtaattatcttgagttttttcctgtggacattaacagtggcaagaagacaaaatggagaaaaacaattcagtctactgagaagaaaaaaactttttcagaaaaacacaactcaagaagaggaaaaaagataaaggccttttaagtatgtataccttgggtatccatttttaattaagttgaatttaaccataaagttcttttctcaaaaaaaaattgcttattacccaggacagccaatatttttggcttttgaattgtaccacaggtaaccttccatgagaaattagtaagttttaactaaggttatgacttaaccatggatgcacaaggtgtttcaaagacatgataagcagtttttttccttatttatttcttttcttcttttttttttaacaagatttagaatctccacaagggtcgttcagagaaaggaaaatccaatcaggaaatcagaagctatccatggggcagggggaaaaatacacctcaatattagtggcaaagttacacaaatgacaaaccagaaaggaatcattctggaagccaagaattgaacccgagccaccattgtcaaaaggcaaagccttacctactgagctacacgccattgagcagtttctattgctgtgccctgaagaagtctaaagcagccaattccaagcttgcaaagcctcttaactgttcaaaataatttttagggctaactatgacatgaacccccaaattcctgtcctctggttggaggaaaccaaaagaaagtatctccacatggtcacaaagttaagctcttgaggacacaaaacaagacagagaaatttcatctggtattcgtttcagggaccctcagcaaagtttgtaacagaccagcctgccaggctggcttgaaaagcgggaatataggagttctaaacctacgttttatcttgtgatgcccatctctccattatagaacaacatagaaagacaaattcttagcacaaagtacaccagatttgctacaacctaagactagtctcacaaatcctttcttctattaatcaaacccttgtagaggagacaaatagtggtgtttaccatttacacacatacacacacacacacacagagagagagagagagagagagagagagaaagccgaaacttggctggtaagattttcttatcctttttgctggcatactaggtttccaggttctctttcttcgcagcttccacagaaacagagtggcttttgatgatcctgaccactgtgccataactgtgagggtcaagccacccaacaaaagaaaatcacccctttctgttttatggaaccataggcaaaagattctcaattttgcaagatgttgcccaacaggctgcttggggaaccaaattaacattctccatcccaacaaaatacacacaacaaaacagacactagtcacctcgttcagtacccaatattgatatggcaaggctcaaactttctcctcttggtttctgttgcctttggtctactccaggtggttgagggatgacttcagaacagtaattcaatgggtggtctctgggaaagacaaagagcagacagtcaccccaagtcagtcctgttgagcttacttcagggttcactgaatgtaaccacacaaataaggagggttctccgagttaggcctgttggacttctgtcagcaattccttcggagatcccctccacatatacaaacacacataaacacaagacagacagaaggccttccaaatcaagatccctaaccaagaattccaggagtacttcttctaaactatcttactattctccatttgagaaatctccccaacatcttctgatggaggagaagtctcccaaaccaagactcttcctactagttagggagagccaactgagaacccccaggagctgaactgagacagacaccccatggtggagctccaggcagacaccccacaatgcggctacagctagacaccccaccatggggttacagaaccagtcaggagaaggaaggagacattggcagtgcctaggatactcaccaacccagatactccataatggggctatagctacagacactccatgacctggctacagcaccccgccatggagctatggacagacaccctgtgacagggcttcagttatgagatgtctcctgaggactatttctccattgcaattaaatccatgcacattgggttggcagtgcccaactggaagagacggtgccagagtcacccactgtccaagaaaattaggtggccacttgagctgacctccagatccattgccagaggcaggctaccaaaccatgggcagctagccacaagggctatcctggacaagcccccaaatttgtaactgcccaatgggttcaccttgcccactgcctagacagagccaatttattaacacaggggaattgcaatagagaaaaagtagtttacacagagccagctgtgcaggagactggagttttattattactcaaatcagtctcttgaagtgttcctttatgctcagaagaatgactcattaagtcaagtgaatggttttatctgataaattctctccctaatagcagaagtcatggccacaagtccctgagattagtatgggaatttgggtaggtgggtttattttaaagagaaaaagagttacaaaaatgagagatgtgtgcctcaaagatcaaacctcatatttttctaaatttatcccaagaccagccctaccagaatttattaaaagtctgatctccaggaaatcacgtaagcttttgcattcagcaagactaatcaagatggtctcagcctttgagagaaatctatgaaaaggagcaattcaaagaaaagaggtaaacatcatattatgagaatgccggcatttttttccataagctgagtcctccatcctaaaccagcttcatcagcttgagcatccttaaaagtttcacagctgacaaaatatagtcatgcactacataacaacctttcagtcaatgacagactgcacacaccacagaggtaccataagattataatactgtatttttattgtactttttctatgtttaaatatgtttgactacacaaacactttccactatgttacagttgcctacagtattcagtacagcaacatgctgtacaggtttatagtctgagaacaataggctataccatgtggtctgggtgtgtagtgggctgcagcatctaggtttatgtaagtatattctatgatgttcacacaattatgcacttctcagaacatatccccattgttaagcaacacatgactgtatattaattcagtattttgttcctagagtctcataacagatgtttctcccccatggcacataaacaagcagtaaaccataccagcttttcagtcacttaggcctggattcaaatcctgactcttcagcttagccatgtgaccatggggaggtcatttaactgccctaaaccttgttttctcaactgcgaactgggaatcattgtccctatcccatagaattgcttggaagatgacataaaaataatgcattaaagagcttaccgaagtgcaggtcatacaatcagcacttaatgggagaaagttaaaaagaagggccaggtgaggggaactggcaaagacagagaaagagtgtggagctcctgagagacacaagtgcatgggttccaggtgatgcattgcttgggcaaaaccacacacaccaagtctcaaaagaagttgaaaagcctgagagaaagcaggcctggaatttacaaatggaaagagtcctatctctcttgtattttctcttggaacatgtgagatgagttcacccagagacaggaaagaaaacagcaaggaccgcccaggcattacagcatgggttctgcctgaagaggcccatgacaaaagagaatttagggtaggacatccacctggaaaacttccaggcagagtggtgcctgggaagctgctaaaagcttaaataagggggagtaaaccagagagctggacgaaaaaataaaaagccaaaaggaccctcctggtctccctgcagattgccagcctcatcccatgaaactggcctcagttattacagacagaagaatttcctgctggaaagctctttgaccttactgagcttggcctaggatattcaacattctcaggcttggcatggcattccccagtaagattttctctttctggaaaaaagtaatacagaaaaagaaaaggcaactatatagtgaaaataccaaagaatgtcaggaatctgaatcatggggaagagaattcctaaatttatctttcccaaagttatttttatcaaggagaaagacatttccttactgaggctctgaatctataagtccctaaaactctttcttatgaaattcatgcttgtgctttattttttattttattttattttattttatttttgagacagagtctcactctatcacccaggctagagtgcagtggcgtgatcttggctgactgcaacctccacctcccgggttcaagcaattctcctgcctcagcctcccaagtaactgggattataggtgcccaccaccacacccagctatttttgtatttttagtagagacaggctttcaccatgttggtcaggctgatctccaactcctgacctcaagtgatccacccgcctcggcctcccaaagtgtgttttattttttaaagatataggcactttgcatacctctttctgtatcaacccttttccctcctgcccacatagctgtgagaagaatttcaacaggcccagcaaatgacataaaatgatataccatgtgcattttggaggctgaggtatgaggactgagagttgtaaataaagtgctgacccaagtgagatccaaagagcacctgggaagctctgggtgcagggtagcagcccagagccgctggccccttcctggccatctgggtgctgggcatagatttctcaacaagaagactctgctacctcccctcaccaggcctctattcttctgagaaacacaaagcaataataaaagaaagtgttaaccaaataaataaataaatagtgctgaaaagggctcactgcatcctggagttgcagctcctgtagctgtaataatgaatctggtagcccttagtgattctcctttatttgttttgagttggggtctcactctgtcacccaggctggagtgcaatggtaccatcttggttcactgcagcctctacctcccaggttcaagtgattctcccacctcagcctcttgagtagctgggattacaggcacctgccatcaggcccagctaatttttgtatttttagtagagacagtgtttcaccattttggcctgtctggtcttgaactcctaacctcaggagatccacctgcctcagcctcccaaagtgttgggattacaggcctgagtcaccacacctggccttctcctttatttctctaagcctagtttcctacctgtctgaggagaccaagcagggaataaacagagagcatctgcaacgccttgttagagggaactgctgtcctcaagcatccaacaaccccagtgaggaaaatacggccaaacctccctcccagtgttacaggaagcaaggctagaaattggaccagcgataagttttccaagaaagtgaatcacacacgtgagacttcaggaccacttaatgcagagcagattttcggaccacttaatccatggaaaaaaaataaacggattaatagttgcatagaaaaaaatatgctttaataaaaaacaatgcatcacttatgcatacccttctgggttatgagattgtagccatgtttattgtctttgagctactttgtaaatcttcgtaagttgtaggtaactgatagatatataacttctgtcctatctggtagtgatttaattgactccccctggccctatccttcactcatggataaaacagttttgcctccatttgcaattcatctcagcattcctttacttgtaaaaaaaaaaaaaaaacctgtgctgttttgacttttcctttgagccagttgctatgggttgaattgtgtccccttcccccaaaaatattgaagatatgtcccaacccccagtacctgggaatgtgagcttatttggaaatagggtctttgcagacgatcaagatgaggccatgagagtgggccctgatataatatgactgtgtccttaagaaaaataaaaggtgatttagacacagagacaaattaccttcctcttcatgcatacacaaaagaatgccaagtgaagaggaagtgagagataggatgatatgtctcccagctaaggaacacagaggattgccaccaaaaccaccagaaactgggagagatacacagaatagattcccctcaaagcccccagaaggaaccaaccctaccaacaccttgatttggaacttccagcctcgacaactgtgagagaacaaatttccgttgtttaagccacccagtttgtcataccttgctgtggcatcccaagcagacaaataaaccagttataacatgtttcttattccctagtatcatataagcaaaataaattttttagcacatgttcatttttgtatctatagaagagtcatgatttcattaggttggggaaaaagctattgtgatttttgccattaaaagtagtgatccaaaccgcaattactttgcaccaacctaatacctttttctgaacgttatcttttaacagtttcagaggattcaccaagatgtcctgtggatttgctgaccagagccaggtagacttcatccacagaaaagtgcaccacatgggcagttgaagcacagaaatatattttcctgattcatgaggtcaagtaacatgaagtgaacaatagaactttgctgactctgtttttctaattttattttgcccttactaattttggttttggtttgtttatagccagtaaattattccccattgagaattagttttagggtctgaccatttatgatctttgtaaatgtcgcatagagatctagtctctgttgggtgaaaggctccagggaatttagtttgtttgcctttttggttgagaatttggttgctttttttttttttttttttttttttgagtcaaagtctcacgctgttgcctgggcggagctcaatagcttgatctgggctcactgcaacctctgcctcctgggttcaagtgattctcctgcctttgcctcctgagtaactgggattacaggcacgcatcaccacactcagctaactttttgtatttttagtagagacggggtttcactatgttggccaggctgtctcaaactcctgaccttgtgatctgcccgtcttggcctcgcaaaatgctgggattacaggtgtgagccacagtgcccagctggaatttggttttatgatgagatcatcggaggatctctgcaaatgaattaatagtttacatagaacttgtttctgctgggtgagagataacagagaatctggtttgttagtcttttctgcgtgttcacctttatattttgaatgcaaattattaagagtttaaactgcaagggaggaaaaaaatttcctcctctcctctaagttcaatggctgggaccctgcaaattaaacaatctgacaaaagacagattaacaagagaaaaacaaatttaattaagtatatttgcacacataggagttcacaaacaaatggagcttgaggacatggttagaatttgcttttttttcttttccttttttttttttttttgagacagagtcttgctgtgttgcccaggctggagtgtagtggtgcaatctcggcttactgcaacctccacctcccaggttcaagtgattctcctgcctcagcctcccgagtagctgggatttcaggcgcccgccaccatgcccggctaattttttttgtatttttagtagagatggggtttcaccatgttggccagtctggtcttgaactcctgacctcaggtgatctgcccaccttggcctcccaaagtgctgggattacaggcatagaccaccaccccgccagaatttggagcttatctaccatcttaacaagaaagataaggtgtggagaagagattagaccaaggaaagagggtgctttttggtttcttggagggtgggggctgtaaaatgatcatgggaaggtgagtaagaaattaggaaatgtatggtaagtaaggttgtttagtatggtttgttatacagatgagtctccagtgataagaattgtccctagtagttctcttcctcatatagaagagggagacaactttacaaaaaagggatgtgtatgccctgcttttaaacagaagggagttttttcctgcatctgctatttttcaattatcttcagctcaaaataatccttatgctaaagtagcatattttggggtgacatattctggtccccttcgatacctactaggaaaaaagctctttgactggtgagttttataaatgtatgtttactttgactcatgactgaaaatctagaattaaaactataagctccctctgtctgtttccacgcttatgtttctgcaattcagaaaggcatttaaatctcacataacaattttcttttttatttatttatttatttatttatttattattttattattattatactttaagttttagggtacatgtgcacaatgtgcaggttagttacatatgtatacatgtgccacgctggtgtgctgcacccattaacttgtcatttagcattaggtatatctcctaatgctatccctcccccctccccccatcacataataattttcacctcttgttggtattaataaattgggttagaaaatccctgaaattaaaggagctctattctgattagcttatagagataaataagtgtttgtattgattgtttctagaattgctagaaaataaggaaatcgaacttctaatattttcaatgtaatttttatagaaagtaacatggaaatgttttaagattgcaagttcacataatttaggtaagtcttcagcaaccaagactagttaaataattttggtttaataaaaacagctacagattagctgataatcagattagttagataaattctgatttatcagcattaaatataatacctgctagtattttaattctacttgggcatgtacttcttaacacaggtttcttgattgaacaagctaccattacttctacttaatacttaagattacagaaaatataaatttgtgtttcattgactcattctcacaattttgtttgcctcgggttatggcttgtgcaaacaatgagtctgaaaggctacgaaagctgtcaaattttgctcaattttgacagacttgttcccttggttactgtttattgccttcatctacaagatgaagggctttttgtttttcttatgtaatcggcgtagacagcaaagattctgtgttttactggaatagccttcaatggtttatgctgaatttattattatgtccttgactatttaagaaaacaaaagtttctcagttaggaaagatctaagcctccttacagtcatgttaccttctatgtttactttttaaatactttattgtcacttagaaatgaggagccaaagagttttgtttcagtttttgttttgttttgggtttgttttttgtttgtttgtttgttttgagacgaagtctcgctttgttgcccaggctggagtgcagtggcacaatctcggcttactgcaacctccacctccccagttcaagcaatttttctgcctcagcctccccagtagctagaatcacaggcatatgccaccatgcctggctaatttttgtatttttagtagagacggggtttcacccccatgttggccaggctggtctcgaactcctgacctcaggtgatccaccagcctcagcctcccaaagtgcgaaattacaggtgtgagccactgtacccagctcccaaatagttttttagacacctagatccgattcctgtcatagtgttcaaattgcctgacagtgtctggtttttgcctccctaaaatggaattctaaatataaaataaaatgaagctttcaggattttttttgctactaaagctattttgagatttcctagggggcccctggaaaatcacaaagacttattttttagccttttgaaaagagaggtgttagaaataattaggtttacttgctggattactattgatgaaccacatgaaaggcttgtgaaatcagaagagatgctcagcctttcctaggttaaattggtatatgttgcatgttgttagtatatttcagaaactgtacgctatatgggcattttccagagctttgcagtgtcctcgccgtccatgacacatttcttcttattagggccctagtgctgctttgccatattagacaatgacactacagtgttatcactcatgatttcagttttgttttgtttttttttttaatagaaatggggtctcactctgtcatccatgctggtctcaaactcctgggttcaagtgatcatcctgcctcagcctcccaaagtgctggaattacagatgagagccactgtgcctggcccaatttcagttgctttctaagtgttaacttgatcacagctttacttatttaatttgaatctagtatcttctagggcagtggttttcaactggggattgacatcacttacataattttactaacaaacagatgtctaagaattactgaggaccacgaactctctttacttgatattcttgatatatttttgttatattcttacttagcaaattcatgttatattatgtttcagcattattacgttatatctcaagatttttttctctggaaagattatgttcatccatttttataaattagatataacgttcactgtcttcttttgttgttgttgttgttttgagacagaatctccatctgtcgcccaggctggaatgcagttgcaatcttggctcattcgaacctccgccttccaggttcaagcaattctcctgccttagcctcctgagtagctgggattacaggcgtgtgccactacgcctggctaatttttttgtatttttagtagagacaggatttcaccatgttggccagactggtctcaaactactgacctcaggtgatctgccagcctcggcctcccaaagtgctgggattacaagtatgagccacccagcctggcctgtcttctttaaaaatagagctaatcattgtaagtttttttggtttttttgtttgtttgtttgttttttagagggagttttgctcttgtcgcccaggctagtgtccaatggcgcgatcttggctcactgcaacctccgcctcctgggttcaagaggttctcctgcctcagcctcccgagtagctgggattacaggctcccgccaccacgcccagctaattttttgtgtttttagtggagacaggatttcaccatgttggccaggctggtctcgaactcctgacctcaggtgatccacccgcctcagcctctcaaagtgctggaattacaagcgtgagccactgcacctggcctgtcttctttgaaaaagggctaatcattatgtttttaactattttatctaaaatttttttgaatcgactttattttctttttggcatgccacagaagcaaccaaattttcttatcggttgcatttttattggaataaattcttatcagaacttttgcttttgaaaattatcagtaatacattaagcacagtattttaagccttttgtcatctagaggtagtttttttgttttactctgacgcttccttgaaaatgtttcctcttcaacaaaggactgtctcagagacccgtggaaaaggactatgttgggtattttggggtatgtgctgctgatggcatcacttaaacaattttgagaccataccagcaaactgagtaaggatttccagaactctaggcaagaaacaaatggagtcatgaaaatgctaacccaagatccagtgaaacaagaattaattacatagggctaaatgaactgatgaggaatgattgtagtttatggtgggcggggggagtattactgattttttttctttttctttttacaaaattatttttattcttcttcacagcatctgcagctgtgagattattgatgttttaatatacagaagccctttcttttttcttttatctataacccataacaatttagtagactctgtttttgtaaatggaaatgaaacatttataaatgatatcatattcttccagcctaacccctccagaatctggaaactcttaatgaacattcttcttttcataccaatatagttatttccgtagatgcaataaggacatatctgggacttaattttactgggatttcattgaaaacattggttatacaaccaagaacttgcctggaatgtcatatttgaaaactatgtttatttactcgtatatcaccaagtccttttaagtaactaaagttgttttatggagtcaaggcttacaaaaccattgggtgcagtggtgcacacctgttgtcccagctacttgggagactgaggcaagagaattgcttcagcccaggagttcaagaccaacctaggcaacatagtgagaccccatagtgagaccctgtctttaaaaaataaacaaataaaaaataaaacgcttatacaaccctcttgaaaaaactggcctgggacctggtttacagggtttccagacttactcttttttcattgagtttttgagtttcacgaaggcatcacaatatatctttttaaaaacaacccataattggaaacttaactaatcaaaatgggccacctctcctcattcatacaaatgaatggaagagattggagcccacacagctgccaggctctatgcagggcacttggcacataatctacaggatgtttaaatttttattttactttattcttattttattttactcttatttatttattttattttattcttttttttttcttttttagagtttttttgaaagtccttgtcagacaggtaatgtgtcaacatcataacgaggtttaagggaggtacagctcacacatgagcatgaaaacccaattatcatgcttatgaactacaaaaggatcacaggatatttttgtaagtgcctacccaacagatctcccctccttctgtggtacaatgtgtccagtgttgaactagtagcattcacatttccccacaagtgtcacgaaagggggactgtctcccaagtttccccagcagtaaaacccgattggtttaaggtctgcagggcggatctagtcctcttgccagtgattaattagacatgactgtataacatggctgggaggtgggagcagaagatgagattccaaaaggaaagggtttatgctcttgaaaagagctatgtgatgcctctgatgaagcctatgttagtagagacatctgagagtgtagatgaatgccaatggccctcatggaaagagagagagatgagaaaaagcacactctttttttgcatctacatgtgatgtctggaattacagcagccattttgtgatcatgagagcagctggcttggctaaggacaaaattcgtcacaccaaacatggcagagaagaaagaagattctggattcctgataatatttttgagccactggactaaccaagactggaattggtcttccttgggacttcttaatatgtgggatagtgaattttcacattgaagtaaattttgaatggagttttctgtttcttatagccaaaaccatcttacctgctacaaatattttatttaatttcatctttacaacagtcctatatctgtggacattctcattttatagataaaaatctgagattcagaaagttttagtaacatggccaggcacagtggctcacaactgtaattccagcactctgggaggccaaggtggggggactgcttaagcccaggagtttgagaccagcctaggaaacatattgacactctgtctctaccaaaaaaaaaaaaaaaaaaattacctgggcatgatggtacatgcctatagtccagctactcaggaggctgaggtgggaggattgcttgagcccaggaggtcaaggtagtagtgagctgtgatcgtgccactgcactccagcctatgaaacagagcaagaccctgtctcaataataataataatgacagatagaacaaccacacagaagataagtaaggagagagaggacttaaacaacataataaaccaactagagctaacggacatatacagaacactctacacaacagcatatacattcttctgaagcacatgagacattttccagaatagactatacgttaggccacaaattaagtctcaatacattttaaaagatagatattataggcctggcacagtggctcatgcctgtaatcccagcaccttgggatgccaaggtgggtggatcacctgaggttgggagttcaagaccagcctgaccaacatggagaaaccccatctccactaaaaatacaaaattagccaggcgtggtggtgaatgcctgtaatccaagctactcaggaggctgaggcaggagaatcgcttgaacccaggagatagaggttgcagtcagccgagatcatgccattgcactccagcctgggcaacaagagcgaaacttcatctcaaaaaaaaaaaaaaaagatagatattatataaagcatcttctctaagcacaataggatgaagttagaaatcaataacagaagtaaaactggaaaattcccaagtttgtggaaattaaacaatgcatcaataatcaaaagaccaggtgcagtggctcaagcctataatcccagcactttgggaggccaaggtaagtgaatcgcttgaccccaggagttcaagaccagcctggacaacatagttagactccacctctatttttaaaatatatatataaaataaaaataaatacagtaaaaacaatgaaaaaccaaatagatgaaagaaaaaattgcaacaaaaatttgaaactacagaagaacaaaaacaaaaacacaaccaactaaaacttacaggacatagcaaaagcagtgctaaaaggaaaaactatagctataaatgtttaaatttaggaataagaaagttctcaaatcaacaacctaactttacaaataagaaactagaaaaaaaaaaacaaacaaaacctaatgctagcagaaggaagagaataacaaagattagaacagagattaatgaaatagaaaataggaaaacaaaagggaaaattaataaaaccaaaagttgtctctttgaaaagatggacaaaattgacaaacctttaactaaatggactaaaaaaagagaaaagactcaaattactaaaatcaaaaatgaaaatgggaaaattactaccaactctatggaaataaaaacgattgcaagagagtactgtgaacaattgtatgtcaacaaatagggtaacctggataaaatggaaagattatgagaaacacaaaacccactaaaactaaatcatgaggagacagaaaatatgaatagactgataactagtaaggagactgaatcagtaatcaaacatctcccaacaaagaaaggtcctggacctgttggcttcactagtaaattctaccaaacatttaaacaactaataccaatccttctcaaacttttctttaaaaattaaagaggaggaaacacttcctaaatcattctatgagactagcattaccctaataccaaagccaaaaacactagaagactacaaatcgatatcctttatgaacatgtgtgcaaaaaccctcagcaaaatattagcaaactgaatttagcagcatagtagaaggattatacactatgagcaagtaggatttattcctggaatgcagggacagttcaacatatgaaaatgaattggccgagcacagtggttcatgcctgtaatcccaaaactttgggacactaaggcaggagaatcacttgagctctggcgttcagcctgggcaacataacaagaccctatctctacataagttaaaaaattagccgggcatggccgggcttggtggctcatgcctgtaatcccagcactttgggaggccaagggaggcagatcacttgaagtcaggagtttgaaatcagcctggccaacatggtgaaacccacctctactaaaaatactgaaaaaaaattagccaggtgtggacgggcacagtggctcacacctgtaatcccagcactttgggaggctgaggtaggtggatcacctgagatcgggagtttgagaccagcctggccaatgtggcgaaaccccatccctactaaaaacacaaaaaattagccacccatggtggcgggcacttgtaatccctgctatttcggaggctgaggcaggagaatcgcttaaatctgggagatggaggttgcagtgagccaagatagtgccatgcactctagcctgggcaacaagagtgaaactccatctaaaaaaaaaaaaaaattagccaggtgtggtcatgggtgcctgtaatcccagactcaggaggctgaggcagaacaattgcttgaacccgggaggcagaggttgcagtgagccaagatcatggcactgcacttccagcctgggcaacaaagcaagattctgtctcaaaaaaataaataaataaataaacaacaacaaaaaaagctgggcatggtagcacacagctgtagtcccagctggtcggtagactgaggtggaaagatcacttaagcctgggatgttgagcctgtagtgagctatgactgtgccacttcactccaatctgggcaacagagtgagaccctgtctctcaaaaaaagagagaaaatcaatcaatgtaatacatcccattaacagaatgaaagggttaaagaactacatgatcatctcaatggatgcagaaaaagcatttgacaaaattcaccaccttttcatgataaaaacctcaacaaaccaaaaacagaaaaaagctacctccgcataataaaagccacatatgaaaaatctacagcagacatcatactcaatgctgaaagtcaaaaagcttttccctaagatgaggaaaaaaacaaaaatgcccattctcggcctggtgcggtggctcacgcctgtaatcccagaactttgggaggccaagtcaggtggatcacctgaggtcagaagttcaagaccagcctggccaaaatggtgaaacccccatctctactaaaaatacaaaaattagccaggtgtgatagcatgcacctgtaatcccagctactctggaggctgaggcagaagaatcacttgaatctgggaggcagaggttgcagtgagccaagatcacactactacactctagcctgggtaacagagtgagactaaatctcaaaaacaaaaacaaaaacaaaatgcccattctctccacttctattcaacctagtactaggggttctaaccagagcaattaggcaagaaaaagaaataaaagacttccaagttggaaaggaagaggtataaattatttctgtttgcagataatatgatcttacgtgtaaaaaacttaaaaagattccacaccaaaaaaaaaaaaaaaaaccctgttggagctgataaattaattcagcaaagtggcaggttaaaaagtcaacacacacacacacaaaaaagtcaacacatagaaaccagttgcatttctgtacactaacaattaatctgaaaagaaaattacaaaacaatttcatttacaatagcataaaaaaaaaaagtaaacctgggaatgaacttaaccaagaaggtgaaagacatgtacaatgaaaactacaaaacattaatgaaaaaaagtaaagaagacataagtaaggccaggtgcggtggctcatgcctgtaatccctgcactttgggaggctgagacaggcgggtcgcctgaggtcaggagaccgagaccagcctgaccaacatggtgaaaccctgtctctactaaaaatacaaaaattagccgggtgtggtggcgggggccagtaatcccagctacttgagaggctgacgcaggaggatcacttgaacccaggagacggaggttgcagtgagccaagatggtgccactgcactccagcctgggcaacagagtgagactccgtctcaaaaaaaaagacataagtaaatgaaagcatatattatattcttatattcgtggactggaagacttaatattgttaatatgtcaatgctacccaaagtgatctacaaattcactgcaatccatatcaaaatccttgtgaggtttttgcagaaatagaaagttccattctaaaattcatatggaatctgaagggactctgaatagccaaaataattttgagaaaaaaaaaaagctgaaggactcatacttcctgatttcaaaacatactacaaagctacagtaaccaaaatagcataatactggcataaagacagacatatacaccaaaggaatagaatggagagcccaaaaataaaccctctcatatacagccaaattatttttgacatagatgccaatattattgaatgggaaaagcccagtcttttcaacaaattgtgctgggaaaactgcatatccagatgtaaaagaatgaagttggaccgttatctaataccatatacaaaaattaactcaaatttcatcaaacacctaaatgtaagacctaacgctataaatctcttagaagaaagccaaaagctacatgacattggatttggcaacaacttttttggatatgactccaaaggcacaggcaacaaaagaaaaaaatagacatattggacttcacgaaaattttaaatatgtgtgcatcagaagacaatattaacagagcaaaaaggcaacccacagaatgggagaaaatatttgcaaatcatatatctgataagggattaatatctaaaatatatacagaacttccaaaacttaataacaacaacaaacaacctgattttaaaaatgggcaaaaaggctgggcgcagtggcttatgcctgtaatcccaccactttgggagagatcacttgaagccaatggatcacttcagcccaggagttcaagaccagcctgggcaacatggcaaaaccccgtctctacaaaaaataggaaaatgagcaaggtgtgttggtgcatccctatagtcccagctacctgggaggctgaggtaggaggatcgatttagcccaggaggtggaggctacaatgagcagagatcaaaccactgcactccagcctgaggaacagagtgagactctgtctcaaaaaaaaaaaaagaaaaaagagaaaatgatttgaatagacatttctccaaagaacatatacaaatggccaataagcataggaaaaaatgctcaacaacactaatcattagggaaatgaaaatcaaaactacaagataccatcacctcacacccattacaatgactactatcaaaaaaatggaaaataacaagtgttggtgatgatgtggagaaactggaagccatgtacactggtagcaggaatgtattaggttggggcaaaagtaattgcagttttgccactgaatgtaatggcaaaaactgcaattacttttaatgaaatggtgcagcgactatgtaaaacaatatggtggttcccctaaaaatagaatcactatgtgatccagcaattccacttctgggtatatacccaaaagaattgaatgtaggatctcaaagagatgtttatacaaccatgtcgatagcagcaatattcgcaataactaaaacgtggcagtaacctgggtgtctatcaatggattaacagataaactatgttatagccataaaatggaatattattcagccttaaaaaagaatgaaattctgacatatactacaccatagatgaactttgaggacattatgctaagtaaagtaatcctgtcacaaatgacaaatactgtataattccacttatatcagatacttagagtagtcaaaatcatagagacaaagtgaaatggtgattgccagggactggggagagggaggaatggtgagctatttctttttctttttttttttttagacagtgtctcactctgtcacccaagctggactgcaatggcccaatcacggctcactgctgcctcaacctcctggctcaagcaatcctcccaccttggcctcccaaagtgctggaattacaagcatgagccaccatgcccagcctactttataatgagtatagagtttcagttttacaagatgaaaagagttctgaagatggatgttggtgatggatatacaatattgtgaatgtatttaataccactgaactgtacaatttaaaatggttacaatggtaaattttgtgttatgtgtatttcaattgaaaaagttgaaaaaaagaaaactttcttttttatgtgtgagacagacagggtctcactctgccgcccaggctggagcacaatggcatgatctcagctgaatacaacctccgcctcccaggctcaagagaaaagaaacatttcttagaccatagagcttagtggttaagagaaaactttggtgtcagcagacctgggtttaaatcctgcttctgcatgacctcagggcctctttagggctccttttctctatgcagaatgaagatagcattactgtaacataaggttgtgatgtagactcagtgaaactatgtatgtaaagtacttctgcatgcccagaaaaagaatgatggctatggcaattattaatattatcatgcctctcattgttaccctaatcagtaggcagccagcattttgtttttgtttttgtttttgtttgtttttcgtttttttggtttttttttttttttagatggagtctggatctgtcgcccaggctggagtgcaatggcacaatctaggctcactgcaacctccgcctcccaggttcaagcaattctcctgcctcagcctccctagtagctagaattacaggcacccgccatcatgcccagctaatttttgtatttttgtagacagggtttcaccatgttggtcaggctggtcttgaactcctgacctcaggtgatccgcccacctcggcctcccaaagagctggaattacaggcatagccaccatgcccagctagcagccagcattttgaatggaaagagagcatcttgttcccaataccacagagaggtgtcatcaatttcacttcaggcctcttagagcctccctgtccatgctaaaacttggagctcctgctcttcctgcccagccaccatcaaaagcagcccaactccctgggagcacctttgtctctgctcacattacctccctcccaccattcccagggcgctgagagctttgatgttcacgtggctgcatggcaggggcaggaagataaaatcccacttgttctctctctctacaataccacctttccgcaatttagagggggacagagataaaagagcaggttttttctctttttcttttcttttttttttttttcaacaacaaatggtggtttctctttaccagccgctacttcagagccatgccaacatcaaagagcatgaaatcagtggaaactcaagccagaggacttctgtcccaccctggggtggtgtgtcggggtggggggagcttggctgtttacaaaagaaacagaaagtggagaggagaggagggaactgtgtgcagaggaacatcccactgaggatggcaaaagtttgttttcttagcatttcccctatgccacattaagcttgccaaacagatgggactgagacaaggagggatgcgggaaaaagaaagctcaacttgtctcacgaataaatcttgagttgacttgacatcttctagtccagagggattaaggtggtgacagtgggttggcctgtgtatgtgagtattcaggtgggactcacaagtccgatgacattctctgctctaaatccatgtgactgtgtgcaagggcagaaggaaaagaagaaaagggtctacttgcataactaggaggcctgttgttttccagagtgtgccccatgtgccaggtcctgtgctaaatacctcacatgtagcaaccatggggtaggtaggcttgcttttcccacttaacatatgtgagaactgaagtttaaagagctgaagtccaaaaggagaagcaggatctccactcagatctgcatcaaaatgtgtgttcttggccagatattataaagctgcttcccacggggattgagtgtaactttgaaaagtgacaaacaagataccattgtagggcatcagttattggtgggaatgtgattccaaaaaaagatatgttaaagtctgaacccgcagtccagtacctgtaaatgtgaacgtatttggaaacagggtctttacagatgtaatcaagttaaaatgatttattggggtcaggagaacactaatccaatgactggtgtttttatttgaagagggagattttgccacagatcctcacagagggaagatggccgtgcgaaggcggaggagggagctggagttgtgttgccttaagtgaaggaagaccaagtatggcgcagcccccagaagctgggaagaggcccggaagggtcctcccctagagcctgcgagagcgtctcatgccaaccccttgattttggacttctagccttcagaattgtgagggaataagtgtctgttgttttaagccacccagtgtgtggtactttgttacagcagccctagcaaactaatatcacatctgcctttctgagtttggagagagaccaagacagagagacagagagtcagagagtgttgtggggtgggaataaggcaagacttcaattttcagacaaatatcgtaaagattatctctagcatactggtctggggaatgaggcaaagatgccagccaccagagagagagacagagagagaaatcgaggggggcggtggggtgaaagcagtgaaacaaggggtttcactgaagtaaggggaccaggaagaaagagaagggagctggaacccaagtgagacaggtcagctccttgaacatgaggagagtcaaagaaggttccaaggttccctgccaggaggggaggggttgagaaagagcaggatgctgccaccgtccacgcctgaggacgaccttgcccgcgccagcgcccctgccttctcacacctcaacagggctcttgcatcagactcttcttcagttactgcactcagggaacatgtatttagcactcacaaagtgacaggcactgatggggagaggtggggaggactgccagggtcagagagccgcactaaggacccagggaatggagagccctatgacatcctcagcctggactgctcttcacttcccaatcagcctagaaaatgtccgctcagatttctaggcccactcaacttgactagggcctttaccaccttgctgggcccatgataccttccgtacacctttaatgcttggtagctgtattgtttctttctacctgtatctagatctagatttcaaagaaagcagatccagaagctcacagtctaatggagaattcatatatctcaatctctatctagacctacatatagacctagatctagatagagacatacacgtttttctctttttttagggaaaaaaaaaaaaaggccaggtgcagtggctcatgcctgtaatcccagcactttgggaggctgaggcgggtggatcacttgagctcaggagttagagaccagcctggccaacatggtgaaacctcgtctctactgaaaatacaaaaattagctgggcatggtggtgggcacctgcaatcccagctacttgagaggctgaggcaggagaatcacttgaacccatgggggcggaggtgcagtgagcagagattgtaccattggattccagtctcggagacaaagcgagacttcctcattagactgtgagcttctggaaggtggggccagcatcctattcatctccatctagtctgtgcttttgtggagcctggtgcaacttagttgatcagcaaatagttgacaaatgaatgttctgagtattttagaactcaaacaacaaaaaatgtaaataattttaaaaaataagcaagtgacataaatgcacaactcatgaaataaaatacaaatggctcctaatcgcacgtactagtcacgtcgattccagtcataataagaacgcaagttaaagctatgctgagaaaatattttacctcttagcctggcaacatgtcgtatcaggaggctggggagggagccgggcacaggcaggctcatacctggagtgtgaaatggtgtgtccctaaggagggtaatttggcatcgtcaatcaaaattacagatatgtttatctttagtccaaaaatctcacttctgcaggatacctgctgaatatcttacagatctgcaaacataaaatagctatatgtatagggttacattgctacattgcttgtaacaacaagatatttaaaccaaatcaaaggcccttctctagagaactgggaagataacctgggtaggagcggggaccagcgtggatagctggcgagagaggaagatctctcaaggcgtaactttcatatcaggttgattttttttttttttgagactgagtctctctctgttgcccaggccgtagtgcagtggcgctatctcggcttaatgcaacctccatcccctgggttcctgtgattctcctggctcagcctcctgagtagctgggattacaggcacgcaccaccacacccagctaatttttatatttttagtagagatggggtttcgccatgttggccaggctggttttgaacttctgacctcaagtgatccacccatctcggcctcccaaagtgctggtattacaggcatgagccatcacacccggccgggttgattcttgcattatgtgaatgtattatatagtcaaaaatgatgaattagaaatgaaaaacaggtacgtagtgttaagtagtagatctaaagatagagttggaaaagtcttatgcctgtcttgtccactgcaggaaggttcatggaaagaaataaaaatgactctcaaactcagaataacttaaaattttaaaatggcattaaaatgtacctatcagttaactaattttctgaaagacttaagatggcgtctgttttccttaagaacaacaaaaaagcatcataccaaccaaaaacccctaagtcatctgaaggaaatgccccattgctcactgtggggcattttatatgctcaggacatgggctgcctaaccactatgttccctcattttcccctgccaatcccatcagaattttatttatttcctactttcaactttttctagccagtttcgacctctttttcagaacgcaatatcctcacatatcttggacttttcttttttaattttttccctctctgccccaccaatctgtcttggacttttttttttttttttttttttttttttttttttttttttttgaggcaaagtttcgctgttgttgcccaggctggagtatgatgacgcagtctcagctcactgcaacctctgtctcctgggttcaaacaattttcctgccccagcctcctgagtagctgggattacaggtgcttcccaccacgcccggctaatattttgtatttttagtagaggtggggtttcaccctgctggccaagctggtcttgaactcctgacctcaggtgatccacctgcctcaacctcccaaaatgctgggattacaggcatgaggctctgcgcccagcctgtcttggacttttctagcctccatgccatctatcaaagtcttctaagatctctgactccattcaacttacacatttatactcaaaaatctagattgccttctatgcatatgatgccctacccaagccaggacacaataaatacctcatgtaacccaataaatatctcataacagtcctgtaagatgaagaccatcacaatccatcttctcagcattttacaggcttttttttttttttttttttttgagactgagtctcactctgttgccaggctggactgcagtgactcaatctccactcaccgcaacctctgcctcccgggttcaaacgattctcctgcctcaacctcccgagtagctgggactacaggtgcgcaccaccatgcccagctaatttttgtatttttagtagagatggtgtttcaccatgttagccaggatggtctcgatctcttgacctcatgatctgcccaccttggcctcccaaagtgctgggattacaggagtgagccaccacacctggcctttacaggcattttttaaatggagcctggagaggtctagtactttgtccaaggttatgcagtaaggggaggtggggccaggaagtcatcttgagcagtctgactccatggcccactattcactagcactgcctccctagatgcccccaaaatgcttctggccatagacctttccttctgcttctcatccctctatgcttctttaccttccatgcatgcattcatttgtccataatatccctggccacctgctgtatgccaggcactgtgctaggcgaggaggatgcaaagattaagaagacagtagtccctgacagcagtccctgactttgagaagcttacattccatagagaatgcacagaggtaaaggacaaccccatgcacaggaggttctacaatgtgagcctaggatagggccacccacacacacttgtatgcctttcttgtttttcctcctctgctcaaaaagtcttcatttaaggccctgtgttcatcatgatgggaaaatcagctcaagaaaacttcaggaggattcctccaggtaaattaagttacccaaacagactaacatgctaacaactttcagatttggaatctgctcctctagagcctacagtttgatgactgtcatttcatgttgaaacaagaacaagaggattgcttatgtttgcttctctctgcaagaatctaggttgaaaacaaaatgaaaaggaaatctaatctgaggacacttctcaagtagaagtcagaggaaagagcaataaagaagaactcagaggtcttacctgttacccttaaatgtcttcttcctgatcacagtccaaaggactcatgttactaataccattgttctgacaaagctagcaaggacagtctgctgagcaagtatgcagtcttctctgtgatctattctgtcttcacaggcaagagtgattgcccatgttccatcccccaacaaagcatcaaaaccaaccacacagacctgggttcaaaggcagactctaccacttactgagagatcatcagtgtccttatctggagaatgggaatcatccctaacaggtgcaaagactctagccttgggcatgatcaaattcaaagccttcttgggacactctcataatcagtcactgcaggctttcacctgcacaaccatctagctcagctcttgtgctaatatatcagagccctggccccaactgcccaagggacttgtaattatttttgcagccgtaagtctggcatctagtcctgcagatgggtagggagaacaggtcctatgacctgggaagagagggagttgaaagcaacagagtatcccagctgcagtcacacaggctggggctcagattacactccagacaggatgcagagcaagagtacaaggaaatccaggcgaaaagaaatgctgcaagttggagggagggaagtgtccaggatgcccccagagacagactgagtccatagttagatatcaacaaagcagcacccaaaaaatgactacagaaagaattccctacttcccaaaaaacactcagaaaatcacattgagggaaaaaaatctgaactatgttggactggcctgaacttttgtatagtttaatattgtttttagttttaatacacagaagccaggtgaaggtagggattggaagacatcatattcttctccacgctaggtccactatggttcctaatccagcctggcctattaaataccaatgagatttaatgtatgtctctctagattgagggtcagaaacccaaatgcctacagaagtcaggcagattagataaacgagaaactgtgctaggtgggggtgtaggagctggaacacaaatgctctatggatgcaggcagttgttaatcagtcaattgctgccacagagaagcatggcctgagttgctggatcaatttacttttacattcccacatattaattctaaaaatgatttttccaactgtcttagtctatttgaacttctataataaaattccataagaggagtggttaataaacaacagaaatttatttcccccagttcttgaggctgtcaagtccaagatcaaggtactggcagatttggtgtctagtgagggcctgcttcctagttcataaactgcttcctttttgctataaccctacagggaagaaggggtgagggagctttctggggcctctttcataagggcgctaatcccattcgctacggctctgtcctcaaaacctaatcacctccccaaaccccaccttcttatacttcacattggtgattaggttttaacatatgaatttgggagaacataaacattcaaatcataacaccaacctattttgggggttttttgggggttttttttttttttttttgagacagagtctcactctgtcacccaggttggagtgcagtggtgcgatctcagctcactgtagcctccacctcctgggctcaagaaattctcctgtgtcagcctcccaagtagctgggattgcagctgcctaccaccaggccctgctaatttttgtatttttttaactagagatggggtttcaccatgttggccaggctggtctccaactcctgacctcaagtgatctgcttgcctcagcctcccaaagatagcaccaacctttgttcaatttataaaagatgtttgaaattaaagtctgattaatttctattttcattatggattactaataatatcagctaacacttccataaaacttacatggcaggcagcattctaagtgctttattcacgttgacccatttaatcctcacaacagccatttgaggcaaatctatcatcatcctcctgttgtaaattaagaaattgggagtctctgagcctactctggctcaagaggctgcccaataagaaataagaaattgttttttaatatttaaaagaaagttaaagaaaaagaacaaacaaattaagaaatagaagcataaagtatcaagcaaattctcccaactcactcagataatttgtggcacagctggagctacatggacaactaaccctgggttcaagatgagtttaactttgaggcttccagaaaagacatgagagagccctcctgtaaatggtgaatggttttcttttaccaaagtctttataatagctcattcccccaaaaccctataaatcagagaagtcaactctgaccccttgtctgtgttagtcaaaaagtttcattggagcagaaccatacctactcgtttatgtgtcctctgaggctggctttggtgtatggtctctaccatgagtagtcataacagagaccatgtggctcccaaagcccaatatgtttattatctggccctttacagaaatagtttgcaaactgctactctgaatttaaaaagattttttaaagttcttatactttatacttaattgtactagactcagattaagaaaaatatgtccttgaggccgggcgtggtggctcattcctgtaatcccagcactttggaagggcgagacaggcggatcacctgaggtcaggagtttgagatcagcctcaccaacatggcaaaaccccatctctactaaaaatacaaaattagccgtgtgtggtggcacacgcctgtaatcacagccacttgggaggctgaggcaggagaatcgcttgaaccagggaggtggaggttgcagtgagctgagatcatgccattgcagtccaacctgggcaaaagagcgagattccatctcaaaaaagtaaagaaaagaaaaagatgtccttgaggccaggtgtggtggctcccacctgtaatctcagcactttaggagtctgagacaggcggatcacttgaggtcaggagtttgagaccggcctggtgaacatggcaaaaccccatctctactaaaaatacaaaaattagctgggtgtggtggcgggcacctgtagtctcagctacttggcaggctaaggtggaagaatcacttgaacctggaaggcagaggttgcagtgggccgagattgaaccattgcactccagcctgggcagcagagcgagactccatctcaaaaataagaaaaatatgtctttgaaacttcaattaaaagtatctcctcctaaagttgaattcatagaaggaagaaagctcttaactagaaagttccttaaaaacacacagatatggccaggcgcggtggctcacacctgtaatcccaacattttgggaggctgaggtgggtggatcacctgaggtcaagagttcgaaccagcctggccaacatgaagaaacactgtatctactgaaaatacaaaaattagctggacgtggtggtgcgtgcctgtaatctcagctactcgagaggctgaggcaggagaatcgcttgaacccaggaggcggaggttgcagtgagctgagatcataccatagcactccagcctgggcaacagagtgagactctgtctcaaaaaaaaaaaaaaaaaaaaacacagatacataaacttttatggaaattttcagtttcttctataaaagcagaaaaagaaacaattcaaaccacaattccatttctccaattatcaaaaatctgccaatcctttttttatccaaaaagacaacttttagtggtaaaagctgcttttttgtggcaactgttcttgtttctattttatttaaggttttttgaataactagaacatactagaattgtgtttaagaagactgagaatacatcttacatttgtgactaatgaccctcttagactgaaaatcaatgtttaggcaataagtgtaaattttacagattacaataaaataaaaacaagttagtacacagctataatttgatgaagttaagatggtatttttaaactgaaaggtcaagtttcttgtggaaacaaatatgtgtttccaaggattgtctcattagtaactggtggaatcatttataaacaaataagacaaacaacctttccaggcctcaattcttaagataagatatagaaaaaggtcattttaagaccctaggaagtgtcacaccatcaggacctttctacaaatgagtgtttaaatatactgatgataaatacctgaagaaattaagttgaccttaaagaaattaaattaagttgaatcattggattttgtcctaaactttgcagaatcagagatcatttcgactttgcagacttcaagcagggtatttttctgctcaactgcagttgacatttcttgcatggtaggggaaaaaatatctaaacaaatggagggatacactgtgttcatggattggaagtcacaatatgttaaaatatcagttctccctaaattgatctatagattcaatgcaatcacactcaaaattccaccagacatttttgcagaaattgacaagctgattctaaagtatataagaaaaagcaaaggaagtaggatagccaaaacaattttggaaaagaatgttagctgcctcacactacctgatttcaaggttttgtttgttttttttttttttttttttttgagacggagtcttgctctgtcgctcaggctggagtgcagtggcgccatctaggctcactgcaagctccgccgctcccgggttcacgccattctcctgcctcagcctcctgagtagctgggactacaggcgcccgccaccacgcccggctaattttttgtgtgtttttagtacagacggggtttcaccgtgttagccaggatggtctcgatctcctgacctcttgatctgcccgcctcggcctgccaaagtgctgggattacaagcatgagccactgcgcccggccttttttttctttttaattttttttagagacaggatctcgttctatcgcccaggctggagtgagtggcatgatcgtagctcactgcacctgggctcctgagctcaggcgatcttcctgcctcagcctcctgtgtagctaggactacaggcacacacaaccacacctggctctgatttcaagtcttactgtaaagttaacaataatcaagatattaaagaaggccaggtgcggtggctcacgcctgtaatcccagaactttgggaggctgaggcaggtagattacctgaggtcaggagtacaagaccagcctagccagcatggtgaaaccccgtctctactaaaaaaaatacaaaaattattcgggcatggtggtgtatgcctgtaatcccagctactcaggaggctgaggcaggagaattgcttgaacccgggaggtggaggttgcagtgagccaagatcgtgccattgcactccagcctgggtggaaagagcgaaactccgtcttaaaaaaaaaaaaaaaaaaaaaagatagtaaagaataactgctgcaaatcacttgggcttaatcaggtggtaaagatttttgtttccagagtaactaaaattttaaaaactaacaatatcagccaggcgtggtggcttacgcctataatcccagcaccttgggaggccgaggcggcgggcaaatcacctggggtcaggagttcgagaccagcctggccaacatggtaaaaccctgtgcatactaaaaatacaaaaagtagccgggcatggtggcacatgcctataatcccagctactcaggaggctgaggcacttaaacccaggaggttgcagtgagccaagattgtgccattgcactccagcctgggcgacagagcaagactccgtctcaaaaaataaataaataaataaataaataaataaataaataaatataagaatacaaaaattagccaggcatggtggcacacacctgtaatcccagctactcaggaggctgaaccaggagaatcccttgaacctggggggcggaggctgcagtgagccaagatcgcaccactgcactccagcctgggggacaaagagagactccgtctcaaaaaaaaactaacaatatcaagtgttggtgaagatgtggagcagccagagcaaagtggtgtgtagttagaaaaatgaaattaagtcaaagaaaagacttggacaagagtgtttatagcagatctattcgtaatagatccaagtgtccagcaacgagagagtggattaaaaagtgtgatatgttcatacgatgagataacaaacactcagcaataaaaaggaacaaactactgatacgcagaacattatggatacatctcaaaatcatcagcttggttgaaagaacccagaaacaaaagagtatattctatattatcccatgtgtataaagtttagcaacaggcataactagtgacagaaatcagaacaatggttgcctctgcaaaaggcaggtattgaccaccaagggacacgaaggaactgtcaaggtgagggaaatgttctatacatatcttgacttgggtgacaatcacatgagtgtaatcatttgtccaaattcgttgacaaattcacttaaaattggtgcattttcctgtatgtaaaatatatctcatttttaaaacttgtgtttccacattgaccagaaagatcaacacatgatctatctcttattcattgtgctttcatttttaggactagttggcagaaatctaaggctttaaacaggttgtctatgattctagtcagagctaccaacctcttaacacaagacgctccttctttcattcattctacaaacagaccacaaaacaatcaaacactgtttcaatatataatttatacaatacataatttatgcacgaacatggcactcttctggctttttatattcattagttaatctaaattctactttttaaaaatatgcagtacgggccgggcgctttggctcacacttgtcatcccagtactttgggaggccgaggcagacggatcacgaggtcaggagatggagaccatcctggctaacgtggtgaaaccctgtctctactaaaaatacaaaaaattagccgggtgtggtggcgggcgcctgtagtcccagctactccggaggctgaggcaggagaatggcgtgaacccgggaggcggagcttgcagtgagcagagatcgcgccactgcactccagcctgggagacaaagtgagactccgtctcaaaaaaaaaaaaaaaaaaaaaaaatgcagtacggccaggcatggtggctcatgcctgtaaggcaggaggatcacctgagaccaggaattcaaggccagccttatgaacagagcaagaccccatctctacaaaaattttaaaaataaaaataaaaaaattgccgggcatggtggtgtgcacctgtagtcccagctactcacaaggctgaggcaggaggattgctcgtacccaggagtttgaggctgcaatgagccgtgatggcaccattgtaccccagcctaggtgacagagcaagaccttgccttaagaaaaaaaaaaaaattggggtaggaatatttaacacatgagaatcaaggttcagaaagatcaaggaacttccccaagataacataactaaggagtgatgtcatgaagactcaaacccagatcctaagcacacaccctttcctctccccagtaaatactcttacaacgcacacttgtgtgtgtgtgtgtgtgtgtatgaaatattcaaattgctaattgtagattttccattcttttatcatgaatctgtgataacagtttttttgtgatatttaaaaataaataatcaaagcctttataaaggtctggagcacatggaaagtttgaaaccatagcctgattcaccatacctggctctcattctcaaacccctgtttgctttgaattctaggggctggaatactgacagtaaaagaaggaaacatttgtagtgcttgccaaagggtaaagggggagtttctcttgctttgtttaggtgtaaaacataatcctctattatcctgcacaccgaagtattgccagcgtctttagaagggaggtagacatactgtttgcattttcaaattttaaaattgaggtagtggctcatgcctgtaatcccagcactttgggaggctaaggtgggtggatcacctgagatcaggagttcgagaccagcctgaccaacatggtgaaaccccatctctactaaaaatacaaaaatgagctgggcgtgatggcaggtgcctgtaatcccagctacttgggaggctgaggcaggaaaatcacttgaacccaggaattggaggttgcagtgagccgagaccacaccattacactccagcctgaacaacaagagcaaaacttcatctcaaaaaatgaaataaaataaaataaaattgaaagcaattagcaggaaaagagaaatgagcttcctcatctgcaaccactggctgctcttccaagccatggtccttagaatatggttccttactgaattttttgttctcattagtggtttttaacagtgaatttctaactacccaagtctataccaaagccataattatttaattctgatctgttagaaactttctaagaatccacccaaaaatgccagaaaaattcaaatgactctcgtgtatatagtgagattagtattccacagaaatgcctcattaatgtcaaaataattcacttaaatcttatcctagcaaagcataaaacagctatgaaaaagaataatatcgtgtagataccaagacagaaacaagctgaatagctggtaatgtttatagacgagcaatcaattaactgatgaagaaaaagaaaaaaaatcactattgaaaaagcaggcttctagtctacttccataatactaatgctctaaaagtcattttgcatcatccacagaaagctcccacatatctggccaacaaaattggaagttggtttccaatctgttttcaagtcctaatcctagtttccctaaaaaatagtttgcactttaaagagcccaggacaataattcccctggagacaatttacttttgtggctggcttgtcattctacatataaaccatcttaggcatcagctataagctaaaaaatctcattcctctccttggctcttggagcatggaaataataaaagtgtttccccagatcttacacccttctgagttccaagcagcagtgaatatgattcccaggattgtaaatagtcttataaatcttgccttccctgacaggtttaacttttcatttttcttaaatattagcaataaaagtactgtgtgtaaatatccttaagatttgggcaaagctatcacaggattcaaaatacccagtgcctataaacacacggcttttcatacagctaacagtggagaaacaattccaggagtgtgccaggaatagagaggaaagattctaaataatacaggtgaggtagaatcataaaggaaaaaaagttaactttaaaacacataatttttgttctgcaggcagtttcaaattgggtcgttcaagccagggtgttttttgactttggttctccctagggaaaagcacacagtagcaaaggataatgaaaaggcctggagaacttggatacagacggtctgggatttcaatcccactttaactctcccaagacaagaaacttgaacaataataaattgataataacagtgaacagttattgaaacttaaggtgtggtgggctgtcctaagtgttttgtttttgtttttgtttttgagatggagtctcttgtcgctcaggctggagtacagtggtgcgatctcagctcaccgaaacctctgcctcctgggttcaagtgattctcctgcctcagcctcccgagtagctggaattacaggcgtgcaccaacaagcccagttaatttttgtatttttagtagagactgggtttcaccatgttcgccaggctattctcaaaatcctgacctcaagtgatccgcctgcctcagcctcccaaagtactgggattactttgggattactgagattacaagcccggccttgtcctaagtgttttatgtacattaactcatttaattctatgaggtagtgaagtgtttaggaggataagttccggagctacactgtgtgagttcaaaaactttcccatttgctaactatatcatcttgggcaaattccttttctgtataatgatccttcaatggtatctacctcctaggttacttataagaattaatgagctaatactaaccataagcacttagaatagtgtttggcacaatgtaggtgcttaattgtttgccattcttattttcattttacattaggaaactgaggcatagaaagtctgtttactagagatgcagtaattaatatctaatgaacctgtaatatctggtactttgtaaatattttacacgatagttattttttattccataacaaacaaagaggttgaaaggttcttgtattggttcaaaccccgagagcacaccaacagataacacaaggcggtgtggagcaacatgctgttttaatgagcgcctgggtgcaggcaggctgaggcctaaaatggcgtcagcaccaagtgaggatggggcaggggttttatagtcctctgtaaacaagaagtgtcccagtctgacgtgactgctacgtagtacccagacggcctctttctcaatcttcaggggtacatgtctccctgccagagtaggtgtcttccggccagggtaggtgtcttcctggcagctctcttcctgcttctgctgtcttgctgatgcacgcaagtggccttgagccttgggactgggcctgagaagggaggagttatccctccaagctttcagaccccgggagaatctttcagaggtcactgtgaaaacaactccccctttgtaattcaaaattgcgcttcgcctatgtaaaccaaaaataaaattataagcctcccaactgactgaatggatccctcctcttggccaaggggattccagaataagcctgaaaaactacttcaggccatgatgggaaggaggggttgagtatgcctcattatactctcctccctttggaattcaggtacaactgaccaacagtaacattaaaatagagatcccaagactgacaaaacagattctttgtagcaataagataccaaattccaacctgactctagtataacatcacatgacagatagcaggccctgaaagaaattgaggcattttaccccaaaatatatttctttgacagattttgaaatggccctgcaaagctatctcctgtggggaaaaatctacattctgtagagaatcctcttcccttttcaggtcttttcctgatctgggggaaattaaaagtctagcacctaaaaaataaattaaaaataattttaaagaaataaaaataatttttaaaaaatagtctgacactttttaaggtctgataagagacatttactatctatcctctctgaagcctgctacctggagacttcctctacataataagaaccttggtctccacaaccccttatcttaacctacacattccttttgattgattccagctctttagataatgacttaattcttttttttttttttttgagacgaagtctcactctgtcacccaggctggagtgcagtggcatgatctcggctcactgcaagctctgcttcctgggttcacgccattctcctgcctcagcctcccgagtagctgggactacaggtggctgccaccactcctggctaattttttgtatttttagtagggacggggtttcactgtgttagccaggatggtctcaatctcctgaccttgtgatccgcctgcctcggcctcccaaagtgctgggactacagatgcctgccaccacgcccagcaatgacttaattctttcaaccaattgccagtcagaaaatctttgaatccacctatgacctagaaccaccccactctgtttcaagttgtcccacctttctgtacactttacatgtattgattgatgtctgcgtgtaattcctgtccccctaaagtgcataaaatcaagctgtaacccaaccaccatgagcacatgttctcgggatctcttgagactgtgtctccagccttggtcatttatatttgactcagaataaaacaaaacctctttacatattttacagagtttgacactttttgtcaacacctaaactgatcataaaaagttccaactgtagatttctaatacaaaactttttttttctttttctgagatagagttttgctcttattgcccaggctggagtgcaatggtgtgatctcagctcactgcaacctcctcctcccaggttcaagcgattctcctgcctcagcctcctgagtagctgggattacaggcctgcgccaccaagcccagctaatttttgtatttttagtagagatggggtttcaccatgttggccaggctggtcttgaaatccttacctcaagtgatccgcccgccttggcctcccaaagcgctagggttacaggcgtgagccaccgcatccagccataaaaaacatttaaatagctgtccattactatcatgcccttcttgcattcctggtaataaatccagagcacattaaaactctacacattgaatggagacattctgcaataactcttgtgttaaatcatctttccaatagtagtcagtttactgatctgtaaaatgggaaaccaacactagtccccacagcagggcaccttagggtgaattctctgctgtctacattgtggcccacacactggacagccttggaagcttgagtagagaacacagccatctctcagcgacaaactcccctaaaccaggctcatcatcaaggcccatatataaaactaaaacgtcaaattatttttctttttattttttatagaaatgggatctcactttgttgccctagctggtctcaaactcctggcttcaagcaatgctcttgctttggcctcctaaacagaatgatgaattattaatttataaggagatatagcccgccaagcaggcctgagaatagattagttgatggctatatttgctccctggaggccagagtataattaggttgcttgatgaatgcagaaccagaaagcaggcagagtcatccacctccagaggaactggaattgaagagtttgtactggggcctgatgaggcggggcctttgctctgtagccaaccccccttaggcacagtttagtttgccctcctctcgggcgaattaatttcctttctgaagggcacattctttctttgtctctgtaaataacttcaagcctattagtcaagtcttgggacctagaagccattccatcctttaaggtaatttgcctacataatctgattccttttatgtttgttttgcaatttagctctctctgaaggcaatctcctttctgaagttcaaagcccatagggaagtatatccctgtttcttccatacaccaacagtaagataatcacctagtctagcacaaaacaaatgctccagaaaagtaatcccctttcgtaatgcccttcttccaaaaggtcaacaatagttttacctaccggtggaactttagaaatgctcatggggggacactggcagatctaagggtgagttcattcattcattcattcattcatcttctactttctggctattaggtgccaagggctgagaaatgtgctatgagtcaacaggatgtgaaaaagacatggaccatgccagcctgaatctctaaggtctttgaaacaaatattaacaaattaagctacactgtaatcctaccagagaaggcaaaattataacctgagaaaagtactctgaagaagaaaagaaatacaattcttttagaaaacaaatgatcaggccaggcacagtggtttacacctgcaatcccagcactttgggaggccaaggctggtagatcacgaggttaggagttcgagaccagcctggccaacatggtgaaaccccgtctttactaaaaatataaaaattagccaggtgtggtagtgcacgcctgtaatcccagctacttggtaggctgaggcaggagaatcacttgaacccaggaggcggaggttgcagtgagccgagatcacaccagtgcactccagcctgggtgatagagcaagactctgtctcagggaaaaaaaaaagaaaacaaatgatcagacccaactcaggcagttgaaaaggctttcctgaagaaatgagatgtttgttgaggttaagaggagagaagtagatgttagctggtgggggcagagagtgggtgaacgggcttaggaagaggagagcctttcatccgaaggaaactgcacttgcaaaaatcttaaggcttgcaacagtgagcagcaaatgcataagaagaacctaagaaaggccagccaagcaggggagcaaagaaccattgagcaaagcagtgataacacaggtggcataggccaggcatggtggcttatgcctgtaatcccagccctttgggaggccgaggcaggcagaacacttgaggtcaggagttaaaagaccagcctggccaatatggtgaaaattcgtctctactaaaaccacaaaaattagccaggtgtggtggtggagtgcgtctgtaatcccagctactagggaggctcaggcaggagaattgcttgaagctgggaggcggaggttgtggtgagccaagatcgtgccactgcactccagcctgggcaacagagtgagactttgtttcaaaaaaaaaaaaaaaagacaggtgccataggtaggaaggggctgacccatgcagggtctggctggccaaaacatcaattttgatctttataccaggaagaagagttttagggcaagttgaagatccttgagcagatgtgtacttctaaagatcactcttcctgcatagtggagagtaagttgaaaggggctaaagaggaggcttggggaccaacttaacaggatctgcggttgtccaggtgagggatgctggttcccttagtgcagatgaggagaaatggacagggctgagatacagagaaaataaatgcctattaataagcaaaggttaagaaaaattgtccataccatgatgtcaacctaaaggaaaaaactgaggcaaaatttgtataagtatagcgtttatttgggccagatttgaggactgcaacccagaagcatagattcaagttgctccgaatatacactccaaatagactcaatgaaataatgggacagaaacttaggggattggccaacgagaatggccaggaaagagcactaaggaaacttgggaggtgaaatcttgtgttggtggttacatgaatataaattttttttttttgacatggagtcttgctccgtcacccaggctggagtgcagtgtgcgatctacaacctctgcctcctgggttcaagcaattctctcgcctcagcctcccacgtagctgggattacaggcacctgccatcatgcccggctaatttttgtatttttgtagagatggggtttcaccatgttggccaggctggtctcgaactcccgacctcaggtgatccacccacctcagcctcccaaagggctgggattacaggcatgagccaccacgccaggccataaacattttttttaattcatccaaatatatgtttaaatgattaagtttcattgtatgtaaagtacacctcaataaggttaatattttttaaaaatcagtttagcttaattattaagagcaagtacatggattttggaagtgtacagatatggctttgaatcctagctttaccattagtaattgtgcactctaagaaagtcagttagccaatgtaagctttaagtcttatcactggtaaaatggggagggaggatggctgttttgaagaccaaattgcctagcttagcagactgccaaatacaaaggcaagagggcttttcattcaaattttattccttgccacagtggaagtattaggtgaaaaattaatgtttcttgagtgtttccttgttttctttttctttttcttttttttttgagacagggtcttattctgtcacccaggctggagtgcagtggcatgatcacagctcacagcaggctcaacctcctgagctcaagcaatcttcccacctcagcctcccaagcagctaggactacaggtgcatagtcccacatctggctaatttttttaagtttttttattaaaaataactatattgcccagggtggtctcaaactcctgggcttaagtgatcctcccaaagttctgggagaacaggcatgagccagcagacccggcccatttcttgagggcttcctattattaggcctatggtaggccctttacaggtgttgtctcatttgatcctaatggaaactctaagagatggtctttgttcctatagcttagaaacttcccaggaaccagtaagttggtcaaggtcattcacagacagaacatggagccaaagttccttgccacagtgagagaatgctgccttcgccccaccctcagtgactggggaggaaacatgagggtcctcacaggggattttccaaaagagagtttaaccccaagtggtctgaaagatgattctaaatggcacacagtaggtcatttattattttgcttttattgtattcagttaacttctgtttcatagtagtcttccatttatgataattaatttaatctccttttaaaataagcttaagtttttaaagtgagtcaaattaaagaaaattatgaaagaattgatagtatgggcattacttgtgtatttttcaaaattgggaagaagatttggaaagcttgagaaaggatgggccagcccaagcagagacatgttaaggccctgagatgccagaaagacagtccaaggaggcggggaggattctggctggcttatgaccctagaacacctgagaagaggctagagggtcagaaagggggtgatccctttcctcaccatcacaggggttacagctgacacctataacaaaagacaggtcaacaagagaaaagcctaacacatttatttgatcacagttttatgtgacacaagagccttcagaataaagacccacagatacaaggaaaactgtccatttttatggcttaggttcaatgaagaatggacagccatgtagaactgtggttggacagaaaaggaataatctaaaggaaatagactgagtggggaaacctattaagccctgtggactcagattcttcttggcctctctgcagcatttctttcttcccagtatggggccagaccctttctgcaatgggagtcttatgacctattaccaaacaaggtaggttagagaattttttatggcccctcttacacagaaaggcctgggaagtttagagtaatatttttagcttttctggctggctttggggaagagcagttctatgacccgccttgcggaaggattctagtttctacagctagcctcaagggagaacaaagggtgagagacaggaaggcaggggaaagtcagagagaaactttgcttcagtggctgcttctgataccttcactttggggtattgttttcggagccccactgagggcttatgctcacattactattgcctcctatttgagcagcttcaagacatctagggaaaatacctggaccccagagaaggaataaagatggggaaggaagacatgggaggaggagagtaggaggaggatggaaggaagctggagaaagtgatccagatcgagtagctgtcagctccaggctgggattccaagtaccatcatctgtccgccccagctagggcagcagtctggggaaagccaaaacagctcaaagctttcaaaagccctattttcccctatgaactagggagaacctggctgtaaaagtgatcattttcaaaaacaaagaattaaaataatgaatcctcttgcagtttcagctttgcccagtcactgtcacaggtggcctttgaagatgaggcaagagataatagggtaactattcctagaaaaagacagtgatggtctgcagatttaaatccagagcttcttacaccaggtattgtgttttccaagcaagagctttgcagagcagctgaatggcccacaagatacattcttctcagaagccacaactgcttgcgtttttcctaatctttaggggatttttttaaatgcttatagaatttattctataccttgtttctgctcctgtttttctggtaccagcagggtgtagcattggatttggtcaaattaacttttaaataaagcccctaaattctactcctaatacccttaccaggatcatcccccaaaacacacactgtctatgcccaggctctcaagagagatgttccggaagcttattcatctacaaagggagcaagagcaagagaaattaagaagcttctttaaaactgcaaatcagtttgcacaaagaaagagcaggaaaataggaatgagtggccaggcttcagtgttagacaaagtctagacccaggagaaagaacatcaaacctacacactatgggtggaactttgtgggggttgaagaaaaggattataagccaggggctggctaatgcaggaggatcacttgagcccaagcattcaaaaccagcctggtcaacatagcgagacctgtcttgaaataaacaaacagccagcacagaaagacaaacttcacatgttctcacttagttgtgggagctgaaaattaaaataattgaactcgtggagacagagagtagaaggatggttaccagaggctgggacgggtaggtgggggtaagggggtagcaaggatggttacaaaaaaatacaaagaatgaaaaagatctagcatttgctagcacaacaggaggactatagtcaaatataatttaattgtacatttttaaataactaaaagagcataattggattgtttgtaacacaaacgataaatacttgaggtgacggatacccctgatgtgattattacacattgcacacttgtatcaaaatatttcatgtaacccataagtatatacacctactatgtacccacaacaattaaaaattaaaaaaaattaataaaggaaacaaaaatcggggggcttgcgggttcacaagagattatttgggagaaggcctagttcaaaatgaacactgaatgtttgcagattgaatcaataaatgcatgagtggctggctaagctagtgggcccatggcaagcccaggagagagaagacagggagcagaccaccagaagcttattcttatgcttctctagtctcagtcaaatttgggtcaaaaaaatagaggacacatctaggtaccttagggcccctttgtccagacctgtgcattggaacaatatgagaatcagcacctccccacctacatttcataataaagatcgtaggagttttctcaattgctaacagtcagttacagttggaactgcttgttctcctctttctccccttcttacaactgcacttgactagtcttatttattttttttctttaaaaagatcatataagctcctaggcctttctaagcttaaaaaagctgaaactcactaaggggaagagaactgtgaacatgctgcatgataacttccatatgaactagtaaaacttccctaaacatatggttgttatcatagatagcatcattgtttcagggagcacttactgaaaggctactacgtacctacagacctcatgttgatgcagaacaggtgcttgatcctaaacggtggtgacagttcacatagacagagagcactgggtgaagagtcaggaaatatgaattccagtcctggctcagacactaagtggctttaggaaataggcattccaagcagagaataacttgtgagccatcacagactgacaagaaaaagcatgtgtgagatcaagaaactataagcagcatggtgctcagtagaatcgctgggcaggagtggctaatacttattgagggctcagtaaatagttgttgaatgaacgaatgagggggaggaagatacagatcacagaggatcttatattcattctatgctaagaaacatgaatgtctcggccaggcatggtggctcatacctgtaatcccagcactttgggaggccaaggcaggtggatcacatgaggtcaggagtttgagagcagcctggacaacatggtgaaagccctctctactaaaaatacaaaaattagccaggcgtggtggcgggtgcctgtaatcccagctactcaggaggctgaggctgaagagtcgcttgaacccgggaggcagaggttgtagtgagcggagatcgcaccattgcactccagcctgggcaacaagagcggaactctgtctcaaaaaaagaaaagaaaagaaacatgaatgtctcttggaggcaatggagaaccactgaggacagaggactttattcagacttaggttgtagctaggggctgtgctacataaggagttaatttaggagaacaaggaattacacagaaagacccattaaggccggtcgtggtggctcaagcctgtaatcctagcactttgggaggtggacgcaggaggatcacttgaggccaggagttccagaccagcttggccaacatagcgaaatcccatctctactaaaaatacaacaaaaaattagccaggcgtggtggcacacgcctgtagtcccagctattcaggaggctgaggcaggaggatcgcttgaacccaggaggcagaggttgcagtgagctgagatagtgccactgcactccagcctgagtgacagagtgagactccatctcaaaaaaaaaaaaaaaaagaaaagaaaagaaagaaagaccggtgaagaagcaatgatcaaagagagggagaagagcaaatggcttggagaaaccagacctgaaacagacagcacttgctgggtgattagatgagggagataagtggaagaaaaattgaatcatgggcttttagggtaataaagttcttgatagtaacactagtttacatagaaagtgcataaagtgcaagtaactgataacttcggtttggaatgttaagtggaatatccatgtggaaataaaccagagctaacatttactgagcctttcccatacgccaaaagctgttttaagtcccctacagatgtgaacttgtgtaatcctgcaacagccccatgagataggtactattattagagtcccttttttagacaaggaaaacaaggtacagagagtttaagtaacttctcaaggtcacacagctggtcagtggcagagtcagattcaaactcggacaatcaactccaaatcccactttcttaacctctgtgtaaatgggtatttgccatatagtgagggcacaaagccatcactctacctcttcttggagaagtaaaaaacaaaaaataatcaaatcaaagtgatgatttacattttttaagcacacgaaatgcaagaattccaaccatcagattgtgaatgccattatttttggtgctgtaaaacatattaatagttaaatctaagtctacattttaatatacatctagtctccaaagcaaacaagatgtaatgtgatttgtaatatgcacttgtcaagtcctgctttatttatttatatatttatttatttatttatttattgagacagagtcttgctctgcacccaggctggagtgcagtggcaggagcttggctcactgcaacctctgcctcctgggctcaaacgatcctcccacctcagcctgccaaatagctgggatcacagatgcatgccaccacatcagctatttttttgtatttttagtagagacggggtctcgccatgttgcccaggctgatctcaaactcctgagctcaagtaatccgccagccttggcctcccaaagtgctgggattacaggcatgagccactgcgcccgaccctaaatcatgcttttttatataatctatttagagtaaattaagtagcatacgtcatttgtttaaggaaaagttaaagctggtgtttatatgcattataagtattattacagaacatattaagacatacttcaatataatctttaaaaacataattctcttaagttgattttttctttttttttgagacaaagtttcactcttgcccagtgaagcagcatgatcatagctcactacagcctcaacttcctgggcttaagcaatcctcctgcctcaggcacctgagtagctgggactataggtgcccatcatcatgtcaggctaattttgaaaaattttttttttttgagacggagtcttgctctgttgccccaggctggagtacagtggcgagatctcagctcactgcaacctctgcctcccagattcaagtgattctcctgcctcagcctcttgagtagcttggactacaggcgcctaccaccatacttggctaatttttttgtatttttagcagagatgaggtttcactatgttggccaggctagtctcaaactcctgacctcagttgatctgcccacctcggcctcccaaagtgttgggattacaggcgtgagccactgcaccaggccctaatttttttttttttcttttgtagagatgaggtctcgctatgttgcccaggctggtcttgaactcctgacctcaagcaatctctcaccttggcctcccaaagtgctacagttataggcatgagccactgcacctggcattaagttgatttttaaaaacctaaaataatttctttatttcctaactactttgcagaaataacataatgactttagttccttagaggggatcataacattatttattactgtaaaatagatttgaattttaaaagatcaggaactactgcttggcaccgaggtgtaatttctgccattttgagacatattccataacccagggatccccacaaacaactacgacaagaataaatatgagatcctttccattccagggtttgtggtagagggtttagctttgacttggaccccttactgagtgactaaccattacacagacagagcttgtgacctcatggacatgctcagctggtgagctattctgccaggagctcagtgctattttcatttggctttaatctttcctagatcaagacatagccttctttgaaaagccaggtttagtaagatatacacatgacgtattctcagaaatgaaagaaaacacttttagcttccttccctagttaccaaaactctagaacttactgtaaccctaatagcagccaaaaagaaggtcttttctcttgacccttggctgacccttcttccacttccacgaattttctccctctttctggctatggcataagttttgttccccttgagattcagcccttaacagaaataattcaggcagggtaacagaatgttctagagcactcagccatgactactgagcactcaaaatatagctacagtgacagagaaaggagattgtaattaatttaaactttaatttgaaaacttggaccagatttagttattgaagaacttctacataatttagttattggagaatttctgcatatgtttggaataactttgatatgtaaatctactttttcaactgtaaattttgtgaaacctaaattttataaaatctaattttatgaaattttatgaaatctaaatacagaccaagtatttccaatgaaaatttagtctccaaaccgagatgtgctatgtgttacatccacaccagatttcaaagacttagcacaaaaaaagtaactgtctcattaatagtttttatattgattacatgttgaaatgataatattttggctatattgggttaaaggaaatatattattaaaattaatctcacatggttctttttactttttaatgtggctattagaacactttaaataatatatggggctcacattatttctatcagatggtgatggtctacagcatgggtgatagtgtcacagagactaagctcccccgacttgctggctgtgtgactttaagccatcttcttaacctctttattattttattttattttatttttgagacagagtctcactctgtcgccctggctagagtgcagtggcacaatcttggctcactgcaacctctgcctcccgggttcaagcgattctcatgcctcagccacctgaatagttgggattacaagcatctgccaccatgcctggctaatttttgtatttttagtagagacggggtttcaccatgttgcccaggctggtctcgaactcctggcctcaggtgatccacccacctaggcctcccaaagtgctgggagtacaggtgtcagccaccgtgcctggtctacttagcctctttaaacttctgtttactcatctgcaaactgaagaaaatattggccgggcgtggtggctcactcctttaatcccaacactttgggagaccaaggcaggcggatcgcctgaggttaggagttcgagaccagcctgaccaacatggagaaaccccatctctattaaaaatacaaaattagctggtccagatggcgcatgcctgcaatcctagctactcgggaggctgaggcaggagaattgcttgaacctgggaggtggaggttgctgtgagccaagatcacgccattgcactccagccttggtaacaagagagagactccatctcaaaaaaaaaagaaagaaagaaaagaaaatattacaattttctgaataggcatacagtgaattttacatgagacagtgagcataaactgtgcctgacttatagtaaaatattctgcaaatattcacttttattatcattgttattattctctagcaatcatccagatgtttagcaaaagaatgcctcaaaataaatattagttccctatgggttgcctcttgtatctcatgactagataaattgtaacctcattttccaaaatgaaaaaaaagggacttgaggtcagatacaggtttttctcatatttgtcagttttttagtatttaaaaaatcactttttttagttgatgaaatgcttttggggggggggggattaaaataatgaaattacttaaaacccagacttccctgaaaaatctagggcatgagttttactcctaataaatagtgattctcaatatctcaaataatccaaacttagcaatccttcgtttagattcaattttggccaggtgtggaggctcatgcttgtgattccagcatttggggaggctgagacaggaggattgtttgaacccaggagttcgagaccagcctgggcaacatagtaagaccccatctctactaaaaataaaacattagctgggtgtggtgatgtatgcctgtggtcccagctattcagggggctgaggtgggaaaacagcttcagcctgggggtcatgccactgcactccagcctgagtgacagagggagaccctgtctcaataataataattagattcagttttgaagactaaagtttcattaatgtccacagtttttgcagcggaggggcagaattaaagagacttccaaataaatgggctgaatatacattagggacatctgctttgagaaaaatggagaagtacatttccctattccttctgcaaagtacaactgaaaatcatggaccttatatataaaggtggaaagaagaatgcagactactaggaatctcaggacccaaagaatgacatagcagtgaattccctgggtttctttattgcctcttatatcccaaactgtgctggagctggagaaggtagatgcacagaatgccaatggatacagacaaagaaagtccaaaacaagcctgatgtctctagccaaaggaccaggaaaagagaaggttagccaaacagcaagacagaaaacttttcgataataaccactctactccagctaaacatcatagaaaaactctgactccacctccacccatgccagcaaaggtaaaggagggagtctggacttccacttctgttaatggggcacccttccccttctccactgggatggtgtcagagtagctctagtggagataataagactttttccagtgctcaaaagtaacaaggctactccaatgcttgtggtatcagtggaggcaacatggggagccagaattcccacctacacccggcactaatgaggagccctttctgtcctgaggatgttaatggatgctgagtggggaacctggatttctaccacacctggcattaataaagaggtggctccctcaccaccagccagagtggtattagaagaagccagctaaaacagaaggcttaaataagatccagagtcccataacacaatacccaaatgtccaggttttgataaaaaaacattcatcatagtaagaacaagaaaaatcttaacttatctaaaaatataaccaataggtgccaacactgacatgacagagatactagaattatctaacaaatatttgtaaacagctattataaatatgcttcaattagccataataaacatatttaaacaaatgaaaaaaatagaaagtctcagcaaagaaatagaagatttaaagaagcaccaaatggaaatttggaactgaaaactacaacgatagaaattaaaaactcagcggacgagctcaacagcagaatggaggagacaatagaagtaaacagtgaacttgaagatagataactagaaattacccagtctgaacaacagaaagaaaatagataccccaccccccataaattaacagagcaataaggatctatagattattttaaacagtctaacattaatatcactggagtcccagaagaagagaagaaagaagatggagctgaaaaaagtatttgaagaaataatggctaaatatctcaagtttggcaaaagatgtaaacctagagatttaagaagctcaatgcacctcaacaagaaaaaccaaatgaaatccatgccaagacacatcatagtcaaacttgggaaaactaaagacagagaaaaaattattaaattaagtctcttccatgcttcatgaccaaaaagaaaaaaaaaagtaatgaaagcagtgaaagagaaataacaccttactcacaggagaaaacaattctaatgacaacagatttctcatcagaaatcatggaagccagaaggaagtggcacagtgtttttcaagtgctggaaggaaagaactatcaatccagaattctatatccagagaaaatatcttcaggaatgaagggaaaacttagacattctcacatgtaagaaaactaagataatttgtcatcatcagacataaactaaaagataggctaggctgggcacagtggctcacgcttttaatcccagtactttgggaggccaaggcgggcagatcatgaggtcaggagttcgagaccagcctggccaacatagtgaaaccccgtttctactaaaaatacaaaaaaattagccgggtgtggtggcacacgcctgtagtcccagctactcgggaggctgaggtgggagaactgcttgaacccgggaggcagaggttgcagtgacctgagaccatgccattgcactccagcctgggtgacagagtgagactccgtcacaaaaaaagagaaaaaaaaaaagtgctaaaggaagtttcctaaacagaaaaacaacaacaaaaaaatgataaaagcagtaatcttggaacatcaggaagaaacagtaaaattatgagtaaatataatggattcttcttctccacttaagtttcccagattcttttaaatagctaaagcaaacataacagtgatgtggttctaaatgcatatagatgggctatttaagatttatgggctgggcgcagtgtaataccagcactttgggataccagggtggatggatcgcttgagcccaggaatttaagaccagcctgggcaacatggcaaaaccccatctttactaaaaatacaaaaattagccaggcaccaggaatcatgcctgtaatcccagctactcaggggctgaggcaggaggatcacctgagccttgggaggttgaggctgcagtaagccatgattgcaccactgccctccaccctgggtgacagagtgagaccctgtctcaaaaaaaaaaaaaaaagaattataaatatggagagtaaaaagacataaggagaagtaaggtttctatgcttcacttaaactgctaaaatgtcaattccagtagacagtgataagttatgtatatataaccactaaaaatactatgcaaagatacacttaaacgcactaagttgtttttgttttttgttttttttttttttgagacagagtcacaccgtcgcccaggctggagtctagtggtgcgatctcagctcactgcaagctccgcctccctggttcacgccattctcctgcctcagcctcccgagtagctgggactacaggcacctgccaccatgcccggctaatttttttttgtatttttagtacagacggggttttactgtgttagccaggatggtctcaatctcctgacctcgtgatccgccggccttggcctcccaaagtgctgggattacaggtgtgagccaccacgctcggcctaaatgcactaagttttaataacccataggaagttagaaaaaaaacagaaacataaaactgagagaaaacaaaagatacaaaatacaaaaaataaaatgtcaggcacaagtcctatcacatcaataattatatccagtgtaaacgacctaacacaccaatgaaaagacagagatttgcagagtagacgaaaaaacatgacccaactatacatgtgtctacaagaaattccaattataattagataggtagattcaaagtaaacaaatagaaaaaatatatctcatctaaacattaatcaaaagaaagcaggagttgctatattaatatcaaatagagtagactactgagtaaagaaaattaccagagatggggcaaaacattccataatgataaaagggttagtccatccagaagacgtagcttcctaaatgtgtgtgcaacaaacaacagaactgcaaaatgtgaaacacaaactgatagaactgaaagaataaatagacaaatccacactaatagtcataaacttcaatgccttctctcaacaactgatagaacaagcagacagaaaattggcagggatgtagaagaagtcaggaatactttgtttgtttccttgagacagggtctcactctgtcacccaggctggagtgcagtggcatgatcacagctctctccagcctcgacctctcaggttcaagtgctcctcccacctcaacctcccttgtagctggaactacaggcacctgccaccacacctggctaatttatgttatcttattttttgtagagataggggcctcactatgttgtccaggctggtctcaaactgctgggctcaagcaatcctcctgccttggcctcccccagtgctgggattaaaggtgtgagccgccgctcccagcctgataatactattaaccaataggacctaatctacatttatagactattccacccaacaatagcagaaaacacattattttcaagcgcccatggaacacatcccaaaatagactatatcttgggccataaaaccaacatcaacaaatttagaggactaaaggctgggcgcagttgctcatgcctgtaatcccagcactttgggaggccaaggggagtgcagatcacttgagctcaggagttcaagaccagcctggccaacatggtgaaaccctgtctccactaaaaaaaattaaccaggcgtggtggcgggtccctgtaaccacagctactcaggaggctgagacagaagaatcgcttgaacctgggaggcagaggttgcagtgaaccgagatcgagccactgcactccagcctgggtgacaaagagagactctgtctcaaaaaaaaaaaaaaagtataaataaaactgccatatttaagaaaaatattgttgcaggttgggtttcctgggaaacagacttagagatggaggcttacacacaggaggtttattgggaagtgatcttgggattaacacctgtggagatatcaaagctgctgattcaggcagagggagaagttgggctgcaacgcagtcacagcaagggcttccgcccatctcctggggagcccttgagctaggatggtcttacagaaatatcccaaaataaagcaagggggctggacatttagacctcacatcatgatatgaagggaaatgaccttggacagctggcttctcatcactagggttgtcggggagagcaggaggagacaggtgtgagctgtcagccaatcagactgccggtttcagtcatgaagtgggagatctgggcagcccacccagtgcttattctaagtttgaatcacctactcattcactctcaccagggaaacctttatgtagacccaatagacagtaaaggctacctcctgaagaaagagcaggctgttagaaaaaaataatcatagctacaaaactttttcttaccagaggtaagatgacttgtcaccaccaaggtaaggcagcatcttatgctcagcacaggactgattccagcttccctgtcccacgtaaaggcagcccagcagtgaacctcatgccattgacccactcttctctctgccccttgccagcactgacgatatcttaccaaacactagtgactgacacatgaaatgcattccatcccagagagcctcctgaatgttaattttttcacgaacggacagggagaaaacttttatgtggaaatcgttgtgacagaaaaatggtctatggctgggtgtatactttcagcagagctcaaaggtcaaaccttcagtctgatcatacagttttcatgctttctgcctgctggagattcccagaaaaattttccaatagaaaaaagaaagacaaaaaaatcattagaaccagaaagaacatccgcccgtcatactcaatgttaaaaaaccatgtgactctgccgggcatggtggctcatgcctgtaatcccagcactttgggaggccaaggtgggtggatcgcctgaggtcaggagttcaagaccagcctggccaacatagtaaaaccctgcctctactaaaaatgcaaaaattagctggatgtggaggcaggtgtctgtaatcccagctactcaggaggctgaggcaggagaattgcttgaacctgggagacggaggtttcagtgagccgagactgtgccattgcactcactccagcctgggtgacaagaccgaaactcagtctcaaaaaaaaaaaagtgactatttaaacaaggaaactcattcttttgcccacttatggtatgatcatttaaaataacatttttaaaaatgtatagtataaacttgggggagggcgtggggagaaagaaggaaggctttcttctcagcactttccaaaagcagacagatgaaatatagacctagcactagaataatgacttcagatgaagtcctgtgaaagcaagttctatctgactgtctctccgtctgtctgatgtgacatcagtggtcaaaccctggaaatgatggctagagggcaaaatctattttaggtgttctctcaatccccttagcctcaccaacccacttgtcccaggtttatcaaatccatgctagaacctggccacactgctaagtctaaatctccaggaaaaataacgtttaaaaaagaaaagactgggccaggcccggtggctcacgcctgtaatcccaacactctgggaggccgaggcagacagatcacctaaggtcaggagtttgagaccagcctggccaacatggtgaaaccctgtctctactaaagatacgaaattagccaggtgtggtggcgggcacctgtaatcccagctactcaggaggctgaagcaggagaatcacttgaacctgggagacggaggttgcagtgacctgagatcgcacctttgcactctagcctgggcaaaaatagtgaaactccatctcaaaaataaataaaagacttaaatacagatgaaattcaaaggtaggggcagtaaacctacttagcgaataatcaagtttctgcatttccttttctctttggtatgagtgcaataatcttgtccccagtctacgggctcttctggtacttccaataaattccttccagggaccccacctaatcctttgtacatggtcccagttgtctgccttcctgaggtaaacgcattcctaaaacattctgtgtgaaggagatgttcatagtacaaataatacttttccactgactttaattctgattccctagtatttttatcatggcttctaatctatcttctggctacaagaagtgagtcatttgtaaagtgaagaatttattttaaagtgagcaatcataccacccattttctgttttcctccagagaggcatctaaaaatgactttccccttgtagtcccaaagttctcaaacctacactcacctctttgcccaaaacttccagcctcaactatgttaaggtctctctctgccttgcttagagccccaccgtcgctgtgatagttttctagagatgcccaacgaagtatcgcagagttgttaaagaacaggaatttatttttccacaggtctggaagctagaagtccaagatcaagctaacagcagggttggtgtcttctagggcctctctcctcagcttgcagatggttttctctctgtacctgtctatatccacatttcttcttgtaaggtcactggtcatattggattagggcctacccataattttattttaaccacttctttaaagaccctatttctaaatacagtcacattctggggccccctgccttaagggacaacatccaccacattggccggtatgctaaatggaagcattacatttctttgtgccaattgccataagaagtaaggccgaaagcaggagaagcatgtcttcattttctcaactcactactccaccgtctaggtccttgatttaaatgatttcatgacacaagtaggaacagaccctttgggcaactcagcagctaagccaacatcaccttaagcaaaatgttagacatgaaaatgtcacattacatggaaaacagcgttaagggaccacaactacaataaggaaaagactgtggttttttttctctcttatattgtttgtgtaactaggatgattcctgtacataatttattcgtatgcatatgtatccatatattatatataacatttattgagatccagccatgtgccaggcactgctctaaaagcattatgtgtactagctcacttaatcctcatgatagctccatgagatagatacttttatgatccccaaattatggacaaggtgctgcagcacagaagttaagccgctgcccaaggacacacagctggtaagtgttgcaggtgggatttggccctggaagtctggcttttgtatcttatgcatcagttagcagactattgcttattttgatcaagtcttttctatttctaatatgcaattaacatataaacaccattagttccattgaaaaacccactgcagagatttcagaaggggctgcaaacccctttgagcaggctcccatcaggctacctttcctgggtggtcagcagctgctttgctcctctgtgaactttttccttaatagcaaagtggcctcaagaagacctctggcctcaagaagctccccactcttgtactggcaattggcaatacagtgtacaaatgtacactgcttcaactggtcctagaaaacctgggaaccgatgcatccccacaaggaaatattagagttggggaccaggtgaaatcacagtcataccttcaggaccttccatatatacttgccttattcagcacgtactcagtactaagaacttaagttatttacacatattagctcactttagcctagaagaagcctacaagaagatattaatgttcatcattaagaacaatgtatataaaaatgtaaactgcaaaatgtgttaaaaatcttaagctttaataaactggagttaaaagagaaattgaattaaaccacactatccttactcaagttcaaaaccatatatattttcaaaaattattttctgtagagatgtggcctcactatgttgtccaggctagtttggaactcctgggctcaagcaattttcccatcccagcctcccaaagtgctgggattacaggcacaagccacctcagccagtccaaaaatatttttcttaaatcatactctcacaaaaacgttttgtctcactccacttccaaagtgactcatggaagccgtgaaaaccagaaccaataatagtaatgggattaaaaataaatagaatttattaaatatctactgtgtcccaaagtggcatgtgtttcttttcttcttttttttttttttttttttttttttgtagaaatggggtctcactatctttgcccaggctggtctggaactcttagtctcaagcaagcctcccgcctcagtctcccaatgcactgggattacaggcatgtgctgcccaacggtgtttcctggactcaaacttgctttgatgtctcaggtctgcatctacaaactactggatgttgagaaagtcctgtaactttcccatgcctcagtttcctcatctgtaagtgggatgacaaagatacctatcttgtaggcttgttgtgaggatgaattgagttagcttatgtaaaacgctcagaaaaacacatagcatgttgtaagaagacagaagtgcctgcggctatcatcaaaatctcacaaccttggtaatacacatttttacatctgaggaaaacatctgaggcttagacctaaacttgccgcaggtaactcattagaatgtggctggggcgggggacagtggtgaaggttccaacccaggtgtggcagattccagagcctgcggtctgaaccagcccctggtgacctttaccccgagagcggaagaaaggcaaacaggcggaagcccacagccgaggccatcgcgctgcgcatgatccgtggcaaccgtccttccttgacctttgcccactggaaaagccaatcccaagtcagcctggggtaaaggggcggggccttgtggttggcatagcaacagacatgggtcaaactcacctgggggttagggcggggttgtttgtcactaaggaatcattgctgaatgacactacagtggagaaccagagccccgggcttttctaaacaaacagccctggtcactgctgaattcaaagtgtactgccggggccgggcgcggtggctcacgcctgtaatcccaacactttgggaggctgaggcaggcggatcacgaggtcaggagatagagaccatcctggccaacatggtgaaaccgaaaccccgtctctactaaaaatacaaaaattagctgggcatgatggcgggcgcctgtaatcccagctactcaggaggctgaggcaggagaatcacttgaacccaggaagcggaggttacagtgagccgagatggtgccactgcactgcagcctgtcaacagagcaagacttgtctggaaaaaaaaaaaaatgcgcaccgccgggcccgcctccctcagcacccaatgctggtcggagccctcgggcaaacaaactacctcctgcatccgggaacttaccctccaggcggaaggaaagaatgcggggacagagacctgtcctgggagaagctccttaggagatgaaggagcaccgaaagatgcctgacgtttttacgactcctctttcatgtttgtgtcccatctcttctcagaagaattagccatgttttgtgaattccaggtgccatcttcaaaaacacccttggattctagccaatcaccaaaatggcagagacggccacctgagaccaattagaatatccacaccagtggaagagagctccagtggtaaatttcctagatgtacaactattgatttcatgatgtattgttccataaggtgactttaaaacaggacaaaagtcatgattcgtatctttgtttcatcttgtcgttaatattatatctggtaattttcttgaaaacataaggacttattttacaaatttgtatgctttcataagtacttcattgtaactttaatagtaaataaactttggctttattaaggtgtaggagagaaaaccctacgaacagaaataaaacaattgtgatgaatcattcattaatccctgggagaagcagagtgggcgtactgtgggcttaggctcactaagaaggacctggattcacatcctagctttgtccattgtatgtggccttgggcaggtctcataagccacactcctttgcaaaatgaagataacaatatctacttctgagagctgttttcagaggatgaaagtgcataataagtgccttatcttacacatggcccagtcttggctcaaaaatgttacttttctttcttgaatatccccacttcctcttgaacagcctcccccaaggcagttagttgctcatctttctccctaatccccagataatttgttctgagcagaataatttttatcccggtagcttagaacagtggccagcccacaacaagtacttggtgtctgtttatctggacttggttgtgctgtaatttatgtgctgactgagagctcccagggataggaaccacatcagctagcatctagcatagtacctagtacatagtgcctactacataggctatgctcagtaacatagttgtgttactatgcattgcactcctcatttttgcaaggtacacaaacatatctgtcttcagcagccaggcaggtgaattaagataagagcgataaagtccgtgacaaactggaggcattcccattcaactaaacaaaaaacacttttctggccaaacacaacaatctgtccacaggatttacccctctaccataaaactgccaccataaacaaagctttgtaattaacaagttcttttttttttttttttttttttttgggcagggtatcaatctgtctcccaggctggaaggcaggagtgaagtgaagtggcatgtggttcacagtagcttcaacctcctgggctcaagtgatactctcatctcagcctcccaagtagctgggaccacaatcacatgccaccatgctgggctaggttttttattttttgtagagatgaggttttgccatgttacccaggctggtcttgaactcctggcctcaagcgatcctcccactccagcctcccaaagtattgggattataggtgtgagccaccatgcccagcccacaattactttcttatatgttatctcatttgatacttgagcaattttctgaagaaagcgtttttgagttcattttacaggcatctgatagagaaactgaggctcaaatacagagatttatccaaatcaaactaagttaatagccagccagggatttgcattcatgtcttctaacatcgacccaggactcccgcttctctttacaccatatactgttctttatgtgccgctgtttttctctttatagtttttctaggacaaaaaccaagctccatcagaaggttaaacctgtgtcaggtttacagtccaatgaccgccgtgggtcataatccatctagagctctgagacaggtgcctttagaaacaatgccttctttgcaaccagaggagcgtgttttcctcgagtcatcagcatagagaggcctggcagcaaggtatgatgagcatgatgagtgggctgacaggaagaactctgcacccaaatggcaatgaggaagcaggctccttatatcaacgtgaagaatctttaaaggaacttgagtttgtaaagagagcaagaaaaacaagatagagtcttagcaactagaggaaacaagcatctcatttctgtaggccagtgttgtccaacagaaacaaaatgtgagctacatataactttaaattttctaaagagtaaaatttaaaaagtaaaaagaaacaaaagaaattaatttgaataatacattatatttaatctaatatatacaatatatttttaacatgtgaccaatataaaaattattaatgagctattttatttatttatttttgagacagagtctcactctgtcgcctaggctgtagtgcagtggctcaatcttggctcagtgcaaccttgcctcccgggttcaagtgattctcctgcctcagccacctgagtagctgggattaattagcatgtgccaccatgtccggctaatttttgtatttagtagagacagggtttcaccatgttggccaggctggttttgaactcctgacctcaaatgatctgccttcctcgacctaccaaagtgttgggattacaggcgtgagccactgcgcatgtaattctttttttaatttatatttcttttttttttttttttggacaaagcctttgacatccagtgtgcattttatatttacactcagtggcactggccatatttcaagtattcagtagcagctgggcacagtggctcacacctataatcccagcactttgggagactgaggtgggcggatcacctgaggtcaggagttcgagaccagcctggccaacgtcgtgaaaccttgtctctactacaaaaaaaacccaaaaaaattagccaggcatggtggcgggcacctgtaatcccagctactcgggaggctgaggcaggagaatcgcttgaacctggggcagagattgcattgagccaagatcgcgccactgcactccagcctgggcgacagagcgagactctgtcaaaaaaaaaaaaaaaaaaagaagtactcagtagccacatgtggctagtggctgccatcttggacagcacagatctaggccaaagaaattcctaaaggtctatatttctggcatagtaaaaatgagtgacatggctctcttcaaggccactgagaggtctcatttccaatcctgctagtccagtttgaagactgatcttttagggtcaacttcaaactttgccgccatttagagagcagccgtgtcaatttccagccagttgctctgcaaagccaatcagagcccattatgtttggctccctgtttttgccttgcaagagtgcagtcctcagcatgtcccctttcaaatacctattattctggtgctgtcttcagtggtgccatgactggcagtgattagggtgacattttttatgtgcctgagttcacagagcaaattacatagcgtgagtggcatggtgattaagtggctgtgtgtaaagactagaatcgctacatttgcatgtctctgaataatgagattcttatctccattatgtggcaatgaggtcgaaattgatagcgctattaactgtttacacagtaagcacaattttctattctctctttctctctcactggtttcaaagcagccaaaagctttgagccccccagcaaccctcccaaataagttttccataaaaagagatttccacaacccctcaataaattttctggctgccttccagagcccacagataatccaatccaccctcttggtttcacagggaagaagctgcagtgtagagaggtgagatttgtccaaggtcacacagaaagaaagagggctggaaaacagaggactccaacaatactcattccttctctgatttgtgtcctctggtgcccggctgcagctttggaataatgaagtcccaccttccagcctacatacatattgtgcattctggtcacacacccattttgctgctgaagagatgatgaaactggctgaaattataatttgattctccaaacacagagaccttttcagttgaccctagagatgagccctaactatactttgaatcaacaaatatcaattttcgcagcaatgaaataaatatatggagagatagttatagttacagtgggttataaaacagggcaagggaaagctgtgactatttatttggctctgctcctagcaatgaagtatttatccatcagctatgtggcagtgacattttttatatgaagggcaagtttgaattaataactaaagagaccgtttttaaaaatagatcatcagtgtagcaacccaaaaatgtatccaataaagtgcttcactagcaatattgcaaaacatgaggaggaaaaaaactctctccaattaaattctcactcaccagtgctttcgtggtggaacaaccacaacagcatgaaggttaactgccttggcataaaagaggagacggagtaacaggatttgtcaagtagatcgtggcatcagcttaacatttgtgggagttaaatgtatgcatgaacagttgtaatgctgagttccattaaaaaatatgatggtgaaatggcctggagtgaagcattattatttattatgaactaaaacggactatttgtttgtgatatatcttaaaagtactgagtgccttgaaatcactagaagggttcattacctctgtatcccatcaataaccaaaaatcttgtcctaggagtcaaaactgaaggagattccagatggcataaagcacaagaaaactggttcctatttagcagtgggtaaagaagttgtgaaatccttcaggactccacttaaactttgcggggttgaaagaggccctccctggaacccatagtctaaattacacttctttggtataagtcaccatatttctttttttttgagatggtgtttcactcttgttgcccaggctggagtgcaatggtgcaatcttggctcactgcaacctccgcctcccaggttcaagtgattctcctgccccagcctcctaagtagatgagattacaggcaagtgccaccatgcctggctaatgttgtatttttagtagcgacagagtttcaccatgttggtcaggctggtctccaactccagacctcaagtgatctgccctcctcggcctcccaaagtgctgggattacaggtgtgagccaccatgcccagcgaagtcacaatatttccacatgcgctgtttgatttattatatttgttacacgaaggtacttactacctgtcttctccacaaagtctgtgaactctagcaaggcaggtgcctatgcacctaacagcatattcatccattcaaaatgtacctacagagcacctactaagagttagccaacacaattctgccctcatatgtttacatccagatagggggacatagaccataaacaattaaacaagcgagttgatttgcttttttttttttttttaggcaaggtctcactctattggccaggctgaagtacagtggcatgaacatagttcagtgcaacctcaaatgcctgggctcaagcaattctcctgcctcagctttgcaaatacttgagactacagactcaccatcacacccagctgatttttttttttttagatggagtctcactctgtcgccaggctggagttcaatggcacgatctcggctcactgcaacctccacctcccggattcaagtgattctcctgcctcagcctcccaagcatctgggactacaagtgcttgccaccacacccagctaatttttgtgtttttagcagagacagggtttcaccatgttggccaggatggtcttgatctattgacctcgtgatctgcccgcctcggcctcccaaagtactggaattacaggtgtgagccaccatgcccagccacacccagctaatttttatatttttttgtagagacagggtctcactatgttgcccagactggtctcaaacttctggcttcaaacaatcctcctgccttggcctcccaaagcattagattacatttgtgggccaccacacctggcttgattttagataataatatgggagactgatcagagaaggtttccctgaggaaatgagattaaggaaacctgatactgaaagttctgggctggacatagcagctcacgcctgtaagcccagcattttgggagaccgaggtgggcagatcgcttgagctcaggagttcaagaccagcccaggcaacatggcgaaaccctgtctctactaaaaatacaaaaattagccaggtgtggtgttgcatgtctgtagtcccagctactcgggaggctgaggtgggaggatggcttgagcctggtaggcggaggttgtattgagctaagatcacaccgctgcactccagccttgacaacagagtgagaccccgtctcaaaaaataaaaataaaaataagttctggatagatatgagctgagaggagtgaaaaataaaaataaaagaaaaacaattttttaaaaagaagaaagttctgggtaaggggcattccaggcaaccagaagagcaggtggaaggaccccaaggtggaaataagtggctatggctggaacctagtgggtgaggagaagatgaagtcaaggaggcagattggggctggattatgtgcttggcacagagtaaacactcagtaaacatatgtttcatgaacaagtgagcccatatcagctataattgcaggcggaatgtaattcttgctaccctgggcaagactgcaggtgaccaaaatacaaaagtaaagcgtagatattaagtgttgtctccacaaaaataactacatgatgtatattgcgtttgttaattagctagatttaaccattccatagtgtatatacacttcaaaacatcatgctgtacacaaaaaatacatacaattttatctgtcaatttaaagaaatagtggttgttctagggtttacaatgttcatattttatgtatcatagtctcccttcaaagaatattacactactccacatgtagtttaagaaccttatgatagtatagttacaattcctccaccctttggtcttttaatcctcacaatacacttattgtatatttgtttacactgctaaatatcattgattggttctttaaaaatcctctgttaaaaaaaaaaaggctgggaacagtgtttctcatgtctgtaatccctgtaatcccagagttttgagaggctggggcaaaaggattgcttgagcccaggagttcgaggctgcagtgagctatgatcgcgccattgcactccagcctgggcaacagagataggctctgtctctgaaaaaaaaaaaaaaaaaaaaaaatagagagagagagagagaaaggtagaggctagaaacttgaaatttcaagagaaccacaacaggtaaataagataagtcctggggactcagagaaaatgaaaatgagatatttaaggcagcctataataaaccccaaattgctgcagaggaagtcagggcaagggagctaaatgcaggctgacatcatatggggcaggttcctgaaggcaggatgtgaactaggccttgaatcacacacaggaatttattgggcagaacaaataaggaaggtagggcactccaggaaaatcggtcttatcacattatcccaatggaactaccacatttatttctaggacgttatgtaaatccatactatgctcattacacagagggacaattgattatatgcatggagtatagaagttggatcaaatttattggccaggcaccgtggctcacgcctgtaatcccagcactttgggagactgaggcaggcgaatcaccatgtcaggagatcgagaccatcctggccaacatggtgaaaccccatctctactaaaaatacaaaaattagccgggcatggtggtgtgtgcctgtagtcccagctacttgggaggctgaggcaggagaattgcttggcccgggaggtggaggttgcagtgagcagagatcgtgcctctgctttccagcctggcgacagagcgagactctgtcaaaaaaaaaaagaagttggatcaaatttgttttaagttttaggcttaaattgtctcccttgaaattcatagactcctcatctagtggagaattgcctatcttcagctcatgcatagtgaaattgatgagttatggatctataagggatgttctaattctctcatttgctggaaactcagtagcctgctattcttgttgtaatggtttagttctttttagcactttgttaatcaaactgtgttggagattgtgccagggtgatccaacctcctattataaggtctgtgagacatgagtcacagcacaaccaagaggcctcaccagaaactagggtagcatccttgacaccaccgtttctctcatgacccccagtcaatctaaccagtgaagtgctatcaattctacctctcaagtaactctcaaatctgtcgtttttgctccttgcttaccacactgccttattcagccccttaacatttcttactaaatcccaccctttaatttccacctcacctccagctatttttaaacattcctttccaatccccataacctccctgtgactgcttgaacactcaccataatatacatacacacccttcacgatttgcctactctttcatccttgtcttacttcatgcctcccaaacagcccgagttcaagaaaacagccatttatggtttccccaaagccacatgctgctggtagtctccactcctttgtgcttgcaatttcctctgcctagaatttctttgcccagccctgtgtggtctcttttattcgtcctttaagactcagcttgggccaggcatggtggctcacgcctgtaatcccagcattttgggaggctgaggcaggtggatcacctgaggtcgagagtttgagagcagcctggccaatattgtgaaaccccaactctactaaaaatacaaaattagccaggcgtggtggtgcatgcctgcagtcacagctactctagaggctgatgcaggagaatcacttgaacctgggaggtggaggttgcagtgagtcgagatcatgccactgctctccagcctggacaacagagcaagattccatctgatttctataagcaagattaggggtttttcttaatttttttttttattttccgagacagtcttgctctactgcccaggctggagtgcagtggcatgatcttagctcactgcaacctccgcctcctgggttcacactgttctcctgcctcagcctcctgaatagctgggattacaggcgcccgccaccacgcccggctaatttttgtatttttagtacagacggggtttcaccatgttggccagactggtctcaaactcctgacctcatgatccacccacctcagcctcccaaagtgctgggattacaggcgtgagccactgtgcctggccaagattaggggtttttcttctgtaggttctgcagcatcctattttagcattcctacattgctgtaattaatactaggcatatccgtcccacctgacatgggtaggaaccatgtgccagccatatttttatccctttttttctctctctctcttttaagaggcaagaccttgctctgtcacccaggctggagtacagtggcataatcataactcactgcaggcttgaactcccatgctcaagggatcttcctgccttagccacctaagtagctagaactacaggtacgtaccaccacactcggctaatttttttatttttgtgtagagacaaagtctcactatgttcctcagacaggtctcaaactcctggtctcaagtggtcctcctgccttggcctcaaagaactctgggattacaggtgtgggtcaccctgcccagcctattcccattcacagtacaccatcagtaaatacttatcaaagtaatgaccaagtaaatgcatttttatatttttaggacactattatacatgcctagtccttacaactactactagaccagggaattattgttaacatcccaggaaagaaataaagttagagtacaggctgggtgcagtgacccacacctgtaatcccagcaatttgggaagctgaggcaggaggatcacttgaggctaggaattcgagaccagcctgggcaacatagggagacccctctctacaaaaaaatttaaaaattagctggacatcatggcgtgtgcctctggtcccagctattcggaaggctgaggtaggaggatcacttgatgctgggggtttgaggctgcagtgagccgtgatcatgccactacactacagtctggatgacagagcaagactccatctcaaaaaaaaaaaaaaattagagtacaaagaagccatcaaccccacttcccgctaagagactacaaacgctgagtttcatttggaacttttgccccttggtttatggggcacaaaagatggcctggctcccttaagccttctttggcagtgaatgaatggtcctgctcatgactatcccagctcctacagccactgaccaagaggcagttcctgacagccatctggacttacacctcactccgtgactcacctattcataagtgtctcgggaactttcctccgagtgtgtgtggtatagtaacactcaagagaacataattccgagcatgtgtcataaactaactagaacaaattcctccctttaattaattactttatttatttatttatttatttatttttgagacagagtctcactctgtcacccgggctggagtgcagtggcacaatctcggctcactgcaacctccacctcccaggttcaagcgattctcctgcctcagcctcccgagtagttgggattacaggggcccaccaccacgcctggctaatttttgtatttttagtagagataggattttaccatgttggtcaggctggtctcaaatacctaacttcgtgatccacctgcctcagcctcccaaagtgctgggattacaggcatgagccaccgcacccagacaatgggacacttttttttttttttgagacggagtttcactctcgttgcccaggctggagtgcaatggcacgatctcggctcactgcaacctctacctcccaggttcaagcgattctcctgcctcagcctccctagtagctgggattataggcatgtgccaccatgcccagctaattttgtatttttagtagaggcggggtttctgcatgttggtcaggtcggtcttgaactcctgacctcaggtgatccgcccaccttggccccccaaagtgctgagattacaggcatgagccaccacgtccggccaatgggacacttttaagacagtctcaaaagaatctctaagattttggccagactcagtggctcacgcctgtaatccctacactttgggaggccaaggcgggtggatgacctgaggtcaggagttcaagaccagcctagcctacatgacgaaaccctgtctctactaaaaatacaaaaaattaactgggtgcagtggcgtgcgcctgtaatcccagctacctgggaggctgaggcaggagaatcacctcaactcgggaggcggaggttgcagtgagctgagatcgtgccactgcactccagcctgggcaacaagagcaaaactccgtctcaaaaaaaaaaaagaatctataggatttcatcaaaaattgatgtccctgtgacatcttctctcccaacaaattaagaaggcccctagacttctctagctaaactaagaggctctaaggaccaagcacgaatgacctctgaagttttcctttctcactttcctagctctcagcccaaatactagttatcaaatggtacctgggtaactttcggagatattttttgtttgtttgtttgtttgtttgtttttgagatggagtctcgctctgtcgcccaggctggagtgcagtggcgctatctcggctcactgcaagctccgcctcccgggttcacgccattctcctgcctcagcctcccgagtagctgggactacaacaggtgcctgccaccacacccggctaattttttgtattttagtagagacggggtttcaccgtgttagcccaggatggtctcaatctcctgaccttgtgatccacctgcctcggcctcccaaagtactgggattacaggcatgagccaccgcgcccggcttttttttttttttttttttaactttcagagatatttaaagcttctaaagcaagactcttgacactgctctaagatgaacttaatcatgatgcactattaaaaacaatgtctgggtgtggtccagctttgggtttataaacatgctatctatttttcttcatatttttataagtaattctgcatcattgctaaaccatgcaaacgagcttttcatgattcttaatgagcagcctctcaatcacagcacaagacatccttcatgataacaaatgtggaaggaacttgtttccatcttgaatacagatctttcttctgtcctaaggatagaaagtggaaaatcagagaaacataccttgtgtaatgtcccatttattcttctttctgaaagagagaaggtaggaactacattagatgcattctgaggtttccaattcggcaataccaaacaaatgttacaggctaaattgtgtcacccaaaatccatatgttgaagtcctaaccccagtacttcagagtgtgacattatttggagatacggcctttaaacagttgatcaagttaaaatgacatccttcagggtgggtcataatccaaccttactgctgtccttataagaagagatcaggacccaaactggacacaaagggaagaccatgtgaggacacagccagatggtggcaagccaaggagaggggcctcagcggaaaccaggcctacggacaccttgaccttccattccagcctccacaaccatcagaaaataaatttctgttgttcaagctgacgagcctctggtatattgttatagcagcctgtggtatcttgttatggcagcctggcaaactaatacaaaaaatgatttttaaatgttagagcaattttacaatcctagtgcatgatgcattttgtttgtttgtttgggtttttgttttttgttttgttttgttttgttttattgaaatagggtctcattctgttgcccaggctggagtgcagtggcatgatttcagctcactgcaacctctgcctccccagctcaggcgatcctcttgcctcaagcctcttgaggagctgggactacaggtatgtgccaccatgctcagctactttttaaattttttgtagcgatgaggtctcactatattgcccaggccaatctcaaactcctaaactcaagcgatcctcctgcctctgcctcccaaaatgctgggattacagaagtgagcccagccatgatgtgttttatctgccattttggctaacaatgttttgactcaacatctataatacaaatattttaagtaaaataacaccattactaattaatttgggttaagaaataatttttggtgtgaatgccattaagccaatttaaatttttagtccattttctatggagaacaatgaaaccattttcagctttttccattttaggttttattcagccgcagtaactgtcactgaatcaatttttatgaacatacatttcattacaaagatatgattcatcaatgaatgttttgcccaactataattatatcaattgtggccttttataatctttctgctgcagttagtatttatattatatggaaaaatttatcaaatttttcaggtcaaatttaacaggcaaaattttactctttggtcatttttttaaaataatagttgtattgagacataattccctaaccataaagtttatccttttaaagtgtacagctaactggttttaagtatatacaaaggtttatgcacccatcaccactatcaatttccaggatattttcttttttctttttttatttttttttgagacagagtcttgctctgttgcccaggttggaatgcaatggcgtgatctcggctcactgcaaccttcacccgctgggttcaagcgattctcctgcctcagcctccggagtagctgggattacaggcacgcaccagcactcctggctaatttttgtatttttagtagagatggggtttcaccatattggccaggctggtcttgaactcctgacctcaagtgatccaccctccttggactcccaaagtgctgggattacaggcgtgagccactgcacctggccaaattccagaacattttcatcattcttaaaacatacttcccatttctccttccatgtctcctggcctctggcaactaccaatctactctctatggactcacctattctgggcattgcacattcagtcatgtgttacttaacaacagggataccttcagagaaatgtgtcgccgggtggtttttgttgttgtgtgaacctcataggtgcatttatacaaacctagaaggaatagtctactgcatacctaggctattgtaacacaatggtaagtatttgtgtatctaaacatatctaaacatagaaaagatatagtgaaaatggccggacatggtggcttacgcctgtaatcccagcagcttgggaggccaaggcaggtggatcgcttgaggccaggagttcaagaccagcctggccaacatggcaaaaccccgtctctactaaaaatacaaaaattagctgggcatggtggcacacacctgtaatcccagctactcagggggctgaggcaggaaaattgcttgaacctgggggtcggaggttgcagtgagccaagattgcgtcactgcactccagcctgggtgacagagcaagaccgtcacaaaaaaaaaaaaaaagaatttttaaaatattgatagatggttgaaaaactcaaaagaggcataatatttttgtaattcatgaaaattatgtaaaattcaaattcactaactataaataaggttatattggaacatcaccacactcagccacacctactcatctaggtaccatctattactgctttctcactgcagtgacagagttaagtagttgtgacagaaatcatttgagccacagagcctaaaatatttactagctggttctttacagaaaaaggtctatcatacggctgaaccaattcatctttatctttcagatcatatggtatgatgggcactaactgtccaaatagttggcagaaagagcaaatggaagctacccaaagtatgggtctcaggctgttgccagttgaactgttaggatcataatgagataaatacaaaaattgagagtaagccttagaaagttatagaaaattgacaaagtaattttatgtctatttgaatataatacttgaaaaatgaggtttaggccaggcatggtggctcacgcttataattccagcactttgggaggctgagacgggaggatctcttgagctcaggatttcgagaccagcctggataacatagtctctaccaaaaatacaaaaaatgaaccaggtatgatggcatgtacctgtagtcccagctactcaggaggctgaagtgagagaatggcttgagcctgggaggcagaggttgcaatgagctgagatcacgccattgcactccagcctgggtgacagagcaatatcctgtagaaaaagaaagacagaaagaaagaaagaaagaaagaaagaaagaaagaaagaaagaaagaaagaaagaaagagagagagagagagagagagagagagagagagagagagaaagaaagaaagaaaggaaggaagggagagagaaagaaaaagaaaaagaaagaaagaaagaaaaagaaagaaaaagaaagggaaaagtgaagtttctattttgtatgtctttgggagtttttaaatttcatctttctagccattgatttttagactaattgaatttttaagactgaccctttaatacagtttgagacacactgaaatagaagatcagtatctttagaatcaaagaagtggatctactaggacatgagcatgctgagggcaggtgcttcatctgccttgtgcacctgtttccccagcacctggtacactataataggtgctcaataaacactggaagaatgtacagatccaaaacaactcacttcttaactctagtatcattgtcaaggattatcattttctaggtttgtttttgtttctaatttattttcagacgcaatagatagcatagaagctagcagcaagcctgtgttcatatcccagcttatttaattaattaattcatttattttcaagatggagtttcgctcttcctgcccaggctggagtgcaagggcacaatctcggctcactgcaacctctgcctcccaggttcaagcaattctcctcctcaacttcccaagtagctgggattacaggcgcctgccaccacacctggctaatttttgtatttttagtagagacagggttttaccatgttggccaagctcatctcgaactcctgacctcaggtgagccgcctgcctgggcctcccaaagtgctgggattacaggcatgaaccaccgtgcccggcctgagtcctagccttttaaaacagtccctccaggttaagatcaccagatattttagcaaattgtaagatatctatttgcatatgatttttcatgaattcataaagtagttcttgtaatttttttttttaaacggagcctagcacgcccaggctggagtacagtggtgccatcacagctcattgcaacctcgacctcctctgctcaagcgattctaccatctcagcctcccgagtagctgggactacagtgtgagccaccacacctgactaatttttgtattttttggagagatagggtttcaccttgttgcccagactggttttcaactcctgggctcaagtgatccacctgccttggcctcccaaattgctgggattacaggcatgagccaccatactcagcccataaatttgatcaatacagtccaaagacctaacttcaggtatataaagtacagctcatgagttgatgcaagtaatgtgcagaagtttccattctgacatcctgcacacagttccaccccaatcccaaacaacctttacaaaatacaaaattttttcagagtgaatctccctaagtctgtggtagccctttcttaggaaggtccccaggcattgtgagggtggcagaaatactgagtggctgtccgaggaatgaccctctttattcttacatactagcacaatattcagggttactgcaagacatagcagaaccagaaaatgtctgtgtctccatgaatcttgctgccttgttgcctggctgtgttcttccttgagcctggaataaatcttttttttttttttttttgagatgggagtctcgctctgtctcccaggctggagtgcaatggcactatttcggctcactgcaacctccgcctcccaggttcaagcgattctcctgcctcagcctcccaaatagctgggaccacaggtgcacaccaccatgtctggctaatttttgtgtttttagtagagatggggtttcgccatgttggccaggctagtctccaactcctggcctcaagggatccgcccacctcagcctcccaaagtgctgggattacaggcttgagccactgcaagcctggaataaaccttcccccagtctctgcctactgagaactagacatccttcaagaacatctatgtcttcacctcacttatttatttatagtgtcacagtcactaaagttccaggaagtcacagaatcatagctatgaatgctagaaggaaccatagagagtcgaatccagggactgcaaactcaaaggcctatagtagctgcacaggttatttgatagaaagaagactggcaggtgggggctggggagaagagcaaagaatagagccatttagagagggcagatactcagctcaagtgggctgttgccaactggtacatgtggcccaatatgccagatttgttttaatatattttttaagtcgactattcaggttttcatgagttaccactctttattttaattgtggtaaaatatacataacataaaaacttaccatctaaggatttttatgtgtccagctgagaagtgttaaatacactcacattgctgtgcaacaataattccccctcttccccgccatccctggcatccaccattccattttctgtttctgattttaactattctaggtacctcataaaaaataaatcaggtcaggcacaatggctcatgcctgtaatcctagcagtttgagaggccggggtgggaggaccacttgagccgaggggtttgagaccagcttgggcaacacagcagaccgcatctctacaaaaaaatatattaataataaattaaaattgggtgtggtgtcatgtgcctatagtcctaactgctttggaggctaaggcaggaggatgacttgaggccaggatatcaaaggacatcaaagctgctgcagtgagccataatcttatcacagcactccagaagaaaggaagtggaatcatacagaatttgtctttttatgactggcttatttcactctatgtaatgtcctcaagactcattcatgttgtagcatgtgtctgaatttccttttttttttttttttttgagacagggtctcactctgtcacccaggctggagtgcgctggcacaatctcaactcactgcagcctcgacttctggggttttgacaatcctcccacctcagcctcccaagtagctgggaccataggtatgctccatcactcctggctaattttcatatttttggtagagacggtgttttgccatgttgcctaggttggtctccaactcctgacctcaattgatccacctgcctcagcctcccaaagtgctggagttacaggcatgagccaccatgcccagcctccatctttttaaggctgaataatattttattgtatatatagtccacatttttttccattcatccatcaatagactcttggttgcttctacctttggctatgtgaatgatgctgctaccagcatgagtatacaaataatgtatcttttttttttattttgagacagagtttcactcttattgcccaagatggagtgcaatggcacgatcttggctcacagcaacctccgcctcccaggttcaagcgattctcctgcctcagtctcccaagtagctgggattataggcatgcgccaccacacctagctaattttgtatttttagtagagacggggtttctccatgttggtcaggctggtctcaaactcccaacctcaggtgatccactcacctcagcctcccaaagtgctaggattgcagaagtgagccaccatgcctggcgaagtatacaaataatatatcttttgagttcctgctttcaattcttttgggcgtatatccagaagtggaattgttggatcatgtggtgattctatttttacttttttttaggaaccaccatactgttttccatagcagctgcaccatttcacattaatactaacagtacacagcattccaatttttccacatcctcaccagcatttgttgttttttgttcttttgataatacccatcctagtgggtatgaggcagtagtatctcactgtggttttgatttgtatttctctaatgattagtgatgtcaagcatattttgatgtgcttgttggccattttttaaattagattgttttactattgttgagtccttttttaaatgacgaacactagtttaaattttataaaaacaaaaacaaacaaaaaatggccaggtgcagtggctcacacctgtaatcctagcacttcgggaggctgaagtgggcagattgtttgagttcaggagtttgagaccagcctgagtgacatgggaaaacctcatctctacaaaaaaatacaaaaattagccaatttagtggcatgcgcctgtagtcccagctactcaggaggctgaggtgggaggatcacttgagcccaggaggcagaggttgcagtgagcagagatcgtgctactgcactccagcctgggttacagagcaagaccctgtctcaaacaacaacaaaaaacaaactaacaaaaaaaccgccgtaacaccatatggataaaatacatgatttcaggcagtatacggccggagacctccatttggtgacctcatctaggcccaacaaactcatcttccaaacagggaaaccaaagcctagatcataaagccaacagttgcacatggctatctgatatctgagccagcattagatctgaggtcctctagtgcacaaggcattgacacatttcttagaacactcaccagagccaacgcgtctgatttgtaaggagttgcaatttgctaaaaattcgtaactgggcttaatgacttgtgggtgaaagtgcaaaagtcaggcaaggcgcagtggctcgtgcctgtagtcccagcactttgggaagttgagtgggtggatcacttgagctcaggagtttgagaccagcctaggcaacatgatgaaaccccatctctaccaaaaatacaaaaaattagctggacatgatggcacatgcccataatcacagctactcaggatactgaggcaagaggatcacttgagctcaggaggtcgaggcttcagtgagccaagctggcgccactgccctccagcctgggagacagagagagaccctgtctaaagaaaaaaaaaaaaagaaagaaagaaagaaggaaagaaagtgcaaaaggcagcagcacaagacagagtcaggaactttttgaaaggaactctctctggcagctgcttcaatcttctttctctagaggtagtaagagggggctggagatctattcattatcttttaacaatggacaaagagaagcctgtctgctgcgttagtcattgcttggaggtccccgacttctgcttccactactgctctctacccccaaagtgacttctctttgatgctatttataaaatggaatgtgaccctccagctaggcagggctgggggcatggggcgggggggacatgagtgagatattaaagccgtatttctgcttgggtctggtatgtggcttctcaagagtacatgaggcaatgagaaactggaatgattgttatttagggtatagctctctagggaggaaaactgagcaactttcttgagaaggaatagtgaacatgtgaaggtgtccaatttagaaaaggggatgggcttcctctttctgggaaagactcacccctgacttgtggattactaaggaatggagtatttctgcctccaacttgctgtgcatcctaaagtgagatcctgtacttccttctacctcaatttctctcttcataatattgaggaaaagttacataaatgcagggtttcctgccttgctgactgtggcacttaattacactaaatagacataagtcgcatatccgtgccacctgccttgactggtgtcttctgctcaactggccccttgaccaacttcagctgcctttggtagttcaagaattgagagtttgaggagacataagagcaactgtaataaactgagggacctcattcaaactcatttgttgctaaagaccatcttaaaatttctggtcacctggagcaaaccatcagccagcaactcccagatctgatcatatttgatgtcgctgtgagaagtgccactccccacttccatcatggctggaggctaggaatgtgcaggggaatgtctaaaggggtagttgatatttgaaactgcatttgggggatctgggccgggcgcggtagctcacgcctgtaatcccagcactttgggaggccgaggtgggtggatcacgaggtcaggagttcgagaccagcctggccaacatggtgaaaccccgtctctactaaaaatacaaaaattagctgggcgtagaggcgcgcgcctgtaatcccagatactcgggaggctgaggcaggagaatcgcttgaacccaggaggcggaggttgcagtgagccgagattgcgccattgcactccagcctagcgatggggcgagactgtgtctcaaaaaaaaaaaaaaaagaaaaagagaaagaaaatgcatttgggggatcctcagaaaaagctactaattacacctaacggctggcaaccagctgtgttatccacattctagggttgagtatcatgacacaccatagtttaagaccatctgggctgggcacagtgcctcacgcctgttctcccagcactttgggaggccaaggcagaaggatcacttgagtctaggagctggagaccagcctgggcaatgtagggagattccagctctataaaaaaataaaaacaaattagctgggcatagtggcttatgcctgtagtcccagctactcgagaggtcgagatgagtttgaagaccagcctgagcaacagagtgagatcaagatgggatcataggctgtacctgtcatcgcaccacagcactccagcctaggcaacagagcaagaccctgtttcaagaaaaaaacaagaccatttgaatgatgccttttataccagggctggaacttgggatgctcagttgtctacttctttaacctccaaattccatagtataaactcaggagagtaggtttaacaaatgtttgacataggcagtaaatggcccagggtggagcaccacttattgaagaagtgtgcccaggtttgtgagtgcattaatatacattgcctgataacattatacactatctggatttagccaaaaatgaggctttattataatctcctataatccccttttcagggcaaaggccatgtcttactcattttggtattcccagcacgtataatagtataaggcctggcccagagtagagcctctcaacccctgattaactcctaatcatcctgcagttcattcactcaagtttgaatgctgattgagtacatatgtgtgcaaggcagtgtcgtgggaactgggggacagcagcacaggacagcgaggtccctccctaaggtcacttgcagcctacaggaacttcacctcatgcaggaaggttccctttccccccatccctcctggatgcgccctgaagaccctgcacctatcccaaaaccacacttactatacagcactataattacctgtatggatttcattagtacagggctgtgaattattaatccttggaacctcagagtctagaacgaagcacagttctctgtagatgctactcaaatgctcattaatcactgaatccacacctcccttctggcttccaagacaggaaaaggaggctcagagcggaatatgcaatgctgctctcttggcttattccttgtgctaaccagctgcttcgtaactgcccgcttactaacctggttgccccactagagtgtaagttccccaagattgagggcggtaccttatttaccattgtatcccaacatgcagcacaagcaggcgctccataaatgtttgttagatcactgaataaacaagtgaattatgaataaaatgaaagaggcttagatataaaaatgatgcccagttatacttataatgatagagccctaaagagtaaaataagactattctgtttttgtttttgtttttgagacagggtcttgctctgcagccaggctggagtgcagtggcacaatcatgactcatttcagcctcaatctcctgggctcaggtgatcctctcgtctcagcctcctgagtagctgggactacagacgcgcactaccacgcccagcaaattaatttttttggtagagatgggatctcactgtgtagcccaggctggtcttgaactgccgggcttgatcctcctgcctgtgcctcccaaatgctgggattacagacatgagccaccaaacccagtctattctgatatttctaacctgttattggagacccattaggtttgcttcttacttagaacaaaacctaaccaaccaggcacgatggctcacacctgtaatcccagcactttgggaggccaaggcgggcagatcacctgaggtcgggagttcgagaccagcctgaccaacatggagaaaccccatctctactaaaaatgcaaaattagcctggcgtggtgatacatacctgtaatcccagctactccggaggctgaggcaggagaatcgcttgaacccgggaggcagaggttgcagtgagctgagatggcgccattgcactccagcctgggcaacaggagcaaaattccatctcagaaaaaacagacacacaaaacagcctaacccaagatagatagaaatctgtcaacagttgaactattatggtttctattatcggatcatgcaatgaaaacactttaacccttcttcacttaaccaactcactcaattaatataggtctctgtttcctctctaaaacacactgacctgtcaccagacacccactgaagggatgccgcgggaagggtcttgatttgcatgtctgagtgcttctgttcctatctgctgaactgtatgctttccagttccagtggagattgtgcccactcccattgatgtccattgttattatcattttacaatttaattaaatattacataagtgctgaaataggaatgcaaaacaagagttgttatttttgtaaaaattaagttgaatgttttggggaaagttgatagaataaatcattaaaaatattgtcatacaggtgcaagctaatcaactctaaaagtttagggcagaaaagcctactaagattctgccctcaaaaccagaaaatgtaactcggacacggtggctcatgcctgtaatcccagcactttgggaggtcaaggtgggcagatcacttgaggtcaggagttcaagaccggcctggccaacatggcaaaacaccatctctactaaaaatacaaaaattagctgggcatggtggtgggcacctttaatcctacctactcgggaggctgaagtgggagagtcacgtgaacctgagaggcagaggttgcagtgagctccagcctaggtgataaagtgagactcagtctcaaaaaaaaaaaaataaacaaataaaataaattttttaaaattaggaaatgtggataatattttatgaaaatagtttgtgcaaaaaaagacagagtagaacctgaatcagcaggtccgtcttgaaaggaaaagccttgaggtctaaaccaaaaatagacaaatgaatctatagtatatgctgtgaactgtataaaaatatttaaggcttataggtatcatatcatatcttttttttttttttttttttggtctcactctgtcacccaggctggagtgcagtggcacaatatcagctcactgcaacctccacatcctgtgcccaagtgatcctcccaccacagcctcccaagtagctgggactacaggcatgcaccaccatgcccagctaattgtatgtgtgtgtgtgtagagatgggggtttcaccatgttgttcaggctggtcttgaacttctggactaaaacaatcctccagcctggcctcccaaagtgctgcaattacaggcatgagccactgtgcccggcctgtcatatcattctttatgattataaacacttccagagtttttttcagtttactaatttactggttcctggtctatggatctggcagattttctactgtacattggattattcaaaagctctatctgaaaatggtatctctccaggaaggtccctgtaattccatcctcctggcccgctaccctactaattagagtgatatgggatggccatagctacgtttccatcttgccgttttctctaacgtcacgtcctgaataaggtaggagagtctaaccaactgtaaggcatttagatatccatcatcataatctttctaaaaggaaattttactttaacattatagtgaaaagaagaaactcttttctgaaacagaagccctctctggagagcttattttcagaatggtaaaatggggaactaactttagttaagtatcttctgagagcagatgctttcatatctaattttctgtaatctttgcaaacattctgtgagttcaaaatcactggccccattttatagatgaggaaactgagctccagggaggttaagcaaggtcacacacaggcagtaccagagaggtggcatgtgacccattgtgagccaatatacttcccaagtcaccaaattacatctgatgatttgccccaaatgtgacatcccagtttttttcagaagtaaagtagtatggtggctacgtattatgtttcttaagttccagctacttcaaagggattgcccttgtttcattattggaatgtgtccaaactgagcagctcccctgccctccttcgacactggctgaggatggatgcagaggctctataaaaagcccgaggatggatgcagaggctctataaaaagccctttgctacatgctatgctatgctatgctatgctatgctatgctatgctatgctatgctatgctatgctatgctatgctatgctatgctatgctatgctatgctccagttattctagaaattctccaggctatcccctacccctctactttcaactctgtctctttctctgtccctctttgtcctttctctctctgttatgggttagtttctccccaaaagatattgaaatcctgtgactatgaccttatttggaaataggtccttgcaaatgatcatgttaaaatgttaaaatgggtcctggccaggtatggtggctcatgcctataatcccagcaccttgggaggccgaggttgatggatcacttgaggtcaagagtttgagaccagcctggccaacatgatgaaacgccatctctactaaaaatacacaaattagccaggcacggtggcacacgcctgtaatcctagctactcgggaggctgaggtaagaggacagcttgagcctgggaagcagaggttgcagtgagccaagatcgcgccattgcactccagcctgggtgacagagtgagaccctgtttcaaagagatagacaagagggaagatgatgtcaggacacagggaaggaggatgccacctacaagccaaagataccagaagccaggatggaagcaaggaagggattctccctcacagcccttagaaggaaccaacctctgcagacacctcaattttgtactttttttttttttttggtgacggggtctcgctctattgcccaggctggagtgcactggtgcgatcttggctcactgcaacctccacctcctgggttcaagcgattctcctgcctcagcctcccgagtagctgggattacaggcatgcaccgccaggccctgctaattttttgtatttttaatagagacagggtttcaccatgttggccaggctggttttgaactcctgaactcaagtgatccgcccgcctcggcatcccaaagtgttaggattacaggcgtgagctaccgcgcccagccagggaagagcactttaatgaatttaatttccttgggaatccccaaatttaattgtgcccttatcagtaatgttcattttgttaatgtaaaagaaatatatacaccctgcagaaaatatagaaattagaggaactatgaagagtaaaaggccaggcgaggtggctcacacgtgcaatcccagaactttgggaggccaaggcaggcagatcatctgaggtcaggagttcaagaccagcctggccaacatggcaaaaccctgtctctactaaaaatacaaaaattagctaggtgtggtggcacacgcctataagcgcagttactcgggaagctgaagtaggagaatcgcttgaacccagggctcataggttgtagtgagctgggatcacaccactgtactccagcctgggctacagagtgagacttcatctcaaaaagaaataaaataaaataaaataaaataagagagtaaaatttaatgacagtaaatcaatcatgtagcgagaactattgtgaatattctggagtatttccttcttgtcttttcttctatgagcacacacacacacacacatacacacacataaattcatatactcagcaccctctgcagtgtctgaaacatctgtgtgctcaataaagttcaaagaataaatgaatgaagaaaattttatttttacacatagtcaaacttacgtacagtaggaaattcatttttaaaaatcttactcaacacattatgtgtatttttctatgtattatatagatttttaaggcattttttatgaaagcataagtgctatagaataatgctgacctaaacgaacatctagtacataaccctacatttgtatctctgaagattcccttagcctaaattctttttttttttttttttttttttttggtgagatggagatttactcttgttgcctaggctggagtgcaatggcacgatctcggctcacagcaacctcctcctcccaggttcaagtgattctcctgtctcagcctcccgagtagctgggattacaggcatatgctaccatgcccggctaattttgtatttttagtagagatgggatttcaccgtgttgcccaggctgatctcgaactcctgacctcaggtgatccgcccgcctctgcctcccaaagtgctgggattacaggcatgagccactgcgcccggccaacccttaggctaaattcttagccatgaaattaataggcgaaaaagaataaactatttaaggtccttggtgtcattcagcgttcacaaacgtcccgaattgaagtgatacttcacatgaaaacccaagcaagcctttgcaagctccctggcagcccataggcacagattctccatctgtggggtgatcctcttatatagactgtagctccattatcccctcagaccagggataaccctccttctccagcatctttaggtcatccctggaatgacctgagctggattaagctccagctcagctgccctggtcctccacaaaggctcaaaggagagatcgaacttttggtgttacattccatttatttatttatttatttatttatcaatcaatttatttttctttttgagatgaagtcttgctctgttgcccaggctggagtacaatagcgtgatctcagctcactgcaacctccgcctcccgggttcaaccgattgtcctgcctcagcctcccgagtagctaggactacaggcgctcaccaccacgcccaactaatctttgtatttttagtagaaatgaggtttcatcatgttggccaggctggtcttgaactcctgaccagtgatccacctgatcaggtgatccacctgcctcagcctcccaaagtgttaggattataggcataagccactgtgcccggccttgcattccatttaattctcacttcagcatgtctttaatatctttctactttctctagccctatctattccaaagaaattctgtgtcacgagctatttctttttttattagtttttttttcatattgtgtgcagtgtgagatggaatgtaagtgggtggctttgtccttccttgaaacataacttgtgccaaaaataacatcatttgaattgtgtgtctttggtaacaacatgacatatgccaccgcaagtacattcatccaatatgtgcatgttacagggctatgcactgcgaagtcttgtttgcttgttttttgagatgggagtttcactctgtcgcccaggctggagtacagtgtcgcgatctcggctcactgcaacctccacctcccgggttcacgccattctcctgcctcagcctccttagtagctgggactacaggcatccgccaccatgcctggctaatttttgtgtttttagtagagacagggtttcaccatattaaccaggctggtctcaaactcctgaccttgtggtctgcctgcctcggcctcccaaagtgctgggattacaggcatgagccaccgtgcccagcttgtttgttttttaataactaaaactctgcctttcagaattcagattcaccatataacatcttcacccaaatgttactcccctggaagcctttcctgaccatcttttttccatttgcaacgccctttcctcctatgcttaattcttttcatagcagttatcaccacctcatctactatatattttactcatttgtcttgctaactatttttctcacccactagaagcataaccatgacagagccattcattcattcattcactgtgtatgtagtgaacacctacaggtgcccaggaatgtgttaagcatgagagtacggctgctttccagcagcttacaattagaaataccaaacagctaaacaaagatcagagtgtaatcttttttttttttttttttttttttgacacagggtcttgttctgttgcccaggctggaatgcagtggcacaatctcggctcactgcagcttcaacctttcaagctcaagtgatcctcccacctcagcctcccaaatagatgggaccacagggatgcgtcactacacccggctaattgtttatttttagtagagaggaagtctcactatgttgcccaggatggtcttgaactcctgggctcaagggatccgcccaccttggcctcccaaagtgctgggattacaggtgtgagccactgcgcctggcctcagagtgtaatctttcaacactaaaataagtggggcaggacaagttaggtttccagaggaagagaagagctcagactgtctcaaatgagggtcaagctataggaagtaggtgagagttaaaggcaggtcagaacttgatggaggaatttgaggtagaaacatttggctcatcccataagcagggcagatttgtgagcaggagaatggcatgataaaaatgatttatttagattaagccacagtggctcacacctgtaatcccagcgctttggaaggccgaggcaagcagatcaatggaggccaggagtttgagaccagcctggccaacatgatgaaaacccatctctactaaaaatacacaaattagccgggtgtggtggcacgctcctgcaatcccagctacttagtaggttgaggcaggagaatcgcttgaacccgggaggtggaggttgcagtgagctgaaattgcaccactgcactctagcctgggcaacagagcaaaactctgtctcaaaaaaaaaacaaacaaacaaacaaaaaagagaatgggtgaaactctagttcgagagtcaatttggccctgggatggggagacactaaaggaaggtgataaataagaatggacaaagagggtggaagctagcactcagtcaaaacacattcacctcaaagcaggcaattctcaaaataagatgtttaagatcatcaaccattaaagagggcctcgttagtgggttacaggagactgagttttgctgcctgaattgggagagagggagtgagagatacaaaaaagcagagggtaaagtcagctcggttattctatgctaagttaaacccatttaaagagcccagatgaagaggaaaaaaaaaaaatgagaggaggggaaaaaatgagaatcgctattttagacaaatcccatatgggttatactcttaatttacttaagccagatggctaggctggggaccgactaatttattaccatcctgccattcagagccagagccttccttaggttcctaagcaactctgagggggaaatgtcagattgcatgaaatttcctgattaggtcacatgacccaagcacagcccactgaaatgattcgaatcctccaaatcgcatattccagatcacagctgtcagctcggccctctcctgcttatggcagatgcacgggccttcccctctttgcaggcagtatggtggcagttctaggaataagaaacaccaaaataaaggctgggggaggactgacaaaaaaaaactttagaatttggcatttcagattctccctttgtaccatgtacatcccaaaattttctataaaagaaggaaagtagcaaagtatttttaaaaggagcatttaaactactgtggcaattaagcagcaatctctgagtcagcaaatcccatccagcaaactgagtaacatttgagataacatgagaggattaaaaaagtagggacactagccgggtgcagcggctgaggctggtaatctcaccactttgagaggctgaggaaggaggattgcttgagcccaggagtttgagaccagcctgggcaatatggcaaaaccctatctctacaaaaaatacaaaaaattagctaggcattgtggtgtgcacctgtagtcctagctactcaggaggctgaggtagaaggatcatttgagcccaggacgttgaggctgcagtgagccaagatcacaccactgcactccagcctggccaacatagtgatacaccatctctactaaaactacaaaaattagctgggtgtggtggcagccgcctgtaatcccagctactcaggaggctgaggcaggaaaaccggttgaacccgggaggcagacgttgcagtgagccaagatcgtgccattgctctccagcctgggcagcaagagcaaaacatcttctcaacaaaaaattaaattaaaaaattgggaaaaaataagcagctaggctggtttatgatctgaagaggaaagcataatgatataacaaaagcaacaatgaacatgttttaagatggagtcattatgtaacaagccatgtagaaactattgttacccgcattttgtattatggatgagaaaactgaggatttctaaaagacttaagttaggtctcaccgctagtaagtaccactgttaggggccaattctattcattcgtcagagaataagaaaatgattggccagaaaggtgaagggcaggccgggcatggtggctcacacctgtaatcctagcactttgggaggctgaggttggtagatcacctgaggtcaggagttcaagaccagcctgatcaacatgatgaaaccccgtctctactaaaaatacaaaaattagccggacgtggtggtgggcacctgtaatcccagctactcaggaggctgaagcagaagaatcgcttgggcccgggaggcgaaggttgcagtgagtcaagatcacgccactgcactccagcctgggcaactctgtctcaaaaaaaaaaaaaaaaaaaaaaaaagcgaagggcagcaggctgcaaatgccaaaatgagagcataactagtggttcctggggcctgtctatgagcagaggtggctagaaagctaacagaacagtgactgccaaatgcggaatggagcatgtgccaaattcaacggggattgaatcctggaacagaaaaaggatattagtgaaatctgaataaagtctggggtttagttaatagtagtgtaccaatgttggcttcttggttgtgacaaatgtaccattgtcatgtgagatgtgggtaagggacacaggggaactctctgtactctcctgcaacttttctgtaaatctaaaattattctaaaattaaaagttttaaataaatttaaatgaaattaaaagtttatttttaaattatttaagagaagagagtattggtgacatgtttacaaatattcttcagaagagtaacattttaaatggcaatggcgagggtaacgctgcatttttgtagccagtcatatttcttggcagacaagatgactaatgacaatcacaaggactaacattactgaatgcctataatatttcagcttccgccctaaggatgttacatgcatgcccatagcatcttcaagattattttcccaatttacagatgagaaaagttcttagaatagtgcctggaatctggcaggtgctcaaaaattagatcttttttgtttttttaacagaggctaagaaatgtacccagcttttgaacaagagtcacaattcaagtccaaactctaaaaggtttttttttttccttgtgatggagtctcacctgtcacacaggctggagtgcaatgacatgatctcagctccctgcaacctctgcctcctgggttcaagcgattctccagcctcagcctcctgagtagctggaactacaggcgcccaccaccacgcccagctagcttttacatttatattttttagtagagatggggtttcaccaggttggccaggctggtctcaatctcctgacctcaagtgatccgcccacctcgtcctcccaaagtcctgggattacaagtgtgagccaccgcgcccagtcccttcaaggcttttaaatctcagccttgccacttactaactctatgaccttgggcaagtttcaaagccaaaacaaagctaactgatatcacagaatggattttaaaagtatgttgaaagttgcatagtatcaacctaaatttctaaacagacaaattatttatagaatatttcaaaattgtcaaattgaataactggaaaataatcaggctgtatcgttctgcattgaaatcaataaaaatagggctcaaaataacagttctgaagaatccttgggcacacctctggatgtaagaaccaaacaagagacaactaaggaaattgttaactcctggtaactaccagagcctcaaggaaaaacgtgttttcagctctcctctggggtcaaatgactatagctcactgggccagacaggatccatgatgagattttctcaagaggggaaggtggtaagggcaaattataaagatacaccttctggctgggtgcagtggctcacacctgtaatcccaacactttgggaggccaagggaggcagatcacttgaggtcaggagttcaaaaccagcctggccaacatggtgaaaccccatctctactaaacaatatataaatataaaaattagccaggcatggtggcatacgcctgtgatcccagctactcaggaggctgaggcgggagaatctcttgaacccgggaggcagaggttgcagtgagccgagatcatgccactgcactccagcctgcgcaacagaacatgactttgcctcaaaaagtaaaataaaataaagataggccttctgatgactgacgctcagtcatctcactgacgctcagtcatctctactaaaaaataaaaaataaaaaatctctcgtagttcatgagcatgatgattgtgttcacacgcatgtgtgaaacgtaccaccacaaatcttattacaacgttggtacattacctgcctggcatgaaaaaaaaaaaaaaagagtgagagagaaatccctgagtcacacctctgttcacacatctgttcattttaaactagatcttggcctcaactgttacagcaaaagggaggtcacagcagaaaaactaaagttttttttggcttccaggtaggcagaaatccagattcaaccaatataaagactattgagggagggtttcaagaactaacttcagaggcctaccacatcattaaccgtacccatccctgccaacctaggtacaaagatgggggtgctgaaatccaattcataccttgctgatacaaagctgcttagagcctgagaaggctgaagccctcttccaatacatctgcccagacctccagccattctaattaacataaaagcaagaaacatgcctcacccttccccatccccataccccactaaaatgtgacacccttgcacatcttgatccaaaatagattgcccaaacaataacaaaaccctaagcctagagtcacatatttattttttttaacaaatacttgttcagcccctgccaagaccagcttggtcggggagaccctaacccagcagcactagaggaattaaagacacatacacagaaatatagaggtgtaaagtgggaaatcaggggtctcacagccttcagagctgagagccccgaacagagatttacccacatatttattaacagcaaaccagtcattagcattgtttctatagatattcgattaactaaaagtatcccttatgggaaatgggattaactataagtatcccttatgggaaacgaagggacaggcctaattaaaggaataggttgggctagttaactgcagcaggagcatgtccttaaggcacagatcgcttgtgctattgtctgtggcttaagaatgcctttaagcagttttccgccctgggcgggccaggtattccttgccctcattctggtaaacccacaaccttccagcgcgggcattatggccatcatgaacatgtcacagtgctgcagagattttgtttatggccagttttggggccagtttatggccagattttggggggcttgtccccaacaagcccctactctgtgccctggcccattttcttctccctggatccctgggctgcctttaatctccctattccacccttgcttgccctgcaggtctccagttcataatctatttactgttccttctccagggccccaccttctggtgtgcagatccgccatcccttttctccagcatggattattgttctatactcctctctgccctaggctttacctctttcctcctggcttaatttcatcacccttaatctcttcactgttcagcccttcttgcagctctttcccagtctcctgccactaatgtctgatctcaaccaaccacacaacagcccctgaatacagcaaatggggctgaaagaacgtaattcatttgcctgtgctaatcccacaagcaagtggtcccattcaacaaattctgtaaatcagtaatggtaacaataatagctggcacttgaaattgagctgatggacaggttgcagttattagtaatgaagtctaaggattgactttgggtgtgagtggcatgaggcatggaagggtgcaaggccatttgaagaggggaagcctaagaacactaagactagataccatattgaaaaaaatcatctgtagggataaaacaatcatcaaggatgacagaaaccacgtgggtgagaggaagcttgaaggaatgagggcgtgtgtgggaaggaggaggcgttagaggacagcaacacggtggggtagagtttgatgatgtgacagtcggaggtggtagtgggagctacagagtgggagggaaaatggcctggacgcaggaacgagaacactcaccccatttgcaggcctgtggtctgaggagtgtgggagagaaaacggccatccacagcaaggggagcaatgtgctcaagagaaccaggtctagcaagcaggcaaagagagcattcagataagtgaggaagtgaggtttttgaaagaatacagctgaggtccctgtggaagagttgcagaagttggggagtgggccggtgcagtggctgacgcctgtaatgccagcactttgggaggccgaggaaggtggatcaaatgaggtcaggagttcgagaccagcctggccaacatagtgaaaccacgcctctactaaaaatgcaaaaattggacaggtgtggtggtgcgcacctgtagtcccagctactcgggagactgaagcaggagaatcatttgaacgtgggaggtggaggttgcagtgagctgagatcatgccactgcactctagcatgggtgagagagcaagactttgtctcaaaaaaataaaaattaaaaaagttttttttaaaaagaagttggagaagggtaagacatgggatcagaaaaggggatatccaaggccatgtggatatcagagtctaaaggatgagcgatgacctgggagactgggctgacataaacagggaggaacaggaatgacatgaggggattagtcccaggatcccagagcagattgcagtggcacagctgtgagtgcggggggcaggatagtaagggttgtcaggaacatgaggagttcttgcccactgcaaattaataatctgttgggggagccccatatacatgacagaaccatacatcccagatgcctttgaaaattgcagatatggaaacctacaggagagcgacccaaatccaacagggagggtcataaaaaacttcgagggagagagagagaataacggaattccataaaatgattgcaaccactagaaaaaaaaattttttttttttgagatggagtctcactctgtctcccaggctggagtgcagtggcatgatcttggctcactgcaacctccacctcccggtttcaagcgattctcctgcttcagcctcccaagtagctgggactgcaggcatgtgccactaaacctggctaattttttttgtatttgtagtagagacagggtttcaccatattggccaggctgctcttggactcctgacctcgtgatccaccggcctcggcctcccaaagtgctgagatttcaggcgtgagccaccacgcccagctggaaaataattgagatgcttctcctatggcaatgagtctttgtataaatgaaccataagttgaaaaaagttgtataatattttatattcacattatttgaatagtctttggtcttgccagagtgaaatgtattgcatttggctagagaactttgcaagatttacacagcacaaggtgagtatattacctttaatgtaagttgtaaaattctaaatagatgtaggttagagattttctaagattctaattctttccctatccctttattacctgaaatctctgaaattacctccagtatttggggtgatggctagagatagaaaattaaattgatggaaccttccctgactcccttatctaaattagctaaactacctttatgtcaaaatgtgttgattgcctgaatgtatctcatataatcctcataacaaccagcaaggtaataatttctattttataaacaagaaatctaatgttcagagagccaagataagttgctcccacagctaatgaacagctgaagagggactcatgattgtctgctaactgccctttcctgtagaccataatgcaatcacattttcagcgttgttaaaatgcaaaaaaaaaaaaaaaaaaaaaaaaagctattgtgttgtccacgctagatggtaattcgcttacctcttctagtagtttcaagggcgaatactagttgattagaccttgaagccttttatacggtcattgataacataaaacaaattaaaatagaatatggaagaatccccctagggaattcttaagattacaagctagttttccaagaagaaattggcttgtgtttagtagaagcaatagattagagacagactgatagacttggacagccagacagtccaaatgggaccactcattatatcataaccagacaggtagtgttgaaagcgggctcaatctacagagcatcctcatttcatttcattttattttgaggcagagtctcactctgtcacccagactggaatgcagtggtgcagtcatggctcactgcagcctcaacctcctgggctcaagcgatcctcccaccacagcctcccaagtagctggccctcatttttaaaaacagacaaaaaaggcatctgtcaacccacatagatggactactattcaaatgtagagcatttactcatcttaaatctgtggctggttgcagtggctcacacctgtaatcccagcacatagggaggctgtggcaggaagatcgcccaggagttcaagaccaacctgagcaacaaagtgagacaccaactctatagaacataaaaaaatcagccaggcatggtagtacactcctgcagtcccagctactcaggaggctgaggtgggaggattgctttggcccatgaagtcgaggctgcagtgagtggtgattataccactgcacttctagggcaacactttctcaaaaagtgagaccctggccaggcgcggtggctcacgcctgtaatcccagcactttgggagaccgaggtgggcggatcacgaggtcgggagattgagaccatcctggctaacatggtgaaaccccgtctctactaaaaatacagaaaaattagccgggcatggtggcgggcatctgtagtcccagctactggggaggctgaggcaggagaatggcgtgaaccgggaggcagagcttgcagtgagccgaatcgtgccactgcactccagcctgggcgacagagtaagactccatctcaaaaaaaaaaaaaaaaaaaaaagtgagaccctttctcaaaaaaaagagaaaaaaggaaaagaaaagaaaaagaaatggatttagattcaggatcagaatcctgggtttaccattattagctgtgcaaccttgggttacttaaccttgggttcctcattaccttacctataaattgggtataatattggcactcacctcacaggggtgctgtaagaattaaatggattaatgtttgtaaagttcttagcataggcctggctcatagtaaacctttcataaatgttcactattataattatccctggttcttagacttttttttttcttttttcttgagacaggctcttgctatgttgcccaggctggtcttaaatgcctgggctcaagcaatactcctgcctctcggcctcccaatgtgctgggattacaggtttgagccacctcacctagctggttcttagactttcaaacttccaaaatcagtgtttaaaagaagaattaggagatcaatatgggtttgtcttctttgcttttttgttttttttagcttttcccaaatcaaaacagtttttaaaagccagtattttctataataaccaatatttcatagaaaaaaataatattttaataacacaaaatttaggcagaagataatgtcaaaataaatgacttctattattacatttagctttgagagaaacttaaaattttttgttttagagacggggtctcattctgtcatccagggtggagtgcagtggtacaatcctagctcactgcagccttgaactccagggctcaagcgatcccctagcgtcagcctcccacgtcgcagggactagaggccgtgccactacacgtggtaatgagagacattttttatgttatacatatttttctcagttctccttggaatagtaagcatattttttgttcactgtatttgaggacgacttagtcatattttccaacacccttacatgtatagtttttactaattagtagttaaatgtttttaacttttaaaaaactaatcatagactatagacagtagtgtttgtaaactgtgaatgaaagaccaggatcataaggtcagttactggctttgcacattgcaaatagacaaaaaaagaaatatttttctgtaagacactggaaaaaaataaaagtggagttaaaacctattctttggacaagaaacttggcattcctacttttactgtgatagaggagtccctaaaaacagttgaagtgaagatgaaattcccaagcacccatgtgccaactcatttgtggaagagcaaagaatctaattaactcgaagcaagacctgaaaggggacagaatgctcaggaaaaccacatgaactgtccaaactattgattgagcaatttgcaatcatttctagtttaaaaacaaatagtttgggtaaatgaatgaatattcctattgcattattgctattgcattacttcttgcaaagttttccaaggaatttcctagttgtcaggcatatatatatacacatgcccagccttttttttttgttgggggagggggttcctagccactagaccatcagggaggaatcttaagaattattattttagaagactagcagtcacttttctttcttttactagttatacatctagcaaggccatattagttacaagcacacataaagttatataccaggatcttggaatattcattttaccaaaaaaagtcagtaaagtcagttgtgctgctacagttttcgtattttccacagattccaatgagccaacacaagttctactaataaaatccacacaaaataaaatgcagtcagtggaaacactatatgtacattgtagtcatttatactaagactgttgaatacaatactccagagtaaaatgatctcaataacagctatgaggcttctttttttttttaagagatggagtttccctacgtttcctaagttggacttgaactcctggactcaagagatctgcctgacatggcctcccaaaatgctgggattacaggcatgagccattgtgctgggcctgtgaggctatttttaaagtctgaatcttaatgtctaggttggatgatattaaatccccatttactcattcattagctcttctgagagagatttttctctcttagaaccagttttcttttttctttttttgagacggagtctcactctgtcgcccaggctggagtgcagtggcgcgatcttggctcactgcaacctctacctcctgggttcaagcaattctctgcctcagcctcatgagtagctgagattactggcacccaccaccatgcctggctaatttttgtatttttagtaaagacagggtttcatcatattggccaggctggtctcaaactcctgacctcaagtgatctgcctgcctcggcctcccaaagtgctgggattacaggtgtaaaccaccgtgcccggactgattctatatattcctgattgtgttgttgataacaacaataatagcagctactacatattgggtatttcctatgtttcaggcaattatttcagtgctttatgttaattttttacaataaccctacaaaatagacagtgtttgcaaatctccactttacaaatgagcaaacagaaactgaaaggttaaataactagctaaaggccacacagtaagtagtgaagctgggtttcagaccctgaactgtctataactcctgaacctgaattctaccctacggcctacatgcttatggaatctctaaatggctctatggacattcgaaagaagaactcatcaaagtgctctctcctttttactaacttctattataataaacatattactaacatttactagaacaattataaatttttaaatcttaagagttttaggtctcaaagggacctttgaggtatttaatcaatgcccacaattctacaaataaggaactgagctatctcaagttcaactgagctacaactaaaacaccaacgattctcttaaaaatgttagacaatggctgggtgcggtggctcatgcttgtaatcccagcactttgggaggccgaggcaggcggatcatgaggtcaggagatcgagactatcctggctaacacggtgaaaccccatctctactaaaaatacaaaaaattagccaggcgtggtggcgggtgcctgtagtcccagctagttgggaggctgaggcaggagaatggggtgaacccgggaggcagagcttgcagtgagccgagatggtgccactgcactccagcctgggcgacagagattccatcttaaaaaaaaaaaaaaaaagttacacaatatagacctcattgtatgtatacatgttgttgatgataactacagtttgaaattaaatgaccatgtactaggaagatggtatcagcctagccaaggatttgacacaaaagactggaatgttttcaaaccttacttagtaactttgttgctggactacaaggccaaaagcaagtggctgcttggacactggctattcagctctcctttaatctttcttaaaatatcaaagatatgtttattttaaagatgtcttcagtggatgcatttttatttaaaaacctggtcatccaaaactgaatttacttttcccctaaagcaaaagcaaaacctttctagaagtaattgaaaataaaagcattgcctaaaaaacaaacactattcaaaaatcaagattatacaataaggccattggctaaaaataacagagacagaaagttcagcttgtggttttttacattgtttattttttatcctcctatccttaataggatcagtttttttccatgaacagtttattgatcatttggtaagtttgttttttttaaataaaagaccattttttccactgtaaaatgagaaaataaaattttcctcagaagaaaaaatgtacaacttcattaataacctgagtgataacagattaaaatgagataccatgttataaacaatgaaattgactgagatcaaagactccccccaccccaccccaattcgcaatgttggtcatggtgtgagaaaacaagcttatatggtgttttgataatattaagaaataaactaaggcagtctttctagaggtcatttagcaaaatcccttaaaaagtgcatttttggctgggtgcagtggctcacacctgtaatcccagcactttgggaggctgaggtggatagatcacctgaggtcaggagttcgagaccagcctggccaacaaggtgaaaccctgtctctactgaaaatacaaaaattagccttagccaggtgtggtggcacgtgcctctaatctcagctactccggaggccgaggcaggagaatcgcttgaacccaggaaatggaggttgcaatgagccgagatcactgcactccagcctgggtgacagagtgaaattccatctcaaaggaaaaaaaaaagtgcattttttggacatagcaatttcacttctacgaatgtaaactacaaaaacaattaagctttatgtgcaaaggcttacctataatgatattaataacagggttatttgtaataagatggaaggaaggaaggttagagggggagggagagaataaaggaaatcagaatttccatcaataggaattggttaaataaacaaatgtggtacagtgcatgcatcaaaagcagtattatttttccattgaaagtgatgctgtggataaatattattgaaatgggaactgttcacataggttactagatttaaaaaacagattacaaaactctatgtaactgtatgtttctatttatatgaaggtcaagatcaggcaaagccaatctgcagtgatagaaatctaaacaatggtgcagggaaactgggtagagcagaggctgatttggaaagaagtaaaggaactttctggagtgatggaaatgctctaagatgatattcttgccatatggcttgtgggggggtgggaagcacagagtaggtggacatttgtcagaattcatcaaaatggtcagttagcatctatatatttcatttcatgtgagtgatacctcaattttaataagaaacaaaatcctcaaatgtacaacatgatcttaagtttataataaaaacaacggtttctatttgtacagacagaaaaggatttggagactgtcttagtccattctgtgctactataacagaatatcacagactgggtaatttacaataaacagaaatgtattggctcacagttctgccagtatctggcaaagacctttttgctgcatcataacacagcaaaaggcatcacatggcagaaaagtgatagagaacgggtgtggggagagagagggagaatgagcaagacagcaagaggagaccaaactcatccttttataagggacccactcatgcaataatgtaataatggctttaatctgtttgtgatggatccacccccatgactaaattcctccattaggccccatcaccatcaagtttctaacccgtggactttggggaacacatttaaactatagcagaaaggatttagaggtagtgggattatgggcatttttaaactcttttttttccccacttgtctcaacaaatgttgtaataatttaatcataacaattaaacacaaaatgcaaatgtatccaaatgtgtttcagtgagcctctcttgctcttaatctgaatatttcctaacaccgcattaaagggtactgtgaagattacccagtgcatcaccgacttgcttgaaattccttggaaggataccaatggcgtcccaccccttgtggaggtctttcaccataggcacttccggccatttgttttactctttcaaacagctcaaaatgccaaaattaaatcaagaattttatcatttggaggcatgcttgaagtagattttatttctggtgcccaaacccctctcaggtccagagtaaaaagcttcaaattcctgaaggtaatgcaaatactttatgggctgagaagtagctgtttctttgcatgtgtcctgccaagcttctaagaatggttttgccattagttccaaacccacaagcagcctggtctgagctccaccacctccagcaggcttattacagataagtcagctggtcttcatgtgacagagaagccttctgtgccaggtgtgctcacagccaagactgggtgtctgccacctcatgctgatggcagctcatgttcacatgcagcccacagatctcagcacaggctgctgggtggttaacgatgcaggcacaattacctcctgacaataatagtgcaaacaactatgggcagttggttgaaggatgggagagaggaggaatagtaaaaagcagatgaaacgtcattacacttctctaaactcctgcaggatgcagcccagcatcgtggctcacatctgttataccagcactttggggggccaaggtgggcggatcacttgaggtcagaagtttgagaccagcctgggcaacatggcaaaaccccatctctactaaaaatacaaaaattagccagtcatggtggcgtgggcctgtaatcccagctactcgggaggctgaggtggaagaatagtttgaacccgggaggcagaggttgcagtgagccaagatcgtgccactgcactccagcctaggtgacagagcgagacttcatctcaaaataataataataataataataataataataataataataataaactcctgcaggatggatacaaattgagaactgaagtaggtgggaataagtgagaactgaaatctagttttcccttgggatatagccaaagaaactaatggatgaacagtgccaaaagaaactcacctccaacaacctggcctggatctggtgcagagaggaagacatatgtccacggatctgtatctctagtctactggatagctagacaaaaacgtcccacagggccatcacaattacctggtctaacatccctgaactgaactcaacatcccttccttgcctccaacctgctatgtcttttgcaaagacgtataacaaccagtgtataacacaggctgctgggtgtataataaccagtgacccctttacaagagcgagaacttagaagccctttagacctcctccttcttcatcttccacatatgattagttccagttcctagttaggacactatcatcctaatatctttctgactagcccttccttcttgttgtgctgccaactgtcacaaaatctaatttccacctcactgcctgaatgatctgtctacactgcaaatctgatcatgcctctggcctatgccagtctttccacagttctccattatctacctagcatattcttgagaagatctcaaatgccttcactaccaggcactcaaatgtgtgaagccatggggtttaatatggccaagaaggaagttgtatggacctggagaagatctgtcctacctgaagttattcaaatcaaaaattattttaaaacagctgcactggcctgggaaaactttctgaggtcactttgatactcttggtctacaatagagtcaaattccttagcctgtgatgtagctgaagcctgcttctctagcttgtcttcacctattttcaattaagcagcctgcattttcctgaaggttctctttcacacagtgatgcctttgaacatgatcttttctgcttgggtccgtctccttctttccccatcttgcctagaaacttatgtcaagacctcatctgccagcctttgtggagccccgggaagagttataccctggacatgcatctgttattgttgttctttccaagcttgcaaatatttattttccttctctgcaagtagtacttagggggcctgtcttataatggcacaaattgtatgttacaaaataaacggcaaaggctagagacagttttcctccccaacattttaaataagattgagaaattattgtttacatcacaaaatgtcatttaaaaaaaattcagagtgtcctttaggagctaatagagattttatgaggacctccaaatgtgccctgtgtccctagctagccttcatcaataaacctgtattgaatgtgatagtacaacaatcctaggccagaaaaactgcttcaggccttgatcaggttcccaaaatattagaggtgatattaatcattatcataaaattttagttgttcagaaaaaaaaaagaaaaaagaaatggtcacatgctccagtgcatttttaaaaatcacttaaagaaataaaagagaactcaactccactcccacaactgggtcacaagctccattggctaaggtagttgagttcccagccacatgaaatagttctatttctcagaacttgtccaaaagacctctcctgcctgcagagatagaagtaaggaaaagagaatctttcctacgcctttaagtttgacctgcctcatttttttttcccctccctttctgtccattgatttaggccatcaaggaactgtagaagtagaataggaagtgggaaagggaagagatagtgaaggatgaaggggtgggccaatcgtggggggctttcaagggatctatgtctatagtggctgaggttaaatgaagttaaccacaaagctagagtcacctcaccacttcctactttgtagactaataggctgagctctggtttaacttaaacttgagtggtctggagtgaactcattcgttctacaccagttcctcacagaatattatatattttttatcattattattgagattttacgtgtttttattctttccttttttttttttttttttctgagacagggtcttgctcaggtgccgggactagagtgtagtggcgtgatcatggcacactgtagccctgacctcccagggtcaagcagtcctccagcctcagcctcccaagcagttgggactataagtgcacaccacaacacccagctaattttttttttttgaagagatggggttttgccatgttacccaggctggtttcgaactcctgagttcaaataatctgcctgccttggcctcccaaagtgctgggattactggcgcaagccaccacgcctgactgtttttattcttattaaccaatctgaaagcaatttacttaatgtctggctgaacacacacacacacagacgatattctaatacaaatgaacatgcacatgacatgattttgagaaatacaggaaagcataaggaaaaaaatctatagttaacccaaaaataaaaattattaactattttgtcaattctgctattaagatctttatatagttgggactgtattgtattcacaacttttttttttttttttttttttgagacagaatctcactcactctgtcactcaggctggagtgcagtggcacaaccaggctcactgcctcctgggttcaagggatcctcccacgtcagcctccagagtagctgggactacaggcatatgccaccatgcccacataatttttgtatgtttttttagagatgggttttgggtttggccacgttgctccaggtgatacaacctttaatacttagaaatctaactttgtaacaagctcttgccttgcttttagaaactatgtaagcattgttatttatagctacatagaactccttgaagtgtatatattgtaatttatataaccatttttcttttttcttttctttttttttttttttttgagacagagtcttgctctgtcgcccaggctggagtgcagtggcatgatcttggctcactgcaaggtccgcctcctgggttcatgccattctcctgcctcagcctcctgagtagctgggaccacaggcgcccgccaccatgcccggctaattttttatatttttagtagagacggggtttcaccatgttagccaggatggtctcaatctcctgaccttgtgatccgcctgcctcggcctcccaaagtgctgggattacaggcgtaagccaccatgcccggcctacttatatgaccatttttctactactaggcatttagtttttaactaaacatattttggaataataatatggatttcgaccttttaaaagctctcactaccagcaatgagaaaataagacctctttaaagaaggtataggcagcagtagtttaaaagtattttagtcattggtttccttcagccaagaaaaacaggtacaatatcactgaattatggacaaaagcaggaaataccctgaaattttcccaagaataatatatttcttaaacacatgctgatgtgaaggttggacttgttctaggaaggctttaggaaagaaaggagtcttgaataggagaataaatatacaagaggtggtataaagacatgatgttgggggtaagagaaaaaacatggcaaatgtcgtgaggtgaagaactcaggctcttaacgtggtgcctggcagagttcctctgccatcattgcctttgatggtgactggattctggtaagcttaccacaaatccttaaattctaggcagaacacttgcttaaacaaagaatttaaacaaccatttgctaacggtaatctcctgcctactctaagtgtcttttcaccaaatcgttcctctttttctatgctatttagactttgccagcattagagtgggcagccagatgttatttcacagaattcacacggctggaatcgctgctgtgagaattcttttaaagggatgtagaacttatagtcttcctaaagccccatgtccctgaacttttgtagcaatctggggaagatagaatgctgcattattatattacatttgattttcatttaaatcaattcttttcttagaaagttatctaaaaattttgattcattctacgttttgcccaatatgtttcccattatttatcacagtgtgtcttcacaacaccctgagagatgggtaggccagatgttgctacttccattttcttcaaagagaagaaaaccgatgaagagactgaaggcattgccaccagaacccaggtgtctcatctttttggcccagggtgtgttcctctgacacattaaactgtcaccgtggctttgacagatggcattggcagagagtccgtagagacatgggttgtgtctctgctattggatatctcagggaagttttatacttcagtttttcaaacctgccataaaccctgagtatttctttaagcacatatcaaagtagtctatcttaaagtacctccaagtttttaccagatttggattttttaatttttaatttatttcattttatctgacacagagtctcactctgtcacccaggctggagtgcagtggcaccatctcggctcactgcaaacttcgcctcctgggttcaagcaattcttctgcctcagcctcccaagtagctgggactacaggcgcgtgcctccacacccacgtaatttttgtatttttttttagtagatacggggtttcgccacgtcggccaggctggtctcaaaatcctgacctcaggtgatccacccgcctcagcctcccaaagtgctgggattagaggcgtcacccactgcgcttggcctttttttttttttttgagacagaatcttgctctgtcacccagtggcatgatgttggctcactgcagcctcctgggttcaagaaattctcctgcctcagtgccccaaatagctgggactacaggcatgcgccaccacgcccgactaattttttgtatttttagtagagacggtgtttcaccgtgttagccaggatggtctcaatctcctgacctcgtgatccaccctcctcggcctcccaaagtgctgggattacagacgtgagccaccgcacccaaccagaacaatgcttctttaaaaatgactaaaaatacaaagggctggatgtggtggctcatacctgtaatcccagcactttgggaggccaagacaggaggactgcttgagcccaggagtttgataccagcctgggcaacatgacaaaaccctgtttctacaaaaaatacaaaaattagccaggcatgatggtgtgggtctgtaatcccagttacttgggaggcttaggtgggaggatggatagagcccacgaggttgagactgcagtgagctgtgatcacactactgtactccagcctgggcaacagagtgagaccctatctcaaaaaatataaataaatgaataaataaataaaaatttaaaaaaattatatagataattttttcaagctgagccttatataaaatgcatttctgtatgtaggtctccctttgtaaataatatgacttttctataaacctataatataaaagactcttggagaacatacaacagaaaaaggacatgtccactctatatcatacttgaaagtattattgattttctttttaagatagaaaggaaaagtcatattaaaagctacttttggctgggcactgtggctcacgcctataatcccaacactttgggaggccgaggcgggcggatcatgaggtcaagagattgagaccatcctggccaatatggtgaaacgtcatctctactaaaaacacaaaaattagctgggcgtggtggcgcacacctgctactcgggaggctgaggcgggagaatcgcttgaacccaggagacagaggttgcagtgagccaagattgcgccattgcactccagcctggtgacaaagcgagacccggtttcaaaaaaaaaaaaaaaagctactttcacttgggatgtgtgtgtgcacacatgtgttattgttgtcgaagagcagtttccaagaaccctcaactagcctatgaacgtggctgcaagttgacacttgacaatactcagttcaagactatacctgatactgccgcactcccttatattatttcctgttttcccaaaagatagcaagtgtcttgaggttaataactgtctttatttctgttatgtccctcatagtgtttcccatcatatctgtgttgaaatgaacattcatgtgatgttccaggagacccagtcccactaacttatccagtctttgaaataaattgctcttattctctgaactgtaaaattgaatgttaatattactattttttggaatatcttgactctacaataatctacatttgtatgatatggttgcaagcattactatcatgtgaaaaagaatagtttttttgtgcttattccctaaaaattttgaagctttggatataattttatcaatatagtaagtctgtgtgcgcgcgctctctctctctctctctggctcactcccaccttctcttgccttccctcaccctccctccctttccttacctctctccctcacctctccctctctcctacctctcttcctttctccctctctccttcacctctccctctctcctacctctcttcctttctccctctctccttctctccctgtctttccctctccctctccttcctctctccctctcttcttctgtccccttctccttctccttctgccataaaatgaaaaataaaaaaagtagtgaataagagtaagtaaataatagaaaagcaagagcccatcaccccctgaatctcttgtagattgtttttaaggtatgaggaaacctcttaggtttctaggtttctcttaatttctcccattagaattcaactgaccagcattaacattaaaacagagatcttgagactgacaaaacagactcttctagtagaagataccaaatctcaacctgactgtatatactgactgtagtatagcatcacatgacaaatagcaaggccttaaagaaatccaagtattttaccccaaaatacatttctttgacatattttggaatggccctgcaaagctgtctcttgtggggaaaatctacattctgtagaaaatctcctttcctttccaaatcttttcttcatccaggagagattatctgtccccctaaaatgtataaaatcaagctgcaaccaaccaccttgggtacctgttctcaggacctcttgaggctgtcttaagccttagtcactcatatttggctcagaataaacctcttcaaatatgttacagtgtttgaatcttttcattgacaatttcaaaaggttcatgatctttcagaggccccttatttatttatttatttatttatttatttatttatttaatttttactgaaaaagcatctggccatgttgcccaggctggtctcaaacttctgggttcaagtgatcctcccccatcagcttcccaaagtgctggcattacaggtgtgagccactgtgcccagactaaaactattttttaacatcatttattaatgaatttatttttgagacagggtcacactctgtcacccaggctggagtgcagtggcacaattacagctcactgcagcctcgacttcccaggctcaagagatcctcctgcctcagcctcccaattagctgagactataggcacatgacaccatgtcaagctaattttttgtatttttttgtagagatggggtttcaccatgttgtcccacctggtcttgaattcctgggctcaaacaatacactccacctgcctggcctcccaagtgttggagttacaggggtgagccactgtgcccagccctcagagaccccttttgagggatttctgctggtagtaacctacagcattttttatttttattttattttattttattttttgagaccaagtcttgctctgtcacccaggctggggtgcagtggtatgatcttggatcttggcttactgcaacctccacttctcgagttcaagcaattctcattcctcagcctcccgagcagctgggactacagttgtctgccaccacacctgactaatttttgtatttttagtagagaaggtgtttcaccatgttggtcagactggtctcgaattcctgacctcaagtgatccgcccacctcggcttcccaaagtgctggaattacaggcgtgagccactgtgcctggtgatagtattttttaaaactacaaaaaaacaatgtacatatgtttcagaaaatcctcaaattgtgtttttcttctgctctgacacaacagtcataaatacagaagacttctgtgaccaaatattggggcttctcctcaccaccaattctgcagtagataccagctgggtgtcctcgaattcaattctggggttatctacccagagatactgtgagatcccacagttgagggctcagcccctaaggctggaccccatcccccaccagtcacaaggtcaggcctctggaacttctgactgaccagcttcaagttggggtttccatgaccctctctttgggttcgattaatttgctgggggcagatcacagaattcagggaaacacttacgtttactggtttattatgaaggatattagaaaggatacagacaaagagatgccgggagcagtgcccagggaaggagcacagagcttccgcgccctctctgggtacaccaccctctaagaacctccctgtgttcagctatctggaagctctctgaacccagtgtgtttacggaatcttcatagtgttagcattccttcccccagggtatggggcggaaccctctctggaatgagggtcttaggaatcacaatcggaaaggtggagaaagattacagtcctaccttggagcaggtgaaaggagggagaagttcaaagagtttctgtttcctgaggttggccaggcccaacatagcaacaaaatgactgtaacataatctaggatttttttttatacctgccagtgaagatgttcctttcagttttggggggtttttgttgttgttgttcttgttgttgttgtttgtttgtttttttgagacggagtctccctctgtcacccaggctggagtgcagtggcacgatctcggctcactgcaacctccacctcctgggttcaggcaattctcctgcctcagcctcccgagtagctgggattacaggcgcccgccaccaggcccagctaatttttgtatttttagtagagatgggtttcaccgtgttggccaggttgatctggaactcctgacctcaggtgatccacccgcctctgcctcccagagtgctgggattacaggcgtgaaccactgcgcgtggctgtcctttcagcttttagatagaagggagaaagaggtcaactcagatatccagaaccaaactaatgaagttatattgttcttttctatttctgatcaaatacgtttctaaacagccattccaggctctaatataacaagtataacacaacttgtattctagcagtgtggggattcatgtccatgtctacaaaacattcttcctctccccaattttcctaatggcttacaacttaatattttaaacacttatagaaaatttcaaaaaatgcaaaaaaataaaaaataaaaataatgcaaccatatctcaactatgacaataatcaactaatggccaatctagcttccttcacactcctactcattttccttgcccccaacaacctagatttttctccatcatagtactgcagctgcaaatatttttgtacatatgcttaaaagataaggactccttttttgaacatcatcacactgccccaaaagcaacaatagatgcttaatatcatcacatattcagtgttcacattccctaattgtccttataaatgtcctcttaaaaatctttgcttgcctattgggaaaaattagtcatattaaaaaattgtttgaaagtttgttgtttggggctgggtgtggtggctcacacctgtaatcccagcactttgggaggctgaggcaggagaatcacttgaacctgggaggcagaggttgcggtgagccgagatcatgccattgcactccagcctgggtaacacagtgagactctgtctcaaaaaaaaaaaggtgtgtttgaatctgcatcaaaacaaggtcccaggtgggcatagtggctcacacctgtaatcccagaactttgggaggctgaggcaggaggaccactagagcccaggagtttgagaccagcttgggcaacatggcgaaaccccatctctaccaaaaatacaaaaattagccaggcatgctggtgcatgcctgtagtcccagctacctggaggctgagatggaaggatcgcttgagcctgggaggcaaaggttgcagtgaggcatgatcaagactattgctccatccagcctgggcaacagagtgagaccctgtctcaaaaacaaacacacaagggcagggtgtagtggctcacgcttgtaatctcaacactttgggaggccgaggtgggtggatcacctgaggtcaggagttcgagaccagcctggccaacatggtgaaacccccatctctactaaaaaaaataaaaaataaattagccaggcatggtggtgggcacctgtaatcccagctactcaggaggctgaggcaggagaatcgcttgaacccaggagctggaggttgcagagagctgagatcgcaccattgcactccagcctgggcaacaagagtgaaactccgtctcagacaaacaaacaaacaaacaaacctccaaaaaaccaatgtcaatttattgtgataattaacatgtctcttatgggcaacattgtccttttttagcctttgccctcaaataaaaaaattgttatgtagcaaaaacaaccatttccagatgatgcaagagttcaaaatgctggcctgaagaagtctatgaaaatgtcaagtcatgcctttgcgaggagataactacttggcatatacctttccctgaatgataaagaaggaaagaaaaaatgtacttccagtaaacatattcattagccacagagagctgcatataaacatgatgcttggaaaacaaatgctctgcagtaaatgggaattgagaaaataggtaataagttgcaaatctgaaaatcatttctttatttcaatgtaaggtaagtttataaacagtcagaccaaaaggtctgcttttaaagttttgcaaatgctggtcagattgattagtccttttttgaatttttttttttttttttgagacggagtctcgctctgtcgcccaggctggagtgcagttttttaatcctaaagctttttaatttaaggctttttaattttcagtttgcttactccattcttttgtaaaagaaaaaaatcactttagattaaatgaaattgtaattaaggcttctacttccatttctcaccttacgagcttatcttctggatcccccacttaaaaaacaaagttcccttttcatttaaaaattaaagaaactcctgggttagtacttaacacaaacaaactaataattaccatgtaatagaagcaacaggacaagctcacagtaatattacaatgcaggaggtaaaaacttgggcaacatagaaagaaggctccgtttcttagtctgtaaatggggacaataaatagctgcctcataaggctgatgctgggatcagtcaaatgagatcatgcaaagcacccagcactggctaacactcaataaaaaaatagccattatgatcattaggaagatataggaagagacttttgtcattgtcacagtttaatcttgaaaaggaacttactgtatggtagcattctgagtcagttacaagagaaagtaacaagtgacctgcattgctgaggatcctgcctcctccaagctaccctgctacattgttaaaacaccctgggggagaaaagtatcctattcagccaatgttaaactgtttccttttctgaaagttagaaatagatgaaaatagcataagaaataactctgtatatagtaagttctgggtaagacaatattgtggtaagtgaactaaacaaagattaatctgaaattggactctgatccccaagtgaaccagccagtgtagcccagtccttactggacctgaggaggaaaaacaagcctgtgtctatctcaagcgtgatctggctagatatgatctaaactttgaaaagtgcctaagcatgtttcagatgcatattatgtgttaaatactaagcagggagctctgagctggggcagtgcaccctgatgctgaggaactgacataggaaaatgaacacctagcattgtaatttggccttttgctatttatttatttatttatttatttattttgagacggagtctctctctgtggcccaggttagagtgcagtggtgcaatctcggctcactgcaacctccggctcctggttcgagcgattctcctgcttcagcctcctcagtacctgggattccaggcacacgcccccacgcccagctgatttttgtatttttagtagagatggggtttcaccatgttggccaggctggtctcgaactcctgacctgaggtgatccacctgcctcggcctcccaaattgctgagattacaggcatgagccaccacgcccagcctattctctcattttagtcagacaagttttcttttctgttagatctctccccaataattgcaaaaaccaaccaaataaataagtatgggagagaggtggttatttatattatgaaagcattcttcagtttaattcattgcagaatctaagatcctttcctccacagtgttaaaatccatagccctctcaattactcttccacgctttgaggaaaaggaagacagggaggagagatctccaatggaaatttccttgttaataacatcttatgtttctctaaatgttttacagtttcaaagcactttcagactcactctggtatgttagttaagccttgtgcaagataccataaatcatattatactcaattaagaggtgagaaaagacaaggctcagaggtgaagcaaatataaatagtagtaattagttttatatatatatataactaatatatataacattcatatatatatatatatatatatagagagagagagagagagagagagagagagagagagagagagggcgcaattggtacatgtgagacctgaagccaagatttttaaactaagtccagtggccaagaagctgaagcaagtagctcacactcactgccttggtgttgctgtttttcctcccttccgtgatttggttctaagcatcttcccttttttttctcagttaattctgattcatgacttccctcatgtaattaataaatgggaaagacttgagtgaacaaatattcagccaactagtatttattgagcaacaactagaaaccagaactttgaagggttttaaacaaaggaaatggaatctctttgtcatttaaaaggccacaataaaacaaataaaagtaaaaaataaaaaagaccatagtgaggagggtgcagtggctcacgcctgtaatcccagcacgttgggaggctgaggtgggcagatcgcctgagctcaggagttcgagaccagcctgggcaacatggtgaaactccacctctactaaaaaaatccacaaattaaccaggcatggtggcatgcaactgtggtggttacaggtactcaggaggctgaggccggagaatcccttgagcctgggaaatggaggctgcagtgagctgaaacagcaccattgcactctagcctgtgcaaccaagccaggattaataactttattgatgtgaaccaattatccaaaaataataatcacatattagccatagcggactccccagctagatgttttctgcctgtgtttgtaaatcctggacatagttaaatttcaagtgccttcaataagaaatcaatggcttggaaaacatctctgcgcagtcttgataagatttctaattgtggtgaagcctcattccttaaattatttattcaacactaacccattctacaaacttacatctgctgggctctgggagtaacaagatgagttagatgcagcagtcccaaatctaaaggaggttggagactagaaagaccagtgcctgctctgagctctccagtggtccccagcctctcagtcaggcctcacaggcccctctgccagaggcggaaccagcttgcctccgctctgcagccacactggccttttctttcatttctgagaactctcctcactccctcccactttgggctctgcagaaatcccagttccctttgccttgaaagctcttggtcaatttagctcctcctccttcagccctcagctcctgccttgctgccccaataatctttttctgactgcagatctggtcaaatctttgtctgaaaccttagagcccattacatttgtagttttacgtgtacacgtgtgatcatttaatatttgacggtgtgctctcaggtgcctacgctcctggagaggcaggggctgactggttttgttagatgccagtgcctgacacacaataggccctcaaggggtgaaaaaccaaccaaccaagtcaggacccaagcaacctgggcctctgtggaagggcagaatggcctgagtttgggtttctcgagctaccttaagatcaggcctcctggctcctatcttagcccttctaacactctgaagtgtagaggttgtttgttccaagtccccaaggtactgtaagctcccagatagcagaaatcccattatattttagtgctgtggccccagcatccagctgcgctgttacttagcatgagatccacatgaaaaccatttcgcaactattagccattgccagtattaatactttccggaaggtggcacaaagtgggggatgttatagacagcttcaaagaaacgtttaagctagagttgactctttaaataatacaagccatccccaaccaaagattaaaaatttaaatacaaaaaaaaaaaaaggaaatttgcctaccccccatttgtgaaaacaaagaaaaaaaaaacagttaacgtcttaacttttctaggccttcactctcgcctctccccgcgctacaagggcgaattctggacgtatctacacagtcaccgcggagtctgcaatcgccgcgacgtcccctggcatttcttggccaggctgcaactttggtgacggtgtatgtagttacatcccctgtagtgcagctggtatttagggtcctcattggcaaagttgagggtataagcagggagggaggggaccttggcttctttccattcactggcatgttttcggggcacggtcatcccacgctgggctccagcgccagtcccaaggcc

SEQ ID NO: 304 - DNA, 25324 bp, Homo sapiens
  source 1..25324: mol_type = genomic DNA
ggtcgccgcggtgctgctgctcagtgggagcgggtcttcgcaactgtctccgcgtggcgcgcgcctctagccgcccttcccctggcggctacggccggagggagcggaggcgagcgggagtcgggctccatggagagcggcggacaactgggcagaggcggagctttcatctcggcaccctggttccagtgacccgcgctagcgtcccgtcccgcccgcgtcggagcggccgccggccccgggactgaccggcctcgccgcacctcccgcaccgactagcgctcccgggcgctcctgcgcccgactcgccctcgcccccactccccggcggggtggcggcggccgggcccccacggcggcggccggagcagcagcagcagcagcaggagcccgcctctatgatgaagttcaagcccaaccagacgcggacctacgaccgcgagggcttcaagaagcgggcggcgtgcctgtgcttccggagcgagcaggaggacgaggtagggcgcccggcgccgcacgctgccctccggggcgccggggtctagggcccgggtgcttcccctcgctccccgcccctgcgcaggctgcggggctgggagggattagcccccttcctccctccctcctttcctccctcactcctttcctccctcacttcttccttcctttctctgggctgatagatgagacaaagggggctcgcccagccccagtttctccatctgggcactcgagaaggcgcctggtccccgggaaggtcccgggccgcgtaagtctcgcctagcgggagtcaccatcttaacgtgcgaattgagttgaaagccggataaacctcgagtgctcagcgagaggagggtggaaatggcgtgagtgttgcagcagagcccttgtgcctcttttacatattttccttccatgttacagccgtttgcggtctcggattcgatctaagcatgtttgtggagtaacagacagtcctcgtgcttggaattgagtctagtcttggcaattcttgtgggtccatgaacccgcaagctgttggcataattatgcctcatttttaaaacggccttcccttcttaaagttttctgactgcagaaaaatggttagtgaaaaatgtggaataatgccaaaagggagacgatggactagagatgggcaaagctgccattttcagacagtaatctccagctctcagcttatgtataaagggttctttgctgtctggcttgacatctggaaaggagtagcctttctcgttctcagagcagtcgttcttggataatttacccatctgcattgggctgagaatgagacccttggggtttccctggagagcgatttttacttaattcagtagtatttatttaaaatggctaactgttgaagtttgcttagggcaatagtagccttttggtattgccactcttaagataaattacataggtgaaaaaaattaacattctgagttctgctttcataaccaaccgtgtataaaatactaggctaaggctggagatgggaatttaatggcttccttactgctagtccctgtagttgtgatgaatatgacacagaatacactcagtggcttagttcttgttatgttaacgaaaagttctcgaaatttgcccttcaaacccttgttttgcctttatttttttttgaaaagaaaccaagccctttaaatgggttgctctgtgctcactcataacctttacgtattagacttgaatcccaaacgagtgtgcagagaaatacggccccagcctttgagatgggtctgcttaggagagctagaaactgcaaagggaaaggttattaacttttacaaaatgaacaagtcaacaagcattaagtgtgttctgtaaaaaagataaagccttagcggaaaggggccatgttgaggcaaagtagtaaactttaaatataaaagaaatgatagccaaaagggatcaagatagatcaaggatcttgtctggtttcctcaatattgtgtaatgatattcttaattgagtgcttacaatgtgccaggcgctgccagaagaaaacttgttatacatttaatccttttaacactgggaggtagtgaagttactcccattttataggtgaggagacagttgcagagcataagtaccttcccaaatgacacaattaggaagtggtagagtcaggattcagggtccagtccttactcctgatgttgggctctgtttgttgagtgagtgagatttttgtgaggctaagtttggaagcctatctgaaagtggtgactgaagtgttgccataatgtgaacttggaattcaggctttgtaaaaatactagactctaggggaaaatatgagtgatggaaattgaaatgatgatctctattgtgcttatggtaaagcaaagactgatagaagctttaggaattactttagcaataaaaataaatgattatttttatgcttggatattatttctactgaaataaatactaaattcatagcctctagttgagtcaagagacccgtgtcattaggtaaggtgaagtagggagcaagttttggagaatgtattagaaaaatccattgtataaaactttgtaaatctgataacctgtaggttgagaattgaagagagtgagtcatcttgttagaggatatgatctgagggaagactctagaattctccttaagtgaaatgcacagccaattttaacatctggtttagctcttcagaattttcatttctgtgattgtgtgtagttgaggctttatctattacatgattattacagaataaactctgttagctttcctggagattctattgtttctctatgaatttgccttcactctgttgaaattgcattgccagacttcccaggacagtctagaaaaccagcttgagcccacctctctagttaataggtgagaaatgtttccctctactggatgaaaaacacctagatcctggttagaagatttaaatgtatgttttgtttgaggatgaaatgtttatatagagtacaaatggaagtaaaagagtaattgcaatttgaccccaaaaaagctacgtggcgctcccatctggctgttcctgtactgaagttctcagtaagtttctactttaaaacagattgttctaggaaagaaggttgttctaagagcagagttattcttttaaggtggctttatatattaaatattttccattttatctttttctgttctgtagggtaaataagtattagtatttgtttaggaagaaattaggtagcagaagtaacctatcccaaggtcacagaagctggcagatccttttgagctctggtcctttgtttctaaatgttttgtttatttgacctacctccccagctagttatttctgtggggaagcaccctcagttttggccgctgggcttctagacaggcccacagctaattgccctgtagagtagctgggtactgtgcttgtacagtgaaagatgacaatgcttttacaaataggtaatcagaaatggattctgttgaatgtatttgcatatatgatagtttaaaaggggatgaagagatgaggtcttagctcctaagaatcattctgtagggaaaggttggacaagggatcaatggaaagggaaataaagtaagggaaaagtgcggtcgggtattctggggttcagatccaatgtgagtcatttggagttggatgtgggtgactgggagaggagggaccaggcgtcccaaatagagcaagacttggggctgtgatagatttggctgcagcttagggatagcatagaatcagtaatagttgaaaaatttgcaacacttcaaatgtaaggttgagaagttgctacgcaagaacaaagttttgttttgaacttagttttgaacaaagaacattgagatagtagatgtgttcaagcttgagagtgatctggcagcaaaataggtttagactgctaaggggagaagtagaatgacttgatcctgtgtgaaatccagacatagttgcaagagaggcattaacaaatcagtctgaaggactaaccactacaggccaggcaggtggctcatgcctgtcatcccagcactttgggaggcggaggtgggcagatcacctgaagtcaagtgtttgagaccagcctggccaacatggcgaaaccctgtctctaccaaaaatacaaaatacaaaaagcagccgggcgtggtggcatgtgcctgtaatcccagctactcaggaggctgaggcatgagaatcccttgaacctgggaggtggaggctgcagtgagccgagatcatgccattgcactccagcctgggcaacagagcaagaccctgcctgcaaaaaaaaaaaaaaaaacaacaaaaaaaaccactactcttccataggacttgctgccctaattagcttttaagctctatgagccaggggctgtcttctacagatggtctgctataatgctgaatatatattcctgaaaaatcttgagctgtacaaaatcatgcagtaaagctttggtgggaaaggtcaagtctgaaaacctaaaaccagagctccgatgagcaacaatactaattcaaaatattactagagttaaatctcaactagcatttttatacttagaatcaacagtcagtccacccttttcacacatactctggggctcatagttcttcagagttaagtccttgaaggtatttctttcaaatggagaccactttcatcaaaaataagtactatccaaaggtagccttttttttttttttttttttgagacagagtctcgctctgtcctccaggctggagtgcagtggcgcgatgtcagcttactgcaagctccgccttccaggttcacgccattctcaagtagctgggactacaggcagccgccaccatacctggctaattttttgtatttttagtagagaaggggtttcactgtgttagccaggatggtcttgatctcctgaccttgtgatttacccacctcagcctcccaaagtgctgggattacaggcatgagccactgcacccggcttggaagccttttttaaacacagggaagtgtcaccaacttcttcatctgtgcctccagctctcccagaaggtttcccgtcattaaaccaggcattaacgtagaatttgcattggattttttttttttttcttagggtcttggtatagctcaagcttttctctaattgaaaaaaagcttataccccgtcactttaaaacattgacctgctaggtaaaaaatccatggtcaacctgatttacaacattattgataatacttatctaccaatcccatataagttggagctaaacatagtttagaagaaagaactgttatttctggtctactctgcctctggtccaaaaagaagtactaattttcttaatagtaggtagctgtttagcatgtatcaaaccattttcataacctatgttcttttaaaatgtctatgtgcatagtgggtgtttctaataacacggctggcctaattttggctaaattttggttaagtgtagtagaattaggttaacgtagtttcaaccattcatgataccctgatttatgataatttggaaagaaagaatagcaacctcgaaacagtttctgagtaggccaggtgcagtggctcacgcctgtaatcccagccctttgggaggccaaggtgggtggatcacctgaggtcaggggttcaagaccagcctgggcaacatggcaaaacctcgtctctactaaaaatacaataattagccaggcgtggtggtgtgtgcctgtagtgctggctactccggaggctgaggtaggagaatcccttgaacccaggaggcggggctttcagtgagctgagattgcgccactgcactccagcctgggcgacagagcgagacagcgtctcagaaacagcaacaacaacaaacagtttctgaatagctacaattttcataataaacctcttcattcttaggggtcacttgaggttctctggatggctcctccgctccccttcccgggaacagaagtggtatctatagtggttggagttcctagagccaagccatgacaattgcatctttaagggtaaaagctgaaacacaaatgggaattcgaggcccaaggacctacagcctctgaaggcataaatgcattacatagcccttgaacagcacccttttatacatcaccagcgaggaggacccgtcaggtgataaagggtatagattctataaaatagatcaggggtgcccaagcttttttttttttctcgctctgtcaccaggctggagtgcagtggtgcaatctcagctcactgcaaactctgcctcctggattcaagcgattctcctgcctcagcctcccgagtagctgagactacaggcgtgtgctaccacgcccagctaattttttgtatttttagtagagacggcgtttcactatgttggccaggatggtcttgatctcctgacctcgtgatctgcccacctcagcctctcaaagtgctgggattacaggcgtgagccaccgtgcctggcctggggtgtccgatcttttagcttcactgggcctcattggaagaattgtcttgggccacacataaaatacactaacattaatgatagctggtaagctaaaaaagtaataattgcaaaaatattttataatattttaagaaagtttacaaatttgtgtttggctgcattcaaaaccatcttggactgcatgcagtccacgggccacaggttgagcaggcttgcaatagatcattctaattcatagacttttatccaataagatttagggttggtttcctgttgactactgtcaatacactattcttttttttttaagagtctcactctgtcacccaggctggagtgcagaggcgtgacctcagctcactgcaacctccgcctcccaggttcaagccattctcctgcctcagccttccaagtagctgggattacaggcacatgccatcacgcctggctaatttttgtatttttagttgaattttgtatttaaattttagttaagttttgtatttttagtcaccatgttggccaagctggtctcttactcctgacctcggcctcccaaagtgctgggattacaggcgtgagccaccatggccggccaatacactattcttaaagtgataaatgcttttctccaaatgcttaaaaccttaggtatctaggaaaagacaaaataactcttcagcagtgccaggtgagtggtgtttttttctggtaattatctaatacatgggaagagggagtaagatttagtagagtagtaggaagaaagaatgcttatgcgaagataggttgaatagagtaggaagagatgtcttcacttttcaccacactaatagcgttggctttggggtctgagtgtgctccaggtctggctctgcaacctggtagaatgagtagcctccttttcgtaaatctttcatatagtcacagctctgatttatctggaaggttgaatgcatcttccttcatctctgtcatcgctaatgtaacagaccagtatcttgatggatacagaaaatctagtctactcagagaagggaatttcaaacctatgaatgaccatgtgtggctctgtcaactgttggtgtgtctttgtagaatgagcttttataacccatctttagagcattaattagcatgctaactatactagtagctttgggggtgtgatagaaatgtgtagatggctgttgtgtgcgtttagagtgagtgttgaagaataatgcattgtgatagggttctagagattgagattcttccacttttgtaggaggggcttaggagcagctgcctattatttgaaatcaatattattgcaagaaaagcaaccattatggttatgttgctatgattcagcaaatggcgcccccaaaacaagccaaaaaaaaaccttacaataaattgtgctgaaatttgattttagatttctgcatgtatagattttatatatatatatatagtaaatctttttatatatatatatatatatatatatatatacataattttttttttctttttgagatagaatctcacttctgttagccaggctggagtgcagtggcacaatcatggctcactgcagccttgacttcccaggctcagatgattctcccacctcagccccccgagtagcttggactacaggtacatgccaccatgcctggctaatttattgagttttttgtagagacagggtcttcctatgttgcctaggctggtcttgagctcctagactcagtccgcctgccttggcttcccaaagcaccgggattacgggtgtgagccattgtgcctggcctatagaagatattaatagttcaggctgggcacagtggctcacacctgtaatctcagcactttgggaggccgaggtgggtggatcatttgaggtcaggagttcaaaaccagcctggccaacatggtgaaactcagtctccactaaaaatacaaaaaaaatgagccgagcatggtggtgtgtacctgtaatcccagctactcaggaggcttacgcacgagaattgcttgaacccaggaggcaaaggttgcagtgagccgagatcacgccattgcactccaacctgggtgacagagtgagaccctgtttcaaaaaaaaaaaagaagctattaatagttgagttttcccacagagttttagtagaaaagatataatgaagctgaaaaatgtgagtatgtaactagtaaaaacacggactgctcagaactagtatctccaaaatttatgtaagaaacaaaatttccattattgactatactagatattttcatcattctcaaatttttgtggaacacttaaaatttgtattagcagatatgtcaaatcttttgtctaggttggaaaactcttaactggaagaacatagctaaatctttgataatgaaagtacaccttcttattaattttggcctctggaaaacaatactgaatgaactctgatttttttttattattattatttttgagacagtctcactgtgttgcccaggctggaatgcagttgcgctatctcagctcactgcaaaccgcctcctggattcaagtgattctcctgcctcagcctcccgagtagctgggattacaggcgtgcaccaccatgcccagctactttttatgtttttggtagagatgaggtttcaccatgttggccaggctggtcttgaactcctgacctcaagtgatcctcctgcctcggcctcccaaagtgctgggattacaggtatgagccactgcacccggctagactgttttatttgcatgctctttacaaaacgtgttttttcaagctgaattgctttagtagttccataaaaatgtagtccagaaaaatctacattgatgattttcattttcaacagattccaagtgaattcaacagaaaagctgtaattcttgagttcctgatagttctggagtgacagtactccactacggtgcaactcctcaccaccatccccagtttctcttttataatctcaggctttttaacttggtgaaatgtttttctggaaagagaaatggtcatatagcactgaacaatagagcaggtgtggcggttcttaggaaacactgagttatgttttcatcttaatctcaaccccttgcctaaaaagttgttagtgtcctctgttgtctgcctaattaaaatataaacatgctccaatgtgataccaactttttttcatctgtactggtctagatctagtgctggggaccgcttccaagtgcatgacagaccccaggtgatcacaggatggcctagctatcacactagttggccttaagttaaaagacttttcactgttattggggttgggggcaggcaggggactgttttaattgtccttctctctactaatgctgttcatatttttccaccctggcagacatacgccatcatccagtctattctcttatctggagtgtatccctcagttcttgctcactcttagtcactgccttctccccaccaccacccccccagatgtggccttgccctcatttgaacactcaaatgaactattcaagatgagtaggcaagtacttaatgaaacagacagactttcaaatctgtcaccatgacatctgtgtgagacctcttttcataagctagttgtttagatggccagtcatttctatatcacagatattaagtacccatttaaagcgatcattttatggaaagataatttgaagttattggtctgaccaaatttattcttcctgagatgtcaagggactcttggatgataagttactggattaggctaaatcgtttgtccacaatttataatgatatagatttatatagatgtatgtgttcttgcagtttttagacacaaaatattgagcattctatgtgactgtattccaaccccacctccaagaatataagctctttgagggaaagatgtatattcagtatcttttcatcacatacaattcttgttgagtatcacacaattagtagataaggaacaaaatcagcaacttctttctccacagtgcttctctttaaggtggagaacttgtgctgaattgtcactttttgacaggagtcagtctgttctctgtccttctagaggctgaagattgtaaagacaaaagtgaatggatttagtttggataccatgtgcatgatgcttctttcctgctagcccattttcatgattctgattttctttcgaaaagcattttaaagtggtaaggttttgcatgaaaatttaagtggataaataactaacagttacatattttacctgttctgaaaaggatataccattaattggctgtagatgtccaatatgtgacccttgagatgagcacttgaaatatgactggactaaggaattgaattttaaattttatttaatcttaaatttagccatatgatgctagtggtgactgtgttagctgtagaccctcaaaagcatgaaaggttcaaaagtagcagagtttaggacagactggaattaattggcagatcaagggcccagaggagcccaattctatctgcaggtttgtcaatttagatgagtagacaagtgcttaatgaaacatgctggattttaaaactaccatcaccaaaagttggatattagcacatctgccttaagctagtagtttagatgtgaatcatttctggaccatagataattactcatttaaatttatcggccttttttttgaaagatacatttggctgggtgtggtggctcatgcctgtaatcccagcagtttgagaggctgaggcgggcagatcacctgaggtctggagttcaagaccagcctgaccagcatggagaaaccccgtctctactaaaaatacaaaattagctgggcgtggtggcgcatgtctgtaatcccagctacttgggaggctgaggcaggagaatcgcttgaaccggggaggcggaggttgcagtgagccgagattcttatatcataaattactggattgtgctaaatcacttatcaaatttatatactattttcatgaggctttctaaaaagtaatttatgaaagagagatgttgagacacaagggttccatattactcatttttggaagaaaagtttagtcatgctgatgtcttgtagatgcaggattggttttaaatctgaagcatagaccgggcgcggtggctgacacctgtaaccccagcactttgggaggccgaggcaggtggatcacgaggtcaggagttcaagaccagcctggccaagatggtgaaaccccatctctactaaaagtaccaaaatgagctgggcatggtggtgggagcctgtaatcccagctactcgggaggctgagggagggaattgcttgaaccaaggaggcggaggttgcagtgagccgagattgcaccactagactcaagtctgaatgacagagcgagactctgtctcaaaaaaaaaaaaatctgaagcataaaatgtttcttcagaaaagcagacacatcttatactaatggtttttcaacattattaatctcctgtaatttagctctgtcttggagaactggaaacatcatagtcaatgacctagatacatgagactttgcatttcatttattcaggactgcaacattttgaatatggatgattttgaactccctatttactatttactaagtgatgatgtacttttcaggcggctagccacctgcgttatgtcccattattaacgtaatccaggaagttgcttagagagcatagaattgtgtaacaagaatttcatctaggcaatagaaaccagtttattcctaacccaaacctagtgaccagaaaaagaggcctgtaactctgcagtccggaccagtagttgctgtttacttttccagtgatgcgagacaaactcttaacatttttatttaacttaaaaactaacattcacttgccagtcttgatagagggccagtgcctttggttgccatagatcctctgtaagcctccaattttgaataaaatacaaaggttttgaaatctgatttgtagtttctctgttgaaagtagaatttgaacttagagacccttgcatgcacttttggatttttaattttctttttctaattttctataaagtctcatctgggtataatttgataatgtaataaccccccctccctttttttgagacagtctcattctgtcgcccaggctggagtgcagtggcatgatcacagctcactgtaacctcgacctcctgggctcaggtgatcccttccaccacagcctcctgagtagctggtattatgggcacatgtcaccatgcatggctgatttctgtatttttttgtagagggagttttgctgtgttgcccaggctgttctcacacctgcccgccttggcctcccaaagtgctgggatgggattacaggcgtgagccaccatgcctggcctggaatgctgcttttctaagaggaggttctatgcctaaatagatactctcttttaactcagcattttgggggcttgagagaagggtgggagttgctgaattgtcagcttgaaactttccagtttggaaaagttcctggtaacttagtcaaatgagagaggactcctgtgctggctgagaactcttaaaggccagcagctcctggcagcagggagggagcagggcagatagaagtgctggcatgcatttaaaagaaaaaaaaatcagtcatggctcttgcctgtaatcccagttgggaggccaaggtgagaagatcacttgagcccatggttttgagacctgtctaggcaacatggcaagaccccacctctacaaaataatacgaaaatcagactgggcatggtggcttactcctgtaatcccagcactttgggaggccaaggcaggcagatcacttgaagtcaggagtttgagatcagtctggccaacgtggcgaaaccccatctctactcaaaatacaaaaattagctggtcttggtgggaggtgcctgtaatcccagctactttggaggctgaggtgggagaatcacttgaacccgggaggcagaggttgctgtgagccaagaccatgccactgccctccagcctggatgataggacgagactccatttcaaaaaaaaaaaaaagtacaaaaattagccaggcctggtggtgggtgcctgtactcccaactgctcgggaagctggagtgagaggatcacttgagcccgggaagtgaaggctgcagtcagcagagattgtgtcactgcactccaacgtggatgtccaagtgagaccctgtcttagttatcatcatcatctctatgcacactgggaattaaacttcgtgataaaccctatgtgttttcgagggagaactgtttaaatttacttgaaggtagtatactaagataattttgtggacacttttgttcaaattgacttatttatttttattttttatttttttgagacagagtctcactccattgcccaggctgaagtgcagtggtgcagtctcggctcactgcaaccttcgcttcctgaattcaagcaattcttgtgcctcagcctcctgagtagctgggactacaggaatgtgctaccacacccagctaatttttgtatttttagtagagatagggtttcaccatgttggccaggttggtcttgaacccctgacctcagatgtccacccacttcagcctcccaaagtgctgggattataggcatgagccaccacgctcaccttgagttgattttaacttaagtgaagttcaacctaagctagcccacaaatattcctttgtttcccccccccccttttttttttcctttttttgagacagaatctagctctgttgcccaggctggagtgtagtggcatgatctcggctcactgcaacctccgcctcccaggttcaagtgattctcctgccacagcctcctaagtagctgggattacaggtgccttccaccacgcccggctaattttttgtatttttagtagagatggggtttcaccatgttggccaggctggtcttgaactcctgacctcaggtgatctgcccacctcagcctcccaaagtgctaggattacaggcatgagccactgcgcccggccagatattcatttaaaagatgggtatgtaatacctgttacctgttaaataaaatctaggatacttgtctaaggtaatagggtatttttgtaacaatttgtagatttcagtcttttttttttttttttttcccccgagatggagtcttgctctgttgcccaggctggagtgcagtggtgcaatctctgctcactgctcactgcaacctccgcctcccaggttcaagtgattctcatgcctcagtctcccgattagctgggattacaggcatgcaccaccacacctggctaatttttgtatttttagtaaagacggggtttcaccatgttttgtccaggctggtgtggaactcctgacctcaggtgatctgcccacctcagcctcccaaagtgctaggattacaggcatgagccactgcgcccggccagatattcatttaaaagatgggtatgtaatacctgttacctgttaaataaaatctaggatacttgtctaaggtaatagggtatttttgtaacaatttgtagatttcagtcttttttttttttttttttccccgagatggagtcttgctctgttgcccaggctggagtgcagtggtgcaatctctgctcactgctcactgcaacctccgcctcccaggttcaagtgattctcatgcctcagtctcccgattagctgggattacaggcatgcaccaccacacctggctaatttttgtatttttagtaaagacggggtttcaccatgttttgtccaggctggtgtggaactcctgacctcaggtgatcgcccacctcggcctcctaaagtgctgggattatagatgtgagccaccacgcccggccacatttcaatcttaatgctattcttggtaaggggtccatagacttccaaattaagggccagacaaacattttaagttttgagggccacacagtctctgtcacaactgctttgactctgctgttgcatcattaaaacaaccagacaatatgtaaaaatgagtaagtgactcgattctaataattccatctgtggacactgaaatttgaatttcacataattttaaaatgtaaaaatacttctggctcacagactgtacaggtggtgagctgcagactgccagtcctgttctagatcataaatgatagctgcctgttagaagaatgaagtgacttttgcctatgtatgcaggtttaaaatgtgaaggatgcttcttgccacctaatcataacagtaacaagcactctgtatcaagaatcgtctttatgtgcatttccctatttctttctcacacatctgttatcttcttagtattcttattttttaggtgaggaaacaaggtaacctacctatggtcatttccttaaatttggaatattccataactaaataaacttatgtgaccatagacctcagtgcatacaactctggctaataagccaagtttctgttttttgtttttttgagatggagtctctgtcacccatgctggagtatggtggcacgatctcagttcattgcaacctccacctcctgggttcaagcgattctcctgcttcagcctcccaagtagctgggactataggcgcccgccaccatgcctggctaatttttttagtagagacggggtttggggtttcaccatgttagccaggatgatctcgatctcctgacctcttgatccgcccgcctcggcctcccagagtgctgggattacaggcgtgagccaccgcgcccagccaagtttctgtttttatcctttgttattatccaataatttgagagttttaccaccagtagtttatttcattagataaggtgatttggtagtgtgaccatgttaatgttaattctgatttcagaaagatggtgtttaacaaaggttgtcaattgcatttttgtggtgtaatgcgtaccccctaattttaattaaattttaaaatattttaatctagaatagagttataaccttgcagaggtttgagaatgttgtttatatacgaagtgcttctcaggctggaagtatacagttatggttcaccttacaggtgctgctggtgagtagcagccggtacccagaccagtggattgtcccaggaggaggaatggaacccgaggaggaacctggcggtgctgccgtgagggaagtttatgaggaggtgagatgttctttcacacaaattctgtttcggagttttaaaaacaaggccctttgctacataacactaagacagcgagacgggtccaggagtgctttttgcctgatgcaactttatttttaattttaatttttttttttattttttgagatggagtctcgctctgttgccaggcctggagtacagtggagcgatcttggctcactgccacctccgcctcccaggttcaagtgattctccagcttcagcctcccgagtagctgggattacaggcacgtgccaccgcgtctggctaatttttgtatttttagtagagacagggtttcaccatgttggccagactggtctcaaacccctgacctcaggtgatccgccagcctcagcctcccaaagtgctgggattacaggcgtgagccactacacctggccttaatttttgtatttttagtagggacagggtttcaccatgttggccaggctggtctcgaactcctgacctcaagtgatccttctgcctcggcctcccaaagtgctgggattacagacatgagccacagcgcccagccagaaatactaatttttgatcagtccttgccgctgatgaagtaaatgacaataaaaacttcacagaagcaggaagatagtgagttggtatggggaggggtattgtatttaattagatttaagtaaatagccagagtgtaacttgtatttatatacattttgttataaaaaggtaaacattttatatttcatctttttttaataggctggagtcaaaggaaaactaggcagacttctgggcatatttgaggtgagttaaaaagtaatcttcactttgctgataatagaattaatgatttcttcctaaccaaccaaataatgtggcagcagcctgaaccagacatttctctcagactagcagtaggcagtcagtccaggattaggtagggagggaagtaaaagccactttttcatatgccaccacttttatttatttatttttaattaattttttttaagacagagtctcgctctgtcgccaggctggagttcagtggtgcaatcttggcttactacaacctctgcctcccagattcaagcaattctcctgcctcgtcctcccaagtagttgggactacaggcacgcgccaccacgcccagctaagttttgtatttttaatagagatggggtttcaccatgttggccaggatggtctccatctcttgacctagtgatccgcccacctcggcctcccaaagtgctgggattacaggcgtgagccactgtgcccggctgccatcacttttatatagcattattatggtagtgattacttctgtttgaaaatacagtggagctgatactgaaatgtttatcttaatccactgtagactgtttagggtatagatcttttaggaggtacaatatttttagtatgacctaagagcttaggtctcatgtgttttatctggaaatgtccccattgcccttagcaaatattatatgatacacctagtgacttaaaggattgtacgaagatataaatctcaggtacatagaacagatgctaaaagaatagaattctctttcatatattctcttattactgaaggcagaatagaattttcagggagggaatttgaatgtgataggcagtctctggaagccagggagaaaggaggtccagatgtatcttcatccaagattcagacctagatacacagtataccagaaacatggtcactttccttttttcagggtgctgtttataggttagtacagcctttatagtagaaccatataaattttatttttaagccttaggaattcagaaaaaatcccgattttgtagcacttggtagaattgatgatgacttttaccggaatacagtaattaagagtaaagttggccgggcgtggtggctcatgcctgtaatcccagaactttgggttggccaaggcaggaggatcactaggtcaggaattcaagaccagcttggccaatatggtgaaaccctgtctctactaaaaatacaaaaattagccgggcatggtgacgcacgcctgtagtcccagctacttgggaggctgaggcagaatggcttgaacccgggaggtggaggttgcagagcggcactccatctcaaaaaacaaagagaaaagtcgttcaagtagaattcagtcttttccagaattcagcagttgcttcacccagttaaatagcaccatctcctggttaaactgaaaaacatactgaggtttttacaaataacacatttgtcaatatgctgacaaggtgtttgaagaaaatgtctcacattataaataaagcttaaataatatgggaaggtaacagtattaagtgctttacaaatactgtttaacagcacacgtcaatcaaaaaatacctttccccttagaaaatataagggaaaattggattgccctgcccattcatcccagtgatttttgtgaatttgtgaatatagcataataaatgtactgatttgtgagacatagaaataaaacaactgattcttaaaaataatgaatgatgtgttaattgacagttgcctctaatttattgttgtttttattccttctcagatataaaaagataatccttcccagctgtaaaaacccactgttttgagtagatttttcaggttgtttgtggccaaaatcaggacaattatctaaagtcgtggactatggcaaagaaggctaactttaatcaggatgaaggaaggccaacttgtttaatttttaacccagaaacaagctcagttgcctgttttatttaatttatgttttttttttttagatggggtatcattctgtcatccaggctttagtgcagtggcatgatctgggctcatcgccacgtccgcctcctgggctcaagcgatccttcacttcagcctcccaagtagctgaattacaggcatacaaccacgcccggctaatattttcgtatttttagtagagacggggtttcaccatgttggacaggctgggctcgaactcctgacctcaagtgatctgcccgccttggcctcccaaagtactgggattacagacgtgagcttctgctccaggccatgggctattctttatgtgcaccttgataggcctgcaggaggagtgcttaaaggaactggtgctgtttgctcttacaaaggtcctaaaggaagcagttttccatgtcattgaaaggttgtcaggattagccccagggaagaggggataggataaaaactatgggaatgcaggtctattattttaataagattgcattcaactcttaagattttctttatgaaaataacatcagataggccaggtaaggtggctcacacctgtaatcccagcactttgggaggccgaggtgggtggatcatgaggtcagggtttaagaccatcctgaccaacatggtgaaaccccgtctgtactaaaaatacaaaaattagccaggcgtggtggcgtgcacctgtaattccagctactcgggaggctgaggcaggagaatcacttgaacctgggaggcagagattgtgggggagctgagatcacgccactgtactcctgggcaacaaagcgagactccctgtctcaaaaaaaaaaaaaaaaaaaaagaaaagaacatcagatatatagaaataagtgtttaaagtttagtactggaggctgggtcctcatacctgtaagctcagtttttgggaaggccaaagcaggaggttcccttgagggcaggagtggaccagcctgggcaacatctccagacttctacaaaaaaagtagtattgagagccaatttcaccaccagtaatgatgaagctctagttctagtcttctgtttaacttttaaatgttttgtcttatataaagtcacttttgtgttggactgtacaactgaatatacttgcctgtgctgggaaatacgctatgctaatcagcagtatgccagactaatttttttcccttggaaaatgtgtccatggctagctcctgtagattaaaatgcatttctttttatattcaagcagaaccaagaccgaaagcacagaacatatgtttatgttctaacagtcactgaaatattagaagattgggaagattctgttaatattggtaagttcccttttgttatctgaatactctgttctaacagaagattgggaagattctgttaatataggtaagttcccttttgttatctgaatactctttgcttatattcctgtgtccagtttccatcctagatttttttttttttggtcacttttcatttagagcagggaagataattcaaatgtagagatgcatattcatcttaattattccccaacatattgttgtctaagtcatttatcggggagtaagtggacattacttatatggcttactttttaaaatggactgtcttgtaaccaatgtcattcttttctctaggaaggaagagagagtggttcaaagtagaagatgctatcaaagttctccagtgtcataaacctgtacatgcagagtatctggaaaagctaaagctgggttgttccccagccaatggaaattctacagtcccttcccttccggataataatgccttgtttgtaaccgctgcacagacctctgggttgccatctagtgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtggaatttttgtttagatgccttaactgtgccacaccccacaaccccctatattattttggttgtctatttctcacagcatattttcagttttttgtccatttgacatcagtctgtggtttattttgtcatcagattacttgtgggtatacctaccccaaaattgttttctcattcacagcattagcatattcagcaaatccatctgtggtgggaattaaaaatattattggtattaaagaaatccattcaccccaaaacttgttttacaggattacaattttaattcaaaatttccagatttgggctatttctgtatgatccaataacttattttgtcacagggcttaatttgccatttttggggatttgtcgactcattttgtctgaattttcacaactggtattatgtcactagctacctgatacggctatttcccttataactcaatagtaccttaacacaaagtataactctgtagagttggtgaatattttagggaaatattagcaaaatgcatgtagtaaagacatcttatgaaaactgtattcatggaatttgatttagcatgctcagttgccagttcccattatcgatactctttctttgcagaataccttagaaccgttatttccctcagtgtagattgctcttaaaatgtattcagttatttagtggcccccacaggagtggagtcttgaaatctaattctaaatgccagtcagtgatgatcgcatcacagttgagtgaaatggccttcctgttcagctgttagagactgaagattgttagggcaccttagaatgtctcatcttttctaggttgtcaacaggtactatttgtcacataactaactttcgaggcactggaacatacctgaactaagaattaaatcttttactttatactcacttaaaatcaagaatcccatctaaaacacataggtaccttatctgaaactcttgcacttccccaaccagggcagaaatgaggtgggagaagtttgactaaaatgagggatgggggaaagtaaaagatgtttttttttttttgagactcgctttgtcacccaggctggagtgcaatggcacaatctcaactcaccgcaacctccgcctcccgggttcaagcgattctcctgcctcagcctcccgagtagttgggattacaggcgcctgcctccatgcctggctaattttgtatttttagtagagacagggtttcttcatgttggtcaggctggtctcaaactcctaacctcgtgatccgcctgcctcgacctcccaaagtgctgggattacaggcatgagccaccatgcccagccaaagatcatttttttatatagacttcagccctttgtaaatattgtaactggggagtatagagtagaaaaaaagtatagttaaaacatttgttctacaaattaacctttaaaaatataattactgctaaaaatagagtgctgttacacttaaggaaaattagtgccattttggaaatgagatcttgtgccataaatacagctgaactgaatataaatgttcacaaattaatgctgtcaaaggaatgagtaaagcagaaaaacttttaaccagcaacatttcaagtacgtagtgtgatcaaacatgatcatccagaatttttatatttttttctttgtacagaggttacatattctgggtgttcttttataaaggaaacattttaaatcccacaaattgacactttctatcttcaatggactaagatttttttggtcagtaatctctgaaatttccttaaattatatacttaacatagcagagaaactggattgtttttgtatataagactgcttccacctgaaatgctgtcataagtactgggggggtgggggagtgcccatcttgtacatgatattcttagaggtaataaggtaatgatgcatgaatttattttataaactcttggactatgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgattttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatgatcatggctttaaaaaaaaaacaaaaacacacacacatgaactcagatttgcaaaccaggtttctgaaactttgggtaaggtgtatgcttttaactttgaaatgtataaacacccagcggaaacgtatacctttcagtgcatagtgcattgtgtgcttaccctgggttgtttaaacttgtgttcaaatattccccctccaagtgaaagcctgtcgggaattccacagtaacacctttactgttctcccattgatgatcatatacgttacctcttcctagcggtacatttgtatgatccttactactggaattaccgggttaaaaggaaatgcttaccactaagatgtcagtattctcctcatggatattttcagtctcaatgttgccagtctaatagtatagtatgtggttgctttactgctgttctccccacccccgtggagttgtgtcattattttaatgaatgtgagctcttgacttactctagaattctaatacagatactttctgcactagtatcacttttattattgcagttccatttaaaagcataactggctaagtcaccgccccacccgccgcattacatttcctaaaacatactgctgccaaagaccaactgtagaatccttaagtcctgttcaagtgtcacttcattttttattaggggtttcttagttggagggcatgagaaacttggccctttccaatgttgtcttcacattggagtataagaattctctataggactctttaatttttttttttttttggtagagatggggtcttgctgtgttgcccaggctggtctcaaactcctaggcttaagcagtcctccagcctcagccttctcaaagtgctaggatgattggcatgagccacctcgtctggcctgcaggtctttttaagcatttgctgttcaataataagcatcttctttatgcctagtatttgtgataagagcacaaaacaa

SEQ ID NO: 305 - DNA, 25324 bp, Homo sapiens; identical to SEQ ID NO: 304
  source 1..25324: mol_type = genomic DNA

SEQ ID NO: 306 - DNA, 24307 bp, Homo sapiens
  source 1..24307: mol_type = genomic DNA
gtctccgcgtggcgcgcgcctctagccgcccttcccctggcggctacggccggagggagcggaggcgagcgggagtcgggctccatggagagcggcggacaactgggcagaggcggagctttcatctcggcaccctggttccagtgacccgcgctagcgtcccgtcccgcccgcgtcggagcggccgccggccccgggactgaccggcctcgccgcacctcccgcaccgactagcgctcccgggcgctcctgcgcccgactcgccctcgcccccactccccggcggggtggcggcggccgggcccccacggcggcggccggagcagcagcagcagcagcaggagcccgcctctatgatgaagttcaagcccaaccagacgcggacctacgaccgcgagggcttcaagaagcgggcggcgtgcctgtgcttccggagcgagcaggaggacgaggtagggcgcccggcgccgcacgctgccctccggggcgccggggtctagggcccgggtgcttcccctcgctccccgcccctgcgcaggctgcggggctgggagggattagcccccttcctccctccctcctttcctccctcactcctttcctccctcacttcttccttcctttctctgggctgatagatgagacaaagggggctcgcccagccccagtttctccatctgggcactcgagaaggcgcctggtccccgggaaggtcccgggccgcgtaagtctcgcctagcgggagtcaccatcttaacgtgcgaattgagttgaaagccggataaacctcgagtgctcagcgagaggagggtggaaatggcgtgagtgttgcagcagagcccttgtgcctcttttacatattttccttccatgttacagccgtttgcggtctcggattcgatctaagcatgtttgtggagtaacagacagtcctcgtgcttggaattgagtctagtcttggcaattcttgtgggtccatgaacccgcaagctgttggcataattatgcctcatttttaaaacggccttcccttcttaaagttttctgactgcagaaaaatggttagtgaaaaatgtggaataatgccaaaagggagacgatggactagagatgggcaaagctgccattttcagacagtaatctccagctctcagcttatgtataaagggttctttgctgtctggcttgacatctggaaaggagtagcctttctcgttctcagagcagtcgttcttggataatttacccatctgcattgggctgagaatgagacccttggggtttccctggagagcgatttttacttaattcagtagtatttatttaaaatggctaactgttgaagtttgcttagggcaatagtagccttttggtattgccactcttaagataaattacataggtgaaaaaaattaacattctgagttctgctttcataaccaaccgtgtataaaatactaggctaaggctggagatgggaatttaatggcttccttactgctagtccctgtagttgtgatgaatatgacacagaatacactcagtggcttagttcttgttatgttaacgaaaagttctcgaaatttgcccttcaaacccttgttttgcctttatttttttttgaaaagaaaccaagccctttaaatgggttgctctgtgctcactcataacctttacgtattagacttgaatcccaaacgagtgtgcagagaaatacggccccagcctttgagatgggtctgcttaggagagctagaaactgcaaagggaaaggttattaacttttacaaaatgaacaagtcaacaagcattaagtgtgttctgtaaaaaagataaagccttagcggaaaggggccatgttgaggcaaagtagtaaactttaaatataaaagaaatgatagccaaaagggatcaagatagatcaaggatcttgtctggtttcctcaatattgtgtaatgatattcttaattgagtgcttacaatgtgccaggcgctgccagaagaaaacttgttatacatttaatccttttaacactgggaggtagtgaagttactcccattttataggtgaggagacagttgcagagcataagtaccttcccaaatgacacaattaggaagtggtagagtcaggattcagggtccagtccttactcctgatgttgggctctgtttgttgagtgagtgagatttttgtgaggctaagtttggaagcctatctgaaagtggtgactgaagtgttgccataatgtgaacttggaattcaggctttgtaaaaatactagactctaggggaaaatatgagtgatggaaattgaaatgatgatctctattgtgcttatggtaaagcaaagactgatagaagctttaggaattactttagcaataaaaataaatgattatttttatgcttggatattatttctactgaaataaatactaaattcatagcctctagttgagtcaagagacccgtgtcattaggtaaggtgaagtagggagcaagttttggagaatgtattagaaaaatccattgtataaaactttgtaaatctgataacctgtaggttgagaattgaagagagtgagtcatcttgttagaggatatgatctgagggaagactctagaattctccttaagtgaaatgcacagccaattttaacatctggtttagctcttcagaattttcatttctgtgattgtgtgtagttgaggctttatctattacatgattattacagaataaactctgttagctttcctggagattctattgtttctctatgaatttgccttcactctgttgaaattgcattgccagacttcccaggacagtctagaaaaccagcttgagcccacctctctagttaataggtgagaaatgtttccctctactggatgaaaaacacctagatcctggttagaagatttaaatgtatgttttgtttgaggatgaaatgtttatatagagtacaaatggaagtaaaagagtaattgcaatttgaccccaaaaaagctacgtggcgctcccatctggctgttcctgtactgaagttctcagtaagtttctactttaaaacagattgttctaggaaagaaggttgttctaagagcagagttattcttttaaggtggctttatatattaaatattttccattttatctttttctgttctgtagggtaaataagtattagtatttgtttaggaagaaattaggtagcagaagtaacctatcccaaggtcacagaagctggcagatccttttgagctctggtcctttgtttctaaatgttttgtttatttgacctacctccccagctagttatttctgtggggaagcaccctcagttttggccgctgggcttctagacaggcccacagctaattgccctgtagagtagctgggtactgtgcttgtacagtgaaagatgacaatgcttttacaaataggtaatcagaaatggattctgttgaatgtatttgcatatatgatagtttaaaaggggatgaagagatgaggtcttagctcctaagaatcattctgtagggaaaggttggacaagggatcaatggaaagggaaataaagtaagggaaaagtgcggtcgggtattctggggttcagatccaatgtgagtcatttggagttggatgtgggtgactgggagaggagggaccaggcgtcccaaatagagcaagacttggggctgtgatagatttggctgcagcttagggatagcatagaatcagtaatagttgaaaaatttgcaacacttcaaatgtaaggttgagaagttgctacgcaagaacaaagttttgttttgaacttagttttgaacaaagaacattgagatagtagatgtgttcaagcttgagagtgatctggcagcaaaataggtttagactgctaaggggagaagtagaatgacttgatcctgtgtgaaatccagacatagttgcaagagaggcattaacaaatcagtctgaaggactaaccactacaggccaggcaggtggctcatgcctgtcatcccagcactttgggaggcggaggtgggcagatcacctgaagtcaagtgtttgagaccagcctggccaacatggcgaaaccctgtctctaccaaaaatacaaaatacaaaaagcagccgggcgtggtggcatgtgcctgtaatcccagctactcaggaggctgaggcatgagaatcccttgaacctgggaggtggaggctgcagtgagccgagatcatgccattgcactccagcctgggcaacagagcaagaccctgcctgcaaaaaaaaaaaaaaaaacaacaaaaaaaaccactactcttccataggacttgctgccctaattagcttttaagctctatgagccaggggctgtcttctacagatggtctgctataatgctgaatatatattcctgaaaaatcttgagctgtacaaaatcatgcagtaaagctttggtgggaaaggtcaagtctgaaaacctaaaaccagagctccgatgagcaacaatactaattcaaaatattactagagttaaatctcaactagcatttttatacttagaatcaacagtcagtccacccttttcacacatactctggggctcatagttcttcagagttaagtccttgaaggtatttctttcaaatggagaccactttcatcaaaaataagtactatccaaaggtagccttttttttttttttttttttgagacagagtctcgctctgtcctccaggctggagtgcagtggcgcgatgtcagcttactgcaagctccgccttccaggttcacgccattctcaagtagctgggactacaggcagccgccaccatacctggctaattttttgtatttttagtagagaaggggtttcactgtgttagccaggatggtcttgatctcctgaccttgtgatttacccacctcagcctcccaaagtgctgggattacaggcatgagccactgcacccggcttggaagccttttttaaacacagggaagtgtcaccaacttcttcatctgtgcctccagctctcccagaaggtttcccgtcattaaaccaggcattaacgtagaatttgcattggattttttttttttttcttagggtcttggtatagctcaagcttttctctaattgaaaaaaagcttataccccgtcactttaaaacattgacctgctaggtaaaaaatccatggtcaacctgatttacaacattattgataatacttatctaccaatcccatataagttggagctaaacatagtttagaagaaagaactgttatttctggtctactctgcctctggtccaaaaagaagtactaattttcttaatagtaggtagctgtttagcatgtatcaaaccattttcataacctatgttcttttaaaatgtctatgtgcatagtgggtgtttctaataacacggctggcctaattttggctaaattttggttaagtgtagtagaattaggttaacgtagtttcaaccattcatgataccctgatttatgataatttggaaagaaagaatagcaacctcgaaacagtttctgagtaggccaggtgcagtggctcacgcctgtaatcccagccctttgggaggccaaggtgggtggatcacctgaggtcaggggttcaagaccagcctgggcaacatggcaaaacctcgtctctactaaaaatacaataattagccaggcgtggtggtgtgtgcctgtagtgctggctactccggaggctgaggtaggagaatcccttgaacccaggaggcggggctttcagtgagctgagattgcgccactgcactccagcctgggcgacagagcgagacagcgtctcagaaacagcaacaacaacaaacagtttctgaatagctacaattttcataataaacctcttcattcttaggggtcacttgaggttctctggatggctcctccgctccccttcccgggaacagaagtggtatctatagtggttggagttcctagagccaagccatgacaattgcatctttaagggtaaaagctgaaacacaaatgggaattcgaggcccaaggacctacagcctctgaaggcataaatgcattacatagcccttgaacagcacccttttatacatcaccagcgaggaggacccgtcaggtgataaagggtatagattctataaaatagatcaggggtgcccaagcttttttttttttctcgctctgtcaccaggctggagtgcagtggtgcaatctcagctcactgcaaactctgcctcctggattcaagcgattctcctgcctcagcctcccgagtagctgagactacaggcgtgtgctaccacgcccagctaattttttgtatttttagtagagacggcgtttcactatgttggccaggatggtcttgatctcctgacctcgtgatctgcccacctcagcctctcaaagtgctgggattacaggcgtgagccaccgtgcctggcctggggtgtccgatcttttagcttcactgggcctcattggaagaattgtcttgggccacacataaaatacactaacattaatgatagctggtaagctaaaaaagtaataattgcaaaaatattttataatattttaagaaagtttacaaatttgtgtttggctgcattcaaaaccatcttggactgcatgcagtccacgggccacaggttgagcaggcttgcaatagatcattctaattcatagacttttatccaataagatttagggttggtttcctgttgactactgtcaatacactattcttttttttttaagagtctcactctgtcacccaggctggagtgcagaggcgtgacctcagctcactgcaacctccgcctcccaggttcaagccattctcctgcctcagccttccaagtagctgggattacaggcacatgccatcacgcctggctaatttttgtatttttagttgaattttgtatttaaattttagttaagttttgtatttttagtcaccatgttggccaagctggtctcttactcctgacctcggcctcccaaagtgctgggattacaggcgtgagccaccatggccggccaatacactattcttaaagtgataaatgcttttctccaaatgcttaaaaccttaggtatctaggaaaagacaaaataactcttcagcagtgccaggtgagtggtgtttttttctggtaattatctaatacatgggaagagggagtaagatttagtagagtagtaggaagaaagaatgcttatgcgaagataggttgaatagagtaggaagagatgtcttcacttttcaccacactaatagcgttggctttggggtctgagtgtgctccaggtctggctctgcaacctggtagaatgagtagcctccttttcgtaaatctttcatatagtcacagctctgatttatctggaaggttgaatgcatcttccttcatctctgtcatcgctaatgtaacagaccagtatcttgatggatacagaaaatctagtctactcagagaagggaatttcaaacctatgaatgaccatgtgtggctctgtcaactgttggtgtgtctttgtagaatgagcttttataacccatctttagagcattaattagcatgctaactatactagtagctttgggggtgtgatagaaatgtgtagatggctgttgtgtgcgtttagagtgagtgttgaagaataatgcattgtgatagggttctagagattgagattcttccacttttgtaggaggggcttaggagcagctgcctattatttgaaatcaatattattgcaagaaaagcaaccattatggttatgttgctatgattcagcaaatggcgcccccaaaacaagccaaaaaaaaaccttacaataaattgtgctgaaatttgattttagatttctgcatgtatagattttatatatatatatatagtaaatctttttatatatatatatatatatatatatatatacataattttttttttctttttgagatagaatctcacttctgttagccaggctggagtgcagtggcacaatcatggctcactgcagccttgacttcccaggctcagatgattctcccacctcagccccccgagtagcttggactacaggtacatgccaccatgcctggctaatttattgagttttttgtagagacagggtcttcctatgttgcctaggctggtcttgagctcctagactcagtccgcctgccttggcttcccaaagcaccgggattacgggtgtgagccattgtgcctggcctatagaagatattaatagttcaggctgggcacagtggctcacacctgtaatctcagcactttgggaggccgaggtgggtggatcatttgaggtcaggagttcaaaaccagcctggccaacatggtgaaactcagtctccactaaaaatacaaaaaaaatgagccgagcatggtggtgtgtacctgtaatcccagctactcaggaggcttacgcacgagaattgcttgaacccaggaggcaaaggttgcagtgagccgagatcacgccattgcactccaacctgggtgacagagtgagaccctgtttcaaaaaaaaaaaagaagctattaatagttgagttttcccacagagttttagtagaaaagatataatgaagctgaaaaatgtgagtatgtaactagtaaaaacacggactgctcagaactagtatctccaaaatttatgtaagaaacaaaatttccattattgactatactagatattttcatcattctcaaatttttgtggaacacttaaaatttgtattagcagatatgtcaaatcttttgtctaggttggaaaactcttaactggaagaacatagctaaatctttgataatgaaagtacaccttcttattaattttggcctctggaaaacaatactgaatgaactctgatttttttttattattattatttttgagacagtctcactgtgttgcccaggctggaatgcagttgcgctatctcagctcactgcaaaccgcctcctggattcaagtgattctcctgcctcagcctcccgagtagctgggattacaggcgtgcaccaccatgcccagctactttttatgtttttggtagagatgaggtttcaccatgttggccaggctggtcttgaactcctgacctcaagtgatcctcctgcctcggcctcccaaagtgctgggattacaggtatgagccactgcacccggctagactgttttatttgcatgctctttacaaaacgtgttttttcaagctgaattgctttagtagttccataaaaatgtagtccagaaaaatctacattgatgattttcattttcaacagattccaagtgaattcaacagaaaagctgtaattcttgagttcctgatagttctggagtgacagtactccactacggtgcaactcctcaccaccatccccagtttctcttttataatctcaggctttttaacttggtgaaatgtttttctggaaagagaaatggtcatatagcactgaacaatagagcaggtgtggcggttcttaggaaacactgagttatgttttcatcttaatctcaaccccttgcctaaaaagttgttagtgtcctctgttgtctgcctaattaaaatataaacatgctccaatgtgataccaactttttttcatctgtactggtctagatctagtgctggggaccgcttccaagtgcatgacagaccccaggtgatcacaggatggcctagctatcacactagttggccttaagttaaaagacttttcactgttattggggttgggggcaggcaggggactgttttaattgtccttctctctactaatgctgttcatatttttccaccctggcagacatacgccatcatccagtctattctcttatctggagtgtatccctcagttcttgctcactcttagtcactgccttctccccaccaccacccccccagatgtggccttgccctcatttgaacactcaaatgaactattcaagatgagtaggcaagtacttaatgaaacagacagactttcaaatctgtcaccatgacatctgtgtgagacctcttttcataagctagttgtttagatggccagtcatttctatatcacagatattaagtacccatttaaagcgatcattttatggaaagataatttgaagttattggtctgaccaaatttattcttcctgagatgtcaagggactcttggatgataagttactggattaggctaaatcgtttgtccacaatttataatgatatagatttatatagatgtatgtgttcttgcagtttttagacacaaaatattgagcattctatgtgactgtattccaaccccacctccaagaatataagctctttgagggaaagatgtatattcagtatcttttcatcacatacaattcttgttgagtatcacacaattagtagataaggaacaaaatcagcaacttctttctccacagtgcttctctttaaggtggagaacttgtgctgaattgtcactttttgacaggagtcagtctgttctctgtccttctagaggctgaagattgtaaagacaaaagtgaatggatttagtttggataccatgtgcatgatgcttctttcctgctagcccattttcatgattctgattttctttcgaaaagcattttaaagtggtaaggttttgcatgaaaatttaagtggataaataactaacagttacatattttacctgttctgaaaaggatataccattaattggctgtagatgtccaatatgtgacccttgagatgagcacttgaaatatgactggactaaggaattgaattttaaattttatttaatcttaaatttagccatatgatgctagtggtgactgtgttagctgtagaccctcaaaagcatgaaaggttcaaaagtagcagagtttaggacagactggaattaattggcagatcaagggcccagaggagcccaattctatctgcaggtttgtcaatttagatgagtagacaagtgcttaatgaaacatgctggattttaaaactaccatcaccaaaagttggatattagcacatctgccttaagctagtagtttagatgtgaatcatttctggaccatagataattactcatttaaatttatcggccttttttttgaaagatacatttggctgggtgtggtggctcatgcctgtaatcccagcagtttgagaggctgaggcgggcagatcacctgaggtctggagttcaagaccagcctgaccagcatggagaaaccccgtctctactaaaaatacaaaattagctgggcgtggtggcgcatgtctgtaatcccagctacttgggaggctgaggcaggagaatcgcttgaaccggggaggcggaggttgcagtgagccgagattcttatatcataaattactggattgtgctaaatcacttatcaaatttatatactattttcatgaggctttctaaaaagtaatttatgaaagagagatgttgagacacaagggttccatattactcatttttggaagaaaagtttagtcatgctgatgtcttgtagatgcaggattggttttaaatctgaagcatagaccgggcgcggtggctgacacctgtaaccccagcactttgggaggccgaggcaggtggatcacgaggtcaggagttcaagaccagcctggccaagatggtgaaaccccatctctactaaaagtaccaaaatgagctgggcatggtggtgggagcctgtaatcccagctactcgggaggctgagggagggaattgcttgaaccaaggaggcggaggttgcagtgagccgagattgcaccactagactcaagtctgaatgacagagcgagactctgtctcaaaaaaaaaaaaatctgaagcataaaatgtttcttcagaaaagcagacacatcttatactaatggtttttcaacattattaatctcctgtaatttagctctgtcttggagaactggaaacatcatagtcaatgacctagatacatgagactttgcatttcatttattcaggactgcaacattttgaatatggatgattttgaactccctatttactatttactaagtgatgatgtacttttcaggcggctagccacctgcgttatgtcccattattaacgtaatccaggaagttgcttagagagcatagaattgtgtaacaagaatttcatctaggcaatagaaaccagtttattcctaacccaaacctagtgaccagaaaaagaggcctgtaactctgcagtccggaccagtagttgctgtttacttttccagtgatgcgagacaaactcttaacatttttatttaacttaaaaactaacattcacttgccagtcttgatagagggccagtgcctttggttgccatagatcctctgtaagcctccaattttgaataaaatacaaaggttttgaaatctgatttgtagtttctctgttgaaagtagaatttgaacttagagacccttgcatgcacttttggatttttaattttctttttctaattttctataaagtctcatctgggtataatttgataatgtaataaccccccctccctttttttgagacagtctcattctgtcgcccaggctggagtgcagtggcatgatcacagctcactgtaacctcgacctcctgggctcaggtgatcccttccaccacagcctcctgagtagctggtattatgggcacatgtcaccatgcatggctgatttctgtatttttttgtagagggagttttgctgtgttgcccaggctgttctcacacctgcccgccttggcctcccaaagtgctgggatgggattacaggcgtgagccaccatgcctggcctggaatgctgcttttctaagaggaggttctatgcctaaatagatactctcttttaactcagcattttgggggcttgagagaagggtgggagttgctgaattgtcagcttgaaactttccagtttggaaaagttcctggtaacttagtcaaatgagagaggactcctgtgctggctgagaactcttaaaggccagcagctcctggcagcagggagggagcagggcagatagaagtgctggcatgcatttaaaagaaaaaaaaatcagtcatggctcttgcctgtaatcccagttgggaggccaaggtgagaagatcacttgagcccatggttttgagacctgtctaggcaacatggcaagaccccacctctacaaaataatacgaaaatcagactgggcatggtggcttactcctgtaatcccagcactttgggaggccaaggcaggcagatcacttgaagtcaggagtttgagatcagtctggccaacgtggcgaaaccccatctctactcaaaatacaaaaattagctggtcttggtgggaggtgcctgtaatcccagctactttggaggctgaggtgggagaatcacttgaacccgggaggcagaggttgctgtgagccaagaccatgccactgccctccagcctggatgataggacgagactccatttcaaaaaaaaaaaaaagtacaaaaattagccaggcctggtggtgggtgcctgtactcccaactgctcgggaagctggagtgagaggatcacttgagcccgggaagtgaaggctgcagtcagcagagattgtgtcactgcactccaacgtggatgtccaagtgagaccctgtcttagttatcatcatcatctctatgcacactgggaattaaacttcgtgataaaccctatgtgttttcgagggagaactgtttaaatttacttgaaggtagtatactaagataattttgtggacacttttgttcaaattgacttatttatttttattttttatttttttgagacagagtctcactccattgcccaggctgaagtgcagtggtgcagtctcggctcactgcaaccttcgcttcctgaattcaagcaattcttgtgcctcagcctcctgagtagctgggactacaggaatgtgctaccacacccagctaatttttgtatttttagtagagatagggtttcaccatgttggccaggttggtcttgaacccctgacctcagatgtccacccacttcagcctcccaaagtgctgggattataggcatgagccaccacgctcaccttgagttgattttaacttaagtgaagttcaacctaagctagcccacaaatattcctttgtttcccccccccccttttttttttcctttttttgagacagaatctagctctgttgcccaggctggagtgtagtggcatgatctcggctcactgcaacctccgcctcccaggttcaagtgattctcctgccacagcctcctaagtagctgggattacaggtgccttccaccacgcccggctaattttttgtatttttagtagagatggggtttcaccatgttggccaggctggtcttgaactcctgacctcaggtgatctgcccacctcagcctcccaaagtgctaggattacaggcatgagccactgcgcccggccagatattcatttaaaagatgggtatgtaatacctgttacctgttaaataaaatctaggatacttgtctaaggtaatagggtatttttgtaacaatttgtagatttcagtcttttttttttttttttttcccccgagatggagtcttgctctgttgcccaggctggagtgcagtggtgcaatctctgctcactgctcactgcaacctccgcctcccaggttcaagtgattctcatgcctcagtctcccgattagctgggattacaggcatgcaccaccacacctggctaatttttgtatttttagtaaagacggggtttcaccatgttttgtccaggctggtgtggaactcctgacctcaggtgatctgcccacctcagcctcccaaagtgctaggattacaggcatgagccactgcgcccggccagatattcatttaaaagatgggtatgtaatacctgttacctgttaaataaaatctaggatacttgtctaaggtaatagggtatttttgtaacaatttgtagatttcagtcttttttttttttttttttccccgagatggagtcttgctctgttgcccaggctggagtgcagtggtgcaatctctgctcactgctcactgcaacctccgcctcccaggttcaagtgattctcatgcctcagtctcccgattagctgggattacaggcatgcaccaccacacctggctaatttttgtatttttagtaaagacggggtttcaccatgttttgtccaggctggtgtggaactcctgacctcaggtgatcgcccacctcggcctcctaaagtgctgggattatagatgtgagccaccacgcccggccacatttcaatcttaatgctattcttggtaaggggtccatagacttccaaattaagggccagacaaacattttaagttttgagggccacacagtctctgtcacaactgctttgactctgctgttgcatcattaaaacaaccagacaatatgtaaaaatgagtaagtgactcgattctaataattccatctgtggacactgaaatttgaatttcacataattttaaaatgtaaaaatacttctggctcacagactgtacaggtggtgagctgcagactgccagtcctgttctagatcataaatgatagctgcctgttagaagaatgaagtgacttttgcctatgtatgcaggtttaaaatgtgaaggatgcttcttgccacctaatcataacagtaacaagcactctgtatcaagaatcgtctttatgtgcatttccctatttctttctcacacatctgttatcttcttagtattcttattttttaggtgaggaaacaaggtaacctacctatggtcatttccttaaatttggaatattccataactaaataaacttatgtgaccatagacctcagtgcatacaactctggctaataagccaagtttctgttttttgtttttttgagatggagtctctgtcacccatgctggagtatggtggcacgatctcagttcattgcaacctccacctcctgggttcaagcgattctcctgcttcagcctcccaagtagctgggactataggcgcccgccaccatgcctggctaatttttttagtagagacggggtttggggtttcaccatgttagccaggatgatctcgatctcctgacctcttgatccgcccgcctcggcctcccagagtgctgggattacaggcgtgagccaccgcgcccagccaagtttctgtttttatcctttgttattatccaataatttgagagttttaccaccagtagtttatttcattagataaggtgatttggtagtgtgaccatgttaatgttaattctgatttcagaaagatggtgtttaacaaaggttgtcaattgcatttttgtggtgtaatgcgtaccccctaattttaattaaattttaaaatattttaatctagaatagagttataaccttgcagaggtttgagaatgttgtttatatacgaagtgcttctcaggctggaagtatacagttatggttcaccttacaggtgctgctggtgagtagcagccggtacccagaccagtggattgtcccaggaggaggaatggaacccgaggaggaacctggcggtgctgccgtgagggaagtttatgaggaggtgagatgttctttcacacaaattctgtttcggagttttaaaaacaaggccctttgctacataacactaagacagcgagacgggtccaggagtgctttttgcctgatgcaactttatttttaattttaatttttttttttattttttgagatggagtctcgctctgttgccaggcctggagtacagtggagcgatcttggctcactgccacctccgcctcccaggttcaagtgattctccagcttcagcctcccgagtagctgggattacaggcacgtgccaccgcgtctggctaatttttgtatttttagtagagacagggtttcaccatgttggccagactggtctcaaacccctgacctcaggtgatccgccagcctcagcctcccaaagtgctgggattacaggcgtgagccactacacctggccttaatttttgtatttttagtagggacagggtttcaccatgttggccaggctggtctcgaactcctgacctcaagtgatccttctgcctcggcctcccaaagtgctgggattacagacatgagccacagcgcccagccagaaatactaatttttgatcagtccttgccgctgatgaagtaaatgacaataaaaacttcacagaagcaggaagatagtgagttggtatggggaggggtattgtatttaattagatttaagtaaatagccagagtgtaacttgtatttatatacattttgttataaaaaggtaaacattttatatttcatctttttttaataggctggagtcaaaggaaaactaggcagacttctgggcatatttgaggtgagttaaaaagtaatcttcactttgctgataatagaattaatgatttcttcctaaccaaccaaataatgtggcagcagcctgaaccagacatttctctcagactagcagtaggcagtcagtccaggattaggtagggagggaagtaaaagccactttttcatatgccaccacttttatttatttatttttaattaattttttttaagacagagtctcgctctgtcgccaggctggagttcagtggtgcaatcttggcttactacaacctctgcctcccagattcaagcaattctcctgcctcgtcctcccaagtagttgggactacaggcacgcgccaccacgcccagctaagttttgtatttttaatagagatggggtttcaccatgttggccaggatggtctccatctcttgacctagtgatccgcccacctcggcctcccaaagtgctgggattacaggcgtgagccactgtgcccggctgccatcacttttatatagcattattatggtagtgattacttctgtttgaaaatacagtggagctgatactgaaatgtttatcttaatccactgtagactgtttagggtatagatcttttaggaggtacaatatttttagtatgacctaagagcttaggtctcatgtgttttatctggaaatgtccccattgcccttagcaaatattatatgatacacctagtgacttaaaggattgtacgaagatataaatctcaggtacatagaacagatgctaaaagaatagaattctctttcatatattctcttattactgaaggcagaatagaattttcagggagggaatttgaatgtgataggcagtctctggaagccagggagaaaggaggtccagatgtatcttcatccaagattcagacctagatacacagtataccagaaacatggtcactttccttttttcagggtgctgtttataggttagtacagcctttatagtagaaccatataaattttatttttaagccttaggaattcagaaaaaatcccgattttgtagcacttggtagaattgatgatgacttttaccggaatacagtaattaagagtaaagttggccgggcgtggtggctcatgcctgtaatcccagaactttgggttggccaaggcaggaggatcactaggtcaggaattcaagaccagcttggccaatatggtgaaaccctgtctctactaaaaatacaaaaattagccgggcatggtgacgcacgcctgtagtcccagctacttgggaggctgaggcagaatggcttgaacccgggaggtggaggttgcagagcggcactccatctcaaaaaacaaagagaaaagtcgttcaagtagaattcagtcttttccagaattcagcagttgcttcacccagttaaatagcaccatctcctggttaaactgaaaaacatactgaggtttttacaaataacacatttgtcaatatgctgacaaggtgtttgaagaaaatgtctcacattataaataaagcttaaataatatgggaaggtaacagtattaagtgctttacaaatactgtttaacagcacacgtcaatcaaaaaatacctttccccttagaaaatataagggaaaattggattgccctgcccattcatcccagtgatttttgtgaatttgtgaatatagcataataaatgtactgatttgtgagacatagaaataaaacaactgattcttaaaaataatgaatgatgtgttaattgacagttgcctctaatttattgttgtttttattccttctcagatataaaaagataatccttcccagctgtaaaaacccactgttttgagtagatttttcaggttgtttgtggccaaaatcaggacaattatctaaagtcgtggactatggcaaagaaggctaactttaatcaggatgaaggaaggccaacttgtttaatttttaacccagaaacaagctcagttgcctgttttatttaatttatgttttttttttttagatggggtatcattctgtcatccaggctttagtgcagtggcatgatctgggctcatcgccacgtccgcctcctgggctcaagcgatccttcacttcagcctcccaagtagctgaattacaggcatacaaccacgcccggctaatattttcgtatttttagtagagacggggtttcaccatgttggacaggctgggctcgaactcctgacctcaagtgatctgcccgccttggcctcccaaagtactgggattacagacgtgagcttctgctccaggccatgggctattctttatgtgcaccttgataggcctgcaggaggagtgcttaaaggaactggtgctgtttgctcttacaaaggtcctaaaggaagcagttttccatgtcattgaaaggttgtcaggattagccccagggaagaggggataggataaaaactatgggaatgcaggtctattattttaataagattgcattcaactcttaagattttctttatgaaaataacatcagataggccaggtaaggtggctcacacctgtaatcccagcactttgggaggccgaggtgggtggatcatgaggtcagggtttaagaccatcctgaccaacatggtgaaaccccgtctgtactaaaaatacaaaaattagccaggcgtggtggcgtgcacctgtaattccagctactcgggaggctgaggcaggagaatcacttgaacctgggaggcagagattgtgggggagctgagatcacgccactgtactcctgggcaacaaagcgagactccctgtctcaaaaaaaaaaaaaaaaaaaaagaaaagaacatcagatatatagaaataagtgtttaaagtttagtactggaggctgggtcctcatacctgtaagctcagtttttgggaaggccaaagcaggaggttcccttgagggcaggagtggaccagcctgggcaacatctccagacttctacaaaaaaagtagtattgagagccaatttcaccaccagtaatgatgaagctctagttctagtcttctgtttaacttttaaatgttttgtcttatataaagtcacttttgtgttggactgtacaactgaatatacttgcctgtgctgggaaatacgctatgctaatcagcagtatgccagactaatttttttcccttggaaaatgtgtccatggctagctcctgtagattaaaatgcatttctttttatattcaagcagaaccaagaccgaaagcacagaacatatgtttatgttctaacagtcactgaaatattagaagattgggaagattctgttaatattggtaagttcccttttgttatctgaatactctgttctaacagaagattgggaagattctgttaatataggtaagttcccttttgttatctgaatactctttgcttatattcctgtgtccagtttccatcctagatttttttttttttggtcacttttcatttagagcagggaagataattcaaatgtagagatgcatattcatcttaattattccccaacatattgttgtctaagtcatttatcggggagtaagtggacattacttatatggcttactttttaaaatggactgtcttgtaaccaatgtcattcttttctctaggaaggaagagagagtggttcaaagtagaagatgctatcaaagttctccagtgtcataaacctgtacatgcagagtatctggaaaagctaaagctgggttgttccccagccaatggaaattctacagtcccttcccttccggataataatgccttgtttgtaaccgctgcacagacctctgggttgccatctagtgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtggaatttttgtttagatgccttaactgtgccacaccccacaaccccctatattattttggttgtctatttctcacagcatattttcagttttttgtccatttgacatcagtctgtggtttattttgtcatcagattacttgtgggtatacctaccccaaaattgttttctcattcacagcattagcatattcagcaaatccatctgtggtgggaattaaaaatattattggtattaaagaaatccattcaccccaaaacttgttttacaggattacaattttaattcaaaatttccagatttgggctatttctgtatgatccaataacttattttgtcacagggcttaatttgccatttttggggatttgtcgactcattttgtctgaattttcacaactggtattatgtcactagctacctgatacggctatttcccttataactcaatagtaccttaacacaaagtataactctgtagagttggtgaatattttagggaaatattagcaaaatgcatgtagtaaagacatcttatgaaaactgtattcatggaatttgatttagcatgctcagttgccagttcccattatcgatactctttctttgcagaataccttagaaccgttatttccctcagtgtagattgctcttaaaatgtattcagttatttagtggcccccacaggagtggagtcttgaaatctaattctaaatgccagtcagtgatgatcgcatcacagttgagtgaaatggccttcctgttcagctgttagagactgaagattgttagggcaccttagaatgtctcatcttttctaggttgtcaacaggtactatttgtcacataactaactttcgaggcactggaacatacctgaactaagaattaaatcttttactttatactcacttaaaatcaagaatcccatctaaaacacataggtaccttatctgaaactcttgcacttccccaaccagggcagaaatgaggtgggagaagtttgactaaaatgagggatgggggaaagtaaaagatgtttttttttttttgagactcgctttgtcacccaggctggagtgcaatggcacaatctcaactcaccgcaacctccgcctcccgggttcaagcgattctcctgcctcagcctcccgagtagttgggattacaggcgcctgcctccatgcctggctaattttgtatttttagtagagacagggtttcttcatgttggtcaggctggtctcaaactcctaacctcgtgatccgcctgcctcgacctcccaaagtgctgggattacaggcatgagccaccatgcccagccaaagatcatttttttatatagacttcagccctttgtaaatattgtaactggggagtatagagtagaaaaaaagtatagttaaaacatttgttctacaaattaacctttaaaaatataattactgctaaaaatagagtgctgttacacttaaggaaaattagtgccattttggaaatgagatcttgtgccataaatacagctgaactgaatataaatgttcacaaattaatgctgtcaaaggaatgagtaaagcagaaaaacttttaaccagcaacatttcaagtacgtagtgtgatcaaacatgatcatccagaatttttatatttttttctttgtacagaggttacatattctgggtgttcttttataaaggaaacattttaaatcccacaaattgacactttctatcttcaatggactaagatttttttggtcagtaatctctgaaatttccttaaattatatacttaacatagcagagaaactggattgtttttgtatataagactgcttccacctgaaatgctgtcataagtactgggggggtgggggagtgcccatcttgtacatgatattcttagaggtaataaggtaatgatgcatgaatttattttataaactcttggactatgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgattttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatga

SEQ ID NO: 307 - DNA, 33939 bp, Homo sapiens
  source 1..33939: mol_type = genomic DNA
ttaccaagcaatgcatttatttggaaggataccagttaccagtcatcaaaagcttttgtatgttgaaaatgtaattttaatagttaattcttcatcttacataggagcacaataaaatacaccacaatctgaagaaactccagaattacgagaataagagtgaagaaaattcaaatgggctacaatatccattaccttaaactgcaagagacaaggttgcaacccgaaggttaacatttatgtatttatgactggctacatttatgacttaaaaataacaagaatcaggaattagatatggagagaggtgggaaagaacagttttgtgaggggaggaattcgtcaataaagaagaaaaattactgaattccaaattaaagaataaaacgagctcccacagcaaatactggagggatgaaagcaagaatcattaactgaggacttgatactctcaaagggataaacctttctgatgacacacaagctagatagttgagatctgctcatcaggtttataaggaagactcacaaatgcctcagcaaatcccaaatgatcagatcagtgtttcttaacacacatgaaaggttacagatgaaattttcagataagaaccaagaaaaatgtcataacccaaattttaggcaaaaatgtggcacaactgtgaaagtcctacatgtcagtcacaactgctatctttgctgtgactttcctgtacagtaatttttaaacattgtggcaagacaccaatgatcatctaatcagacaacacaaacacatttatttcaaattcctagaaggttaaaaaaaggtcagatactgatgctttatgcatgctcagggccagtttataaatactccattcagtactatcttaacacaaatctgcatcagtgaaaagaaactggcaaaatccacctcttgccattcaatttgtcagatggtgaagaccaagaaagaatgttccatcagtttcaattttaaaatacgattgtcaaattgggaaaatgaaataaacacagtaaaataaactgtacaaaggcaaagtagaataacaaaaaatattttactaaaacataagatttacagaagtttccagacaagccatacaaaatggtcacaagctttttttgaaggggggaatctacacttgacagcaatgttattagtgagggctgtgatgtttgtttaatgttcccattttggttccaacaatcaagcttgtccatctacagcgtctaaataaagttagacttggctagagcatattctaaagacctggttagctgcttttaaccaatgcaattagatcaccaaaaaagggggaaaggagcccataaaattaaactacctcccccctcaaaaataaaataaaataaaataaaataaaaacacccacacccctgcagctaacctgacaactaccttcattcacagtgctttatacttaaaccaggatgggggaaatgaataaaagcagggaggggccactgcttttaaacgtttcacaacaatccagatgatacttctagcctctgctcatgctttatgacagtgaatcaggacaagacatagatttgctaatgtgcatttaatcaccaaaggactgaagatgtctgggcttttttattctgtaatgtttctaagactgtgtccattaaatgcaaacaaagaggaggaagtcttggcagaacaggagaagtgatgcacacttgatgatcgtatcaatttaaatattattcatggcatatagcctagtccatgctctagctgtagacagaaacaaacatacgattattattttacttagttcaatatgttactttccaaactataaatggcaaacaaccactattaattatggaaatgtcatgctgtaatctgttaaattcacgcctttttctataaattggatcagggctgaaagattttgtaaatgtccaattaccaaaacactacaataaaattaagaagttctagaaaattcaagaggatgaatcaagttgtccatttctagatacacaattctccccactaattttcttaaaatctgtagcagaagcttcttgactccaaattccgtagccataaacagctgaatactttaatcaaatgggttacaaaaacagttcaagttttccagtattctttacatataactagataaatggtatgcactcagtatttgttaaaccaggtgtagttacaagagactccaagatctttcaattacaggttgtctttatatttggggggtcccatagcaagccattttgttaagacgtatttacatactataagcaggatctcacttattatacttttttctatttcttttccttgccaagagctttagaaaagtttaagtggtaatacaaatttgtaaaagtggaagtggtgtgaaggagaatgaatattagatacctgtttctatggcttgggcttcgttggtcttccactgctccgctacatcatttgctaatggatcatctggattgggagcacttaacaaggcctggatcgatagcagaactgtgcggatctgcagtgctggggaccacttatctatgaaggcaacaggcccagtatgataaagcatgaaaaaaacaggcccagaactgcttcacttccctcccacagacctctctgatctttgtataatgtttacattctaaacatggaatgcttaagagaaaaaggagaaagcttaataatagcatatgctgataaagataacacttacctttcaaaatatctaaacatattcttcccaacttgtctacattaggatgataaattttggtcatgaaacgtactttaggggctgccattgggtattcttctggaaggaatagttcaagtttaaaagtccctccctcaaagggggaatcctgagggccagcaatgaccacatgaaaataacgggcgttgctctcatctggttcggctttgatgccaggaactggttctgccagcaaacgctgggtttcctatgacagaaaaacaaacacatttgtgaaacaaatgtcattttgctagacaccaaaagtaaaattagaaagttcatctcttagaactacgcataatagaacagctccaatctcccaacagatttagcttataaaatgcaaaattcaaaaaaataccatttaaataattacaaccagctgaatgaaactgcaagcgaatactaatgatgttatcatacattttggctacaaatgtctacaaatatgttaataaaattagcttaataaaactgattttttactcaagtaaaataaagtaacattaggattacataagtaaggcaacttgctctaaactcaaccaaaaccaagctatttaaaaagtaaaattagcttttttggtggttttttttggcttgtttgtttgtttttgagacaagatctcactttgtcactcacgctggagtgcagtggcaagatcttggctcactgcagcctcgacctccctgggcccaggtgatcctcccaactcggcctcctgagtagctgggattacaggtgtgcgccaccacacctagctaatttttgtatttttagtagagacggtatcaccctgttggccaggctggtcttgaactcctggcctcaagtgatttgctcgccttggcttcccaaagtgctgagattacaggtatgggccaacacactcggccaaaaattagtttttaaacccactgaaaacctcccctctgaaaaatgtaacggactaaagaaaggagataagaagaggcccaggtacctgaacaggactaaagaaatatatttaacaatgctgattactctaaaattgacaattaacttcagaggaacccttaatactcccaacaatcataccattagttctctttttcatcattctccctctcccctaaataattgtattattattatttctcttctctcttcaaacctccagcatctccatccccatcctcacttgtggctgatgtcctgcttcctatttcatgacaagttagatacttccatcagttcccactgtagcatttggacatttccctgcatctgcacccatacactctggtttttctcctgtatagatgaaatgtcacgtactcttggctagggccaatcggtcttgagcactagatcttactgatctctgaaatgtttgttcttcggtaccataaagaaatagcacttgaacataaatttaatttatttagtaaagccatttttacttcctgcagaaagggtacactcgccaggagttttgccacaagagtatactgaacaaaggagacagggtcatttataacctgacgcgtccaccctactgctgtgtccggtttccactggctggaacgggatctcacattctgtatttgtcctgactggctagcaacttagaactttttaaaagaggtaaaggtagaggggaacaaaggaaggaggaagtaacttgtggaatgctgagaaaggtaaaaacacttttaaataaggaagaggaacaggctatgacctaatgcttgcttggaccagtataagcatgccagggcaaatatttaggctaaattgtgggagctaagaacataaagtatattgatttctttattatggctagcaaatatttaagaatgtttgcacaggtcttcgaataaattttgcttctaagagaagttactatttattcctaattagatggggaggaaagtctttgaagaggaacctctactttgcttgtctccaatttctctcctcctcttctgtcttgaacataccctccaatcaagctgtagttatcgctaacttgtttgttaaggtcaccaatgatttccacaaggttaaatcaaatgtccagtgcttaatctttatcttacctaaatgcgacatcttatccagctggtctccttcctctttgcaaagctttatctaacttcctataaacattctcatggctctcttcctccttgtctggcagcagcttcctttagtttccttgttggtttcttctatctcccaacatcgcaacactgaaatgcactggggctctattctagggcttcctctctgtttatacatttccacagtgatctcatgtaatgcaatgaatttaaatactaaacacactctataagctgaagcctcccctaattcatatctagcccagacctctcccctcatcgtgcctcttgcctctataactacctgcttgatatacactcttgaatgtctaataagcatcccaaacttaacatgacctccctatccccaacctttgctcctcccataaagtcttccccacatcagttactggcaaacccatctttccaaatgatccaccttttccttcatatgccacacacatctagcctgattggcaaattggttttttttatacttcaaattctactcatgattggactgtttctcaccattccactgctacacctctgatccaagcaaccatcagctctgacctggcatactacaacagcctcctaacctgttcttcctgcttctgacctcactacctccctcgcaggtctattatccacagaccctttaaaagtcatagtcctgagccgggtgcggtggctcacgcctgtaatcccagcactttgggaggccgaggcgggtggatcacctcaggtcaggagttcgagaccagcctgatcaacatggagaaatcccatctctactaaaaatacaaaatcagccgggcatggtggcacgtgcctgtaatcccagctactcgggaggctgaggcaggagaatcatttgaagccaggaggcggaggttgcagtgagctgagatcgtgccattgcactccagcctgggtgacagggcgagactccatctcaaaaaaagtctgggcatggtggctcacacctgtaatcccagcattttgggaggccgaggcgggtggatcggctcaggtcaggagttcgagaccagcctgatcaacatggagaaatcccacctctactaaaaatataaaattagctaggcatggtggcgcatgcctgtaatcccagctacttgggaggctgaggcaggagaatcgcttgaaccccggaggtggaggttgcggtgagccccgatcatgccattgctctccagcctaggcaaaagagcgaagctccgtctcaaaaaaaaaaaaaaaaaaaaaaagtcatagtccttgtaatgggcccccaaaagacgctctatatgatgccctcactccacctacctctctgacttatcttcagctgttctctctccatcccctaaccttctctgttccagacaaaaattagcttccttgtagttcttcaacgtgccaggcatccgctcacctcaagggctttgtacttcctcttcctccccaagatatccatatggcttgctccctcagctcctaagatcttcatgttttctcagtgaagccatcataactgaaattgcaaaccccattcaaccctaccctgcacactccctatccccactccctggctttatctccacagcactactaacaaatctcatttctacttattttgttcagaatttaagctccatgagaggatggatttgagtctattttatggactgctatatcctcagcatttggaacactgcctggcacaatagatattcaattaatatttactgaattctgaatctatttgatgttatgaaaagagggaaataaacgatcagaatttcatcgttaacatcattaaggcagggttattttcaaggcaggatgtgcacattatggaaggaaaacaaaaggagccactcaggtatggggaaaaatagtctaacttctacttatatttatttttaaccagaaaaatgttcatatttaaataagcttttaggtatgaaaaacaataaatgagaacattttatttacactgccttcacctaaaaaaaaatacatcataaactgtttcattccacaagctacagggcatacgttaaaaacaacaacaacaaataacttctctctcagcacagtaatatactgaaatagtcataagatgtaaatacaaatcaaatgcttccccaaaatgtgttaattaaacccatggccattttaggtaatgtctctggtattttaagactagttttttgttttgatcatggcgatgtaagagcaagtgagaaactgacatgttctttaggttcaaactaaaacatttttagagtattaaaaagctcaagaggcaataatgaagcctctgaccttgggaagtcctttaacatgtgaccagaacaaaagaggctggtcttcattttttaggaaaaaagttaagatattagggatgaatagcaggagtagaaaaatgagaaaataactggatggtaaaattccttgaattctgggctctcctcacctccatcctttaattttaccccaggtcttcatgtttttagaaagccataaattgggtgactggaaaaaaaagaaagccagggcccaagagtcccaatccaccactcaccagttacacaaagtagtagcagctctgtatctactataaaaagctacagaaaggcctccaaaagcgtatcccaaaatagcttcaaaatcactctcaatacacagtggcagagataggtatggcatttactttctcatcttcagttcaccctcaaaatcagatattctttgtaaagaatgtacatattaagcacatcatgtgacctgatcaagcctagatttaattggaacacattctaaaataagctttcgtgtgtagaaaacattttgaaatagtccttataatatatgctgctctcaagttctaatggactgacacaaaaacatgcataattatttcactaaactgttggtttccctaacaaacccacagcataaactgtgggaggggaaaaaaggaataaaatccaaactaaatgaaacaagtctgaaatggcagcatctgaaaaagtctcaaccacagaaactgatgtcaacttttttcctaaaaaggcaaaaactggctaggaaataaaatctttccggccactattcaacacatgactaactaaaataccttctggttttacactattctttggtggaaagacagagtacagtatgatttctttaagtgaagaagtaaagggctaaaattcctactgtttcacttatctatctttttttttttttttgagacaagtctcgctctcttgcccaggctgcagtgcagtggcacgatcttggctcactgcaacctctgcctcctgggtccaagtgagcacctggctaatttttgtatttttagcagagacagggtttcaccatgttagccaggcaggtctcgaactcctgacttaaagtgatctgcccgcctcagcctcccaaagtgctgggattgtaagcgtgaggcaccacgcccggccttatctatcttttggcacaaataatttacattgcaggtgggatgccatggttcacacctgtaatccctgcactttgggaggctgaggcaggcaggggaatcacttgaggctaggagttccagaccaagctgggcaagcatagtgagaccccatcactaccaaaaaaaaaaaaaaaaaaaagttgacaaatgagatcacataggaaggccatagttgtttacagaaaaacagaataacccttaaatgaattttgtgattctattatgtttaaaagcagtccaaggattgaatcccaaacagaagtgagtttagggccatgcataatagaaagcactgtagactatgttcaggaaattagttaatgtagactatgttcaggaagttagttactaaaatagacaggtaagttggtaaaggaatagggtatggatttaaatgtccacaaaattaagtctaaaggaaggtatctcatcttatagaacgcatacaatagttaatgctacaaatatttttaaaaggaatcaaatatcacatcaaattgatctaattatcaacagatctactgggtcttgaagagcaaaccctagactcacactactgtaaactatactgtagttagtcaattataacaactgacattctgtcaacctatctctattaaccaggactcttatttttaagttgaaaaataatttgtgctcagtacgaagcaatgacaggtcttagatgctcttctgcaaggcaatgattggagtatgtacagtaaaattttggggtaataaacagtattcttagaaaaagtgctaatttgtgtgtgagaaaagttggtccagttagtaactatctatatcccagtgcatcctgtctacagtgattaggttttttagaatattctctgaaacacaaaattgcaatatatgaccagtaatatcaactgtagatcttttagctcatctcaaacaagagctgtctgataactcagtaactgccaatttcattactgaaaaataagtgttaaaaaactgagtgatgcttcaatgatacctactctgtaaactccaacctgtcactacatctttaagcgattctaaaatattaacaaacagggttctggacaaagttgtgtgttatagaaaaaaaatttaaataaagaaaaaaattatgaaaaatttgtaagataaaacaaacgggctccttttttgggatcactaataaagcaagtcaattcttcattatgtacacaactgtaagttacttatgagaatctgcaagttcaccctctatatatataagtgggcatttttatttatcactttttttgtagagatgggtttctctatgttgcccaggctggtctcctgcctcaagcaatcttcccgccctggcctcccaaagcaatgggatgacagacgtgagccaccacacttggcccaataagtgagcatttaaaaaatgttaccaccagcctgggcaacatagcaagaccccatctctgcaaaccaaaaaactaaaaaaattagctgggcatgctggcatatgactatagtcctagcgtacttgggaggttgaggtgggagtactgcctgagcccaggagttcaaggttacagttagctgtgatcataccactgcaccccagcctgggcgatagtgagaccttgtctcttaaaaacaaaacaaaacaaaacaaaaagttaattatcatcaatggacattttcaagtgcataccccttgcttcattttatctgtaagccctgtgaattttactacatgattttgtataacataacattcttagaaacatataatgtctcattatagtaaaactgactgcctattttctagctgggattagaaatagaaccaaagttttgctcaagctccccattacactacttccttacaaatcataaggccacctagagatacactaagataaaaatggctgatgagtacttttctccacagcactgctatccaacagaaatataatacaagccacgtaagtatttaaaaattttctagtagccaaataaaaaagtaaaaagaaacaagtaaaattaattttaatatattttatctaaaaatgtattcaaaatattatttcaacatgaaatcagtatgaaattaatgatgtattttatcttttatcatagccttcaatgcccactgtgcaaattacacttgtagcacatgttaatttaaactagtcatatttcaactactcaacagccacatggaatgattagtggctcccaaattagtctggagagtgaaacacaagacaatcatgttataatgttactgcctggtcattatgaataatttaatttatttcatataataggtaaaattttgtacagaaactttaaagcatcactattttcccctcaaaaaattctatacaaaaagtaatgtcaggccgggcgtggtgtctcatgcctataatcccagcactttgggaggccgaggcgggcagatcacctgaggtcaggagttcgagaccaacatggagaaaccctgtctctactaaaaatataaaattagccaggcctcgtgctgcatgcctgtaatcccagctactcgggaggctgaggcaggagaatcacttgaacctgggagacggaggttgcagtgagccgagatcgtgccactgcacttcagcctgggcaacaagagtgaaactccgtctcaaaaaaaaaaaaaagtaatgtcagaacatttgacatcactaataacagaaatgcatgtaacaacagttgctgtttgctacactcacaagattgtgtttgaaaaaaatttatggcaatttcaaaacacattaaatgaacaaaaattaattcaaacaagctaactgaatgatgaagtaaagagttcactgaggaactattttaatttttacagtacacactaccccctagtggacataagacatcatctacttatttcaccacctttcctttgcaaatgaaaaaactgatgctcttaaaagttactgtacccaagtttgctaagctttttaaacttacattatatgatcactccttgctttggtaaaaccaaaccaaagttagcacctacctaaacacgtccttgaaaaagacctatagattccaacagtaaataaaatgaaaatagcttaagaaaactaataaaagcaaaccaagcaaagctaagacaattttgtattccctttctgctttcacctcttgtgcctatcttgctcctaaccacttagactcccccagataagctaactgggtccatgagaatttcctgaaaatgcctatcctaaagtcaaatggagaataatgattctcaagacacacccctcccttgttctttcttttcccttctactcccacatatttaaatctcaaaatttcttaggtggcagattcagagaaggaaaaacggaagaaaaatctatttctaagattctgcgtaccaaagactaaatctcagagtactttagaccagagtattccttttttgggaaaagctttatttatgggttgataggtaacaaataggtaagtactctctattccacttgaagtaataatgaacagatggggccagatgacttgggctagaaatctctacatcctaattttttccctcaaacctagaccagatcaatatttctgtgaagctcagtgaaaaggaatggagacttgggagctggagggacttctgaaagtcaaagtatatataatctgagatacatcagaatgtatctcaggtctgaattagtctaaaagtttctcccttgtacttccagtttcctgttcattaccacctctccacttactgtaactacgcacaataactgctggtttacttctcagaccctaaactatttgaagagaggaaccccagctagtaaatggtggtaaattctaaataaatgcttgcttggtgaacgaacatctgcaatgcttaggtaccacccagagctgatgaggaatactgtatctgctgtgttcattggtaaattccatctcaggaacagcatttaagattattccaatcactgacaatgacaatggacaaaaatcagaataatcctactaacaaattgtcccaccaagaagaaaaactgttaagctgaattcctttatttcttgtctatcttgcctccccaattcttctgcccactaaacacatcaggttgtattatagtctgtgtatattttcctccccaccagtctgtaagccccataaaagcagggaccacatgcaattatcaagcactgtcccagatatacagagaatcaataaaagaaaatctcgggtaacagttaagaacaaactatgccaaatactgacttaagtgctacatatgtattagctcatttaatcctcatactcattttacaactgagaaacaaagagtaatcgaccaaagctagtgaatgacagagtgaagattcaaatccaagctgctgggctctattcagtctggtttcaggatgtgtttcttaatctttttctttcttttttttttgggggggctggggggacagattctcactctgtcacccaggctggagtgcagtgatacaatctcagctcactgcaagctccacctcccgggttcacaccattctcctgcctcagcctccagagtagctgggactacaggcacccaccacctcgcccagctaaattttttgtatttttagtagagacggagtttcaccgtgttagccaggatggtctcgatctcctgacctcgtgatctgccgggcccggcccatgtttcctaatcttgatggtatacaataaagacaattaactacataagcagtaaatgtctaatgtttggcagggacagtaaacagcacgggagttaaaagggctattttcaacccttcataatcgtgaagtggtgcttcatgaaaaaggtaaatttaagccataatgtcataaatttttttttctttttgaactggtaaccagaaaagtatagtcttattaagataaaaataggaaaaaaactgatttgattgaaaaattggtatatactattttgacttggaattatcagatggtaaaccattttgcctatctttgatagtgcatgagatcaacatgctctaaaatgtttcgtgactttgaaatataaatttacttacaaatgtttactcattgctattttgttcatggcattgtggtattaaataactggaaggaagagtaaaacttcttggcatccagcagtttatttcattgtgagtagtcaaggtcttaaggtacaggaggtgtgagttaggatactattaatatatgaagagcagaaccagattacagggctattatgttcttgtttatttctaaagacatttttaaagttttctggaaagattaaaaacctcgtctccatcttttttccctctttgttttttcaaagatttccaaatattggcatcacagctaaagatggtgtcaactattccttcataaaacactcatgaagttcttggtggtaaaaatgtcctttgaatattcagcactataattagtagactcgtggcagtcaagcatctccattttctatggttcctgatttgatgaatgacataacacttcattgcctgaacttttcttagcaccagctcaaaaaataaaaataagactttagtgatttaaataatgtagctgtctatcttaatgaactctgttatctcaggaatgatttgacagagatgtctcagaatgctgaatgaaaagaaaggacctagcttagtaacacagttcattgggactgctgtgtgccatggtcctcgaggcactattaacaaacctattgcatattttaggttctgggagtgggtatataacttagtaggtgaggtaggaaatgttcttctgtattcatcttgaattaaaattagggaaattttttaaaagcctgttttatgtggtgaacactaaaataataagatttattagcaaaaaccagtgaacttggtttttttctttgatccagcttttatgtaaaaaatgatgtagattgtgggttttttctttcataaaattttacttgtttttttcaagttggtaattcatttcaggcccttatgtgtaattttagtcatttgtctatgttaactattaaacaatgttaaaaattcccccactcattcatatgttcctttagctcccactctttagtataatgttggagctgggagataagaaaattgtaaaaattttaagtaacttgtagaaaaagaaaaacttacccgtggtcacacaaaaggactgcctggaagcatttagggcaaaatgaggttggtagtatgcatccagcacttcttgcgcatcacaagcaaagaaataacccattctggagagaactgcagtagttaccactaagacagcagcagagttctagtggtagcattctgcgcttgacatcaataatcacaccgcacacactgtagaatgtgttgcacacagtgtgagcactgaaatcatcgtgatgtgattctgaagtttgttcctggctccctcttttctttggccctcctgaagaatgtgtgaggtaactaataactcttaatatcatttctgcttaaactagccaaagctggcttctgttggttgctaaaatgaagtctaaactcaataggaaaggaagtgaagaaaaggttaagagttagcagaccaaggcaggagggggttgggggctggtaaatacgttaagaagctaaataactctttgggattaaatgaagtcaaaagaggagagcatacaagtcaaccaatctctttatcaaagaacttctacttaaaaccttttagaggaggagctaatttcacattagacagttaaattcaactaagcagcctggtgtacctagcgtggggagggggaagaggctcaagagttagcacatctgaatttaattccaattttaattgtaccaatgtgatatgtgaccacagacaaatcatttacctctccagccttctaaaatgtcccttgaacatttaaaaggttctctatagcaccaaaattgtctgaatactttattattattagaatgagttgaatcttattgctatatgcttctttctactggaaggtccccttttgtaataacattctttaggcctataattactgttttagtcttccctgctgaaggagaaggatattatgaactgtcatcctggtatttatgccaacgttcaatatctaaataaagagaaaatttgttgctaagggcacctgcttttttcccaagtttttttcacttgctcattaaagaaatacataaaattaatctaaataaaattagccattctcctaataaccaaaatccaattaacattctagaatgttttttgttgttgttgttctgataaagacaaaagcccttaaaaacagtttaatatgtttacattttttcactcctgtgtcactgcagccactttcctcaaggctagttgatttacagacaaatcaatattctttaaaaaccatacggcataaacaggtacttttcctggcctacaagctagtgactatactagtatagctaccatgtatttacttactcgaccctttttcttcaggttacttctggtttcaaatgcagcaatcacaacaaaatttaatgcctgaggactccataataggtaaggcaagacaagaacagatggaagcagagcagttgaacttttcagcgaagcaaacaaaaaaacaagttacatttcgctcagatttgcattctcaatccaattgtaccagtaacacaattttgtataaaatccaaaccatcaggaaagaaaaattaaaacagtctttcacactctgcatactaactctgagataaattaggaaacatgaaagcatgcagatattggagggttgtctcccacacagtaagcatcctctctcagggctaaccataccgcacagcttcaggagaggaccattcgtatgacagtctgcataaatggcgcctcttgaagttatacagtgaaatactttggattaaaaaataaaacttcaatttagcagttgcaaagatcaactttattattacctaacccatggaaaatggattacacatatgataattttaatgaaatcaaaatgttatttacccaaaacatcccattttgctatccactgtcggtaaatgagcattcattgtgctttcacaaaatctatgcctcacttcagagagttatatttaatgttatctattttgtgaaacaaatacataaatgaactttgtttcgtttatgaaacgaacaaaccattttcccacacactaggaagacattcaatctttttatgtttatggtgaagcagcatctttgcaaagtcagaaaacagtaataaccaacactacataaggctcagtattacgttagggtctgttctttacattctaatccttccaattaccatagagctagattagtatattaagcagataaagaagcagagaggtcaaatgaggttgcccaagctaatatttggcagagctagaaatcaaactcaagagtctggcctcagattctttgttcctgccatacataaacatacatttcatattccctaaatcagtgttttgctctagagaattaggaagtaaggctctctgagccataaaacattattttagtcatgaaaagcagcatttctaccatcttgaaagtcaattgtcaattaagaggtcagcaaaagactacagtaggaatgaaccttctgtaagccatcccttacacactttgctaccttactgtctctccaactaaactagttcctagagatcaaggcctgtgtctaacatttgcagacccaatgttggacaccagtgtgtcttgcatttcttactggttaatgaacagatcaactgcagaactacctgagaccaaccccacagagtaaggaaaaccactgactgggttaaaaggaaattcaagaacttccaaaaatagtaggcctagccaagcagtgactgcaaagagcaggagtatgcagaaaaaaagacttgcaagactccaaaccgaatctttacaaactatttcacacgtctgtccaaaagccttagctttgacactattcctacaggtcatacacttaaatggaccaattacgaagcaccagagataccagccttatcacttcttttgcccctctaggcagcttcaacaatctaataagcattttcctcaatttaaaaaagtgatcattgcctcaataatcacgagttgacatattaaagatgattctttcccctacctcaaggttttgggaagaatctgaaatgaaacagcttggttagggactttaatatttcacagattatcaattaggtctgaaatttgaacagtcttaagagatccagctggagtaaataactcagcagattttttactcttctgtgatttcagattatctcgtcctgcactactaagccagaagaggaaatgatccagacaactcagattttaatgtaactgaaataagcacaaacttacacactagggctgatgtattacaatagagtacgatggacaataatactgggtcaaattcatccacttcatgtggacagcttgagtctccgaaagaatgcgacaatacattcaaagaacataaatgctggaatcagttcttgctagcaacacgagccagcaatgttattatgtgaaactgcatccaaaaaaaaaaaaaaaaaagctacaaagtcataaaaatagccctgagaataactaatttgaatagtgtaagtaaacagttttcttgaggaaggaaatcgggtggctggaacacaggtaggagacaccctgcaagtcaaacaagcttaatcaaaacaagagctaaaaaaaccctataaaacccctaatctgacaagtctgaagtcaagccacatactgccacatctcaagggcttcttacccatccctatctatcctgggctgggccaggccaggcagttttctaaaaaatctctgccttaggaaactagtaagtcagatataaagtcaatcaatgtctctcactttccttctacacttttgtgattctggaggtaggactctgccaggggctcctagtttaagtctgcagataagggagtgttaagggaaaactgcgagagacgacagtgctgtctcccctctcatgggtgcatcagcagatttttttttttttaagctcatcggctatcattagtgttagtgtattttatgtgtggcctaagacaattctttttttttttcttttgtcgcccagactggagtgcagtggcacgatctcggctcactgcagcctctgcttcccaggttgaagcaattctcccacctcagcctcccaagtagctgggattacaggcgtgtgccaccacacccagctaatttttgtatttttagtagagacagggtttcaccatgttggccaggctggtctcgagctcctgacctcaagggattggcccgcctcagcctcccaaagggctgggattacaggcgtgagccaccatgcccagccatgagacaattcttattccactgtggcccagggaagccaaaaggttggaaatccctgttctaaagcaatgcaggcttcacatgtgactagttttatgagagccaatacagattacctatctcctaaaaattctaccttgcttcccttcagcactatcactttttaaaaggttttatttagaaaacacttcaggtaaaatatttacaaaggaatgaagtactaatacatgctacaatatacatgaaccttgaaaacatgctaaatgaaagaagccagaaagaaaaggccacatattgtataattccatttatatgaagtgtgtacaataggaaaatccatagaattggaaagcagataaatggttgccaggggttgaaggtagagtgactgctaatgagcacagggtttttctttttggggtgacaaaaatcttctggaattagcaagtgatgatgttgtactactttgtgaatacatgaaaaaaccactaaactgtacactttgagtgggtgaattttatggtatgagaattatacctcaaaaaaataaatgaagcatttgagttttccttcaatattcagtgagattttggaatcttaccgatgaattagagattggaatagtaaaagtaagtgaagggaaaataaatatctattacttgactatttagtatataacatattcacagcatgttaacagagttttcagttttttgagataggatcttgctctgtcgcccaggctagagtatagtgacacaatcttggctcactgccgcctcaacctcccaggctcaagtgatcctcccatttcaccctcccaactagtagctgggactacagacatgtgccaccacacctggctaatttttgtatttttttgtagacatggggcttcttcatgttgcccaggcttttctcaaattcttgggctcaagcaatctacttgcttcagcctcccaaagtgctgggatcacagacatgagccaccgcacccagccaacagaaattttagtaatgaatatatattcatggactacacttctgaagaaaagaaacttcaagttaaaagattacttttgaagctaagtatctgtgatccaagcatagacatgctgactcaagttacacagtcttagttcaaatatctcctgggtctggtatgtcgacattctactcccccttttctacttatgcttcaaaattcagctcaaatatcatcctctaaaaacctttccctaaaccaaccttgagggttttccaggccagtctgtcacttctttggtgttcccattgatgcctttgtattcaatatacaaagcagtgctagctgtatgattttacttttgtctcccattctacccatctttgcattgaagccaagcacacatatgaccagtgtttctgcaaagtgtacactaaaatcataagcagctcttaaaacaacaaaaatatgttgggctggcaatgttaaatttacaaacttccccagataattccaatgtataaccatgaactaagtactcagactagaaacaagtgttcagagaaaatagcccatagattcttgtcttggcatccttgccaatacatcagcagccctgccaattaaactaggagaagaaataggcaaggtctggccaagtacttctctaagcacagtcagtgctggcccctgaacagaacttgcagcacttttagtttaacccttacctgaaccacaacaataaagacagggtcctggacagtgcactttatttgaaaaagtgtaggccaggcgcggtggctcatgcctgtaatcccagcacttttggaggctgaggcgggcggatcacgaggtcaggagttcaagatcagcctgaccaacatggtgaaaccccgtctctactaaaaataccaaaattagctgggtgtggtggtgcacgcctgtagtcccagctactcaggaggctgaggaagtagagctgcttgaacccaggaggcggaggttgcagtgagccaagatcacaccattgcactccagcctgggcgacagagggagactctgtctcaaaaaaaaaaaaagaaagaaagaaaacacaaaactcaacttgatatataaatgaatgcaagataactctaacatatttttagacttactgagaaaaaaaattctcgtttaaaattagtctgattcagtggtactttaaatacagtcatgcgctgtatgagtttcagtcaatgatcaactgcacaaaagacagtggtcccacaacattataatggaactgaaaaattcctattgcctagtatttactatactatacttttattgattattttagagtgtattccttctgcttgttaaaaaaaaaaaaaaaagttgactgtaaaacaggttcaggcaggtccttcaggaggtattccagaaggcactgttgtcacaggagatgacagctccatgtgtgttactgcccctgaagaccttcgagtaggacaagaggagctggaagacagtgatactgctgatcctgaataggcctaatatgtgtgtgtatgtcttagtttttcacaaaaaagtttttttaaaaaagattgtaagagaaaaaagcttataggatataaagaaaatatatttttgcacagctgtatgatgtgtgttttaagctaaatgttaatacaaaaaaatcaaaagtttaaaaatataagtttataaaataaaaaagttacagtaagccaaggcttattattgaagaaacattttaaaaaattttttggtgtagcctaagtgtacaatgcttataaagtctatcgtagtgtacagtaatgtcctagcccttcaaatccactcaccactcactcacccagggcaacttccagtcctgcaagcttccttcatggttaagtgccctatacaggtataccattttttatcttttataccagatttttactgtacctttcctattttgatacacacatacttaccactgcattacaactgcctacagtattaagtacagtaacatattaaacaggtttgtagcctaggatcaacagactatacaacatagcctaggtgtgtagcatgctacactatctaggtttgtataaatatactctatgatgttcacacaatgatgaaattgcctatggtgcatttctcagaaagtaactccatcgttaagtgattcaagactgtatattttgccggtaagaaagagcagcaaagagtcccttctcaccagaaccacaaaattcctcaaatccaggactggctgggtggggagggggaggaaaagaatatgccatccagaccagaggcattccatcttaaagtgaactatgttactaaacagggtctcatgtttgtaggaaagcctctaattaaattacaataaagagacttctgattaaaaaaaaccaagaaaagcggcaggctcagtggctcacgcctgtaatcccaacactgtgggaggctgagacaggaggatcacttgagcccaggagttcaaaaccagcctgagcaacatagggagaccctgtctctatgtaatatatattatatatgtatatatattttatattgtacataatatatattttatatatatataaaaaatttttttaaattagttggggatggtagtgcatgcctgtgatcccagctactcgggatgctgaggctgcagtgagccatgatcatgcctgggcaacacagtgagaccctatcttaaaaaaaaaaacacagccaagcgcagtggctcatgcctgtaatcccagcactttgggaggccaaggcgggcgaatcacaaggtcaggagttcgagaccagcctggccaacatggtgaaaccccgtctctactaaaaatacaaaaattagccgggtgtggtggcgggcacctgtaatcccagctactcggaaggctgaggcaggagaatcgcttgaacctgggaggcagagattgcagtgagccgagatcgtgccattgcactcccagcctgggcaacaagagcaaaactccgtctcaaaaaaagccaaccaaccaaccaaacaaacaaaacacaacccaaaacaagtaagctaagcacttagatcctgttcttaaacatgtttccacttcatgtgtccaaatgatacagtataaaaatacatgcactgccagttattatctaggaatagacatgttcttcagtatccacagtctacagaatcagaccacctgggttcaaatcatagctctagaaactaataagtccctctgtgcaggttcccatagctataaaataggaatgatactaatatccacacatcataaaactgcaattagaattaagtaaattaatgcacgtaacatgcttagaacagtgcctggtacacgatgccaatgaaagatgtctatttttacataataaaaactatatgaccaacctcacttcaggaacagctgccacactgcatgctagtgaatagttcacagactaaatatgaatttcataattagaaacactttgtttgcctaacaattcttgatgccaactctttgaacacagtcattaaacagtaataattatttttgatgagaccctgattctattatccatcacatactatatttctagatgatgccatgctttctgtctctccttccagctttcatatctgctgccccatgtgccaaaaactcactcacactccctccttctcttggcccagcaaactcttactcttcaagtttaaaaacacttcctcggctgggcgcggtggctcctgcctgtaatcccagcactctgggaggctgaggcgggcggatcacgaggtcaggagtttgagaccagcctgaccaacatggtgaaaccctgtctctactaaaaataccaaaattagccgggtgtggtggcgtgcacctgtaatcccagctactcaggaggctgaggcaggagaattgcttgaacccgggaggcagaggttgcagtgagccaagtcacgtcactgcattccagcctgggccacagaaatttgtttcatgactgtgttttccattacacagggatgcctttcttgttcacctggcttactggtaaatgcatattatgcattcaatgaatgtccaattaattgaactgaaaaaaaatctcatgaatggataataaagagacacgcaaatcacaaggttacagaaaactgaaatttggccttgggatcggcctatgttactaaaaccactttgtccctgcctcatagtaagatggtaatctagttgtctttaagagtcacaaaaaaaaaaaaacaaaacaaaacagctacttactaacattttcccgagtataagctataatcttaagaaagttacagagcaataaaaaaatcaccaatggtttcatgatataaatttgttagttctttctagtgtttccttaactacaatgccttcaatccctagaactgtaaagactttcaaaatataaattcatttgcccaaaattaaccaaactgacagagacataatgtgaaggtattgaaaactaaaaaaaaaattgaaaatctaaagacaacatagccagttgttttaatgcaaaatatgtcaaccttagattctgaaaccagtatctaaaattactttaaattacagtagaatcctaattattcagaagcatctcagttactggccaattcaaaaccaaaaatgtctgtgcctaagtactcaagaaattttagaatagcttcattcaggtttttttttttttttgagacggagtcttgctctgttgcccaggctggagtgcagtggggtgatctccgctcactgcaagctctgctgctcccgggttcacaccattctcctgcctcagcctcccgactagctgggactacaggcacccaccaccacgcccagctaatttttttgtatttttagtagagacggggtttcaccatgttagccaggatggtctcgatctcctgaccttgtgatcctcctgcctcggcctcccaaagtgctgggattacaggcgtgagccaccgcgcctggccaggatttttaaaaaatataaaatgcccccaatggtgtcatgtagcccttgaaagaatgaataataatgaagtatttctgttgattctgagggctcttaaccaattatccagttcttccaaccacacagtcatgtttctgccacaaaagaccctagggccatcaatcacttcacttgggaagaaattttaaaagctgctaagattttagctgaagttaaaagattccctattatttaattgcctaattggtatatccacattcattccttcatatattacatttgcaaagaaaatttcaactctaatgaaacaacagtccaactcgtttttcgcatacacacataagaattcttttccttgatataatattattacataaactatgcctctcatatttattttgtttttagaaagcagcactgtataagatacgaatttggcacctaaatcagaactctgattactataattgtaatgtcaaaagcccctgctggatgctgctgtcctcatttccttgtttctagtatttatttctatagcacatatgcatccatagttcattataacagaaaacataatgtgtgttcagaatccatacaacttgaatctgtagcatattttcttcttaaatccatttacacaggtaaactatcctataaggtatagggaaaaaagaagaagaaccgaattgtacatcaggaatctggtcatccaacttctttggcctacaaattcctcaccagagaaagaaaaggatagaacagatgttctctaatgtgtaaaactctggtggctcactcccgtagtcccagcactttaggaggccgaggtgggtggatcacgaggtcaggagattgaaaccatcctggccaacatggtgaaacccgtctctactaaaaataaaaaaaaattagctgggtgtggtggcgcgtgcctgtaattccagctactcgggaggctgaggcaggagaatcgcttgaacctgggaggtggagattgcagttagccgagttcgtgccactgcactccagcctggcgacagagcgagactccgtctcaacaaaaaaaaactctggttttaagagtggtcattaacacgtgtggaaaaaattccaaacttgagcaaagcaaatgcataacatttccagtcacagtcatttagcacagtgaatactaaagtacttgataatttgacaaaacttaatttcacttgtgcaggagttgatcaatctggactaaaggaactgcttgacacagaggagcttaaaaaagaatactgaactgactgctatttttaacttactttcagttatgctcacatttcataatcaaaacattagatagtatattaaaacagtatctttagagcctgaaagtttaatcactatcaaaagcagttcaaggattcttaacatggagcacatggagacctagggaatccacaaataaacttggcaagaatctgaatccccagaagtcatacgttaaaaaaaatagctttttttcctaggaagaggtcagaaaattcttaagtgagacaactgaaagaactaaagaaccactgttcctagtcaaattttttacaagttttttcttaaattccaaaggtgattttaattacaacttataacaaatctgtcttcatcataatgagtttgtatttatttatttatttatttatttatttaagagacagggtcttgcctctattacccaggctggggtgcagtggtgccactaatagctcactgcagccccggcctcctggattcaagggatcttcctgcctcagtcttctgttaggattactgcatgaaccaccatacctggctaagtttccctgcccccacctggaggtacatatatttctgaaacatcatggtaacttttccatgcctttttttaattggaagaaaacattatcagacaagtattttcagagcttaaaacaacagataggacaggcgcggtgactcacacctgtagttccagcactttgggaggccgaggtgggcagatcaccaaaggtcaggagttcgagaccagcctgaccaacatggtgaaaccctgcctctactaaaaatacaaaaatcagctgggcgtggtggcatacacctgtaatcccagctactagggaggctgaggcaggagaattgcttgaacccagggggcagaggttgcagttagccgagatcacgccattgcactccagcctgggcaacaaaagcaaaacttcatctcaaaataagaaaaaaaaaatgttcaaggcagagagtaaagctactccagtggctgaggcaggagaactgcttgaacctgggaggcagaggttgtagtaagccgagattgtgccattgcactccaggctgggcaacaaagcaagactcccgtctcaaataaataaaaggtgagttttctaaatcacttttcttacaaaaaaaaataccttatgcactagaatacctatcaaatgagtggcttttaaacagtaacaggaaaaaatgtgtgtacttcaaaaaatcctattaaaaaagtaaactcaagtctcaatgtaaaatcagactgtatctgatttttaagaatttgaggctaaatcacaccaaatagaagagtaaatttttccactgcacttcagcctgggtgacagagaccctgtttcaaaaaattaattaaatgtattttcttaagtaaatttttaagcaccatagacaagggaccagtggggaagggagacataaagtaaattctgcgaaagactggtaaaattctaattccagcaggttgactcactaggttttaatcaaataagtcaacccctagggtaagttaactactttttcccaagactgtattttatcattttcattattatcattattactattttgagacagggtttcactctgtcgcccaggctggagtgcagtggcgcgatctaggctcactgcagcctcaacttcctgggccaaaccaatcctcccacctgtctcctgagtagctgggactacagatgtgtgccacaacacctggctaattttcattttatctttttgtagagacaaggtctcattatgttgtacagcccagtcttgaaaccttgggctcaggggatcctcccgcctcagcctcccaaagtactgagattataggcatgagccacagtgctcagccctcatgattaattctgaaaagaccattaaaggaatgtcagtcactgtatcaacgtaacatgtaaagctgaaacagatttggttttgaccaaggccataactatagatctcacttatcggttcccgaaagtgattctcctttatgacaggattatgcagaacctctcatttgagggacattttaggtacctcctaacctttatgactttaagctttaactgctcacttttttttttttggtggagatggagatctcactatgttcctcaggctggtctcaactcctggcttcaagcaatccttgggcctcagtctcccaaagagctgttattacaggtgtgaaccaccatgcccagcttcagtcacttttattggctaaaagagctttggtccagaagataaggcagaaaaacgaaactaaagattctagcttaaaacagaactactaagactcaatatcactcacacttgtgcaaaatgccatacatacaaaacttcgttacagcattttttatatagcacaatttaggaaacattctgaaagttatgaataagcaattagttacaataaagtctaggccaggcacggtggttcatgcctgttaaccctagcactttgggaggccgaggtggaagaatcacttgagcctaggagctcgagaacagcctaggcaacatggcaagaccccatctctactgaaaaagtattaaatttccaatatttgaaaaaataaaataaagtctaaccataaggttccattaaacagccctttgagaaaaaaaaaagagccaaagcagaacactatgatgcatgtctgtaatcccagatactggaggctgaaggtagagatcacctgatattaggaattcgaggctgtatgtatatagtgtactatgatcacgcctgtgaaaagccactgcactccagcctgggcaacaaagcagcagtctgtctcttaaaaaaaaaaaaaagtcaacttgaagatacataggtggttagaggggaagagaagggaatcaaggtatttgcatgagaaggagaagacgcctaacttatagcagaaagttgctctggtcttcttgtaaggatacacaataaaaatagtggttgaagtcgggtgcagtggctcacacctgtaatcctagcactttgggaggctgaggcaggtggatcacttgagaagaggagtttgagaccagcatggccaacatggtgaaaccccatctctactaaaaattagccaggtgtggtggcacatgcctgcagtctcagctacttaagagactgaggcaggagaatcacttgaacctgggaggtggagtttgcagtgagccaaaattgcaccactgcactccagcctgggcaacagggggagactccgtctcaacaaacaaacaaacaaacaaaaacagtggttttctaagcaggggaactggaatgctgaaggacagatgagggattctctacgtatccttcagagcctttcaaatgtgctctatgtgtgcatttcctagttaataaaaaaagatacataagcagagtaggcacacaaaaaagaaataatgtaaaagattgatgtcctttttaagtgagcttatgggtggaaaacgagactagctttaacttttagctcagacattggttcagacagaatataccaaggagtaacaatgtcaaattattgctcattgagattaaggctcatctattcagttagtctattaatatttcagtatctactatgtgccaaggattggtctaggcacgaatgagcaatgcccgggatatccaagagtccctaacttcatgaaggtttaatggggaatagagagaaataaacagtaaataacataacttcgaacagtaataagcacttatacagaagaaagggagataggaggataaaattgtgggggaggaaaaagggaaactggtttatacgggacaggttaggtagagggtatgacatatgagctaagaacggaacaactggacaaagcaagcaatgcaacaaactggaggaaagtcctgtgactggaataagctcaaccacttattgttcagggtacagcaaagcaacagtgtggctacagtggagtgacccagagagagaagtgcagatgcgctcagaagtaggcatcccaaatgaatgcagggccttatagctaaggggtgggggggaaggcaagattctaatgtaagtgtgatggagaacctctacagtttttagcaggggagtaacatggtctatattttaagaagataacactagctgctgctccaaagtaggctaatacaggaggccaggcagtaaatgatggaagtgaacagaggtttgaaagacaggggggaaagtgtctgatttagtacatatattgaaagcagaacctacagaatttgctactggattagatacaggaatctaaatgagatagcaactgggtgaatagtagtccagaaaatcatcttgtatttgtagttagtcattttacagtaacaagagacaggggaatgttacactaatcaagatccaaattctgcctcttaccagctttaccttaggaaagtcatttaagtcagtttctagactgcaaaatatattgtctagttcacaaaaatgtctgtaagaatcaaatggttaagaaatctacaaatgtaaatagtgatcattataagttagaaagcatcatattaacagtcatgcaaatcaagccaccttattttaacattttcattagatgagaatgctaacactgatgttatatcaacactaaatttcatcctttgaaagtcaaaggtcaggcggggcacagtggctcacgcctgtgatcccagcactgtgggaggctgaaatgggtggattgtgtgaggtcaagagtttgagaccagcctgggcaacatggcgaaaccccgtccctacaaaaattagctgggtgtggtggcatgcaccttgcagtcccagctattgaagaggcttaagtgggaggatcatctaagaccaggagatcaaggctgtggtaagccatgatcctgccactgcactgcagcctgggagcggagtgagacgagtctcaagaaaagaaaacagaaagaaaagaagaaagtcaaagatcacccagaaataaaacaaattaacagtccaatcaacaaagtcatgtccctattgcctcaggacaataccgttacccccatccaccacacagaagtttgtatagtgattgacagaaaagaggcaacttttaaaaataaattctgattttttttaaagcattgtcactgattatggaacaacctacataacacaagcatggacacttttaaaaatctagtcttttagtcttctgtttaaggattagagaaaaccatccttttaagctataaatgacactaaactagtaagataaaacccaaatcaaggtgtcattcattagatagatgttgtcaacaagataccgtaaaattaagattatatatcacagtatgagttactgtcttagtttcaacagcaaaatgtaaatgcccagtgtaaattactgtgtgccaaatggattgaatcatgaggacttcaacttattgccttaaaccatttctgtaaatttataaacaaggttccacagaatttattttttcatccaaggctttcatattactgggcatatcttcataatcaaaaatagaaaaatgcgtgttaaatgtttagttcactatgtatttcagagaattatcatgaatgtcaacttgcattatgtacttagtcaataacctaagtaacaacgaaaacaaggatatttgatgtatggctctatcactccctattcatttttcaactggggcctcaataaacatgacctttggggaccatgtgactgcattataactaaaaccacgttgtacggacctgccaatacatatgacaattaaaactccttggacagaatcctagataaatccacacacaacaaatttcggactatgaagattcacattattagactccagtgctccctgacaatctgttctacttctctcatttctaagaatttctaccatacaaaaacgtcttatttctctacatcagcacccttaggtcagtgacatctccctcatctcagatatatttaaatgcaattggatgaagcagtatacagtacatcatcctcgaagcctaacaggtcttccacttagtatgcatctccccacagatttcacaagaatgagcaagattaacatacacgttcaccaggttatatcaagcaaaatgatgctgcaattgagtcactttaactggcgcatttagtcacataaatgtgcaactaatttccttcataaaaaccgacacaaaaatttaaggtttagttgttgtgatgacaaggaatatctcacgtctgaagacttgtcgatatttccttaagactttacaaaatcaaagaatcgaaaatgtcatggttccatacatacttgtcaaaacacagtattcataaacagccaattaataattaaaacgcacaaaattgaggggcaaaagatttcacgagatcccccacagaggccaaggtaggaagatctctgaagccaggagttttggaagccgcctgggcactatagcgaggcctcatatctacgaaaaagagaggagaggagagaagaggagagagaaagagaatcccccataactgcggccctcccccagccttgtgttaaaactatttcctcggaacagctctgaaagagtttgccaaccagagtaaaatcacttcgcagagataaacgagcggaaacgtattcagaagagagagatcgcggaagcaagggcagcggggcgcggggcccccacgtcccgggacccaggcagccgcggcaaccaggggcgagcatgtgctgaccgcggcaggacgcgcgggcctcccagagccacttcccggggcgcagggccccgcccggcctgaccctcccggttcattcattctgcacccgcggttgccgcacctccgcggccccgtcggggcggagaagaggggcttggctgccgagggaccttgtcgggccacaatccccaccaggcgcccgagccccgccgcgattcccgcgcgcccgcggcctccggcgggggggtggtctcagaagctatggaggcccgcgcccaagcccagagacccccagccttgccgccccaccctccgccggggcgtgggacagcactccctggcccgccgggcagccgcctggaagccccgggtccccgctgtccggctgccccgccgcggccggaagtctccccggcgccccctcctcagcacccgacttccctcgccgccgcggccaacccctctccgcgccgcctcgggcctcccagagcgggccgcgggccgaaggaggcgagaggccgcgctgcctgcccagctgagccgacgagagcagagcgaagagctggaggccggcctgggcggttaccttgatgatcctgcggggcagcccggccatcttgtcagaacccgagttcggcctctggtctcgtctccggctcctctcgcctcacgcacgagtggaagtcccgggctccacttccgggggacgttgccgcgcccgtcgccgcagccgccgccgaggcccctcgggaaatgtagtccctgctcgggcgcgggctcgggcacgggcgggcttccctccgacctggccccctcccccgtgcgccccgccccaaccgctgccggggatggcggaagtgacgctctgttgcggggcagggacttgggacaggccgcgaggggaggcgcggggctctggcgctcgtggccgagcctgcccgcgacggtggtacggcacgacccgcgcgcgactgcgcgcgcg

SEQ ID NO: 308 - DNA, 36283 bp, Homo sapiens
  source 1..36283: mol_type = genomic DNA
gcagcgctgtttcgtgggaccaggattgaaacaagatggcgggttcgtggtgagaagccgtcaaggtaaccgcttccctctactcctcctgtcgaggacttcctcgaaactgggcagtcccacagtgttggtcggcagttgtagaggtctcccgcctgtcgttcccggcagggcgaggttgcctgcatccccagcctttgtccttcctgcagaagagccggcatgtggctgcgcgtttcttatagcgccccctttgttccctggcggacgcccgtggggaggtgatgcagcttgtggctctagggactcctttaggtcgaagagttctggtgctcttggtagcctgttcctcaaacctctgaccctcagaggctctgtagcttttgttttggggttgaattccgggctgagggacttgatctctgaaatgatcttcctggggtgaataatctgactcccagcagggcgtgcttttctctgggcttcggacagaggggacctaatttcccccaagatgttttattcgtggtcagaagtcatgggtttacgtcccacgcatgtattaagcagcgatatactgagcaagtaatcgattgacctctctgagcctttgttcttaatctgaaatggagatgctgcttcacacacttgtgaaagtcagagcacatattgtatatgaaagtgggttgtaaactaaaaagcacacctatgagctcagggttaacggtgttaatgtactggcagtgcaaggtatcagtgtgagtggtttagactagcaaataagagggcctgtgtcctaattctcttttatcactattggggggaagggcacggatactcattgaagactattaaaaacaagatttaacaatggttatttgtcatttattcacaacaggccatgaagattgtggttttccccattttgtcattggagaaactgaggatcgtttagttaatgacttgtttaaagtttcccaatttggcagtgactgactctaaagtccttggaagcaagacgtttaaattttgtactttagtttcttcatgaatcagaataaagatacctcacatgattaatacgagagcaaaatgaaatggtggtgaaagtacgttggaaagttaaagactttgtacacatataagatggtgaaattttatctgggacttgagggcatttatgagttcctccaattgagtaataggctaaggataggccttgtttgatatttctttattattattattattattaatggctcagggcagacaactatttcatttaatcagaaacaggatagtactgtaaatgatgtagtatcttgtgtatggaaccttggagggtgtacacagccacactagcattaaaagaatgaatactctgtgtaccatttgtgagtgactgtttcaagagtaattacacatttactgagtattcattaagtggaaggagctgcactgggtcctgcagagaagtttgtatctaagataaatagtaatggacatagttccagtggttctgatcttatattctgtccatgtcgctcttcgtcctgttgttcaatcatgtggaattgccaagttgtttaaaagcattgcttcagttgacttctaggcagtgattcttaccttgttcttgtggtgtttaatataacttaaatttaccataggtagcactgatttttctttatctcttcagcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaagtaagtgaaattttttttaatgtttaaaaacttttaaacttttaagaattaagaaaatttaaagcatttagttattgtatatgcctgtaatttgcaggagtgtttgcagcaatggaaagtgggagaaaacctaaatgtcagtcagaaggggaatggataggtcagatgtggtgtctcatgcctgtaatcccagcactttgggaggctgaggtgggaggattgcttgaggccaggggtttgagaccagcctgggcaacatagcaagacccccacctctaaaaaaaaatgtgggttggggaggggaatggataaattatggtacatctgaactgtgactgtcatgtagctgttactgacatggaaagatctccaaatagaaacaaaaaaagcatgtcagaaccacatctatatatatctatcatatgatcttatttgtatgtttaaaagatgatccatcatatgcatgtgtgcatatgcataaatgcagaggtaaaaggtctggaccaaacagtggttatctgtgtagcccactcttgggatttggctgagggcaggagtaagggactggtcaagggtaactttctcttgttcgattacatgtattacttttttagtatttctctcttttttttttttttaacggagtctggctctgtcgcccaggctggagtgcagtggcgtgattacttttttagtatttcttaaaatgtgcgaataaagggtaaattcacagtcccatcttccaaagataatcattgttaatattttggtggattgtcattgtgttttttctatgtacctagccatttttaaaaaaatgaaatgtaatttctgcctttcttttctaaagaactgtatatagttagtattttctcgaaagcttgttaatacatgtttgacagtcaaagcatggacccaaataagtaaatagagtattaaagtcttttttctcagccaactgtgctttctttttccttttcctgtctgtaaacagagtttatagctcttataaacagctcttataggaagctttccatttctaaagtagacatgtatagaaggcaacagtaggtttgcctttttatattaaactatgtgagccaactttttatttttattttttattttagattcgggcgtacatgtgcaggtttgttacgtggatgtattacatatactgaggtttgggcttcaactgaacccgtcacccaaatagtgaacatagtacccaataggtagtttttcaactcttccctccatccctccattctgttttgagtccccagtgtttattgttcccatctttgtgtccatatgtacccaatgtttacctcctacttgtaagttagaacatgtagtatttggctgtttttgcattaattcacttaggataatggcctccagctgcatctgtgttgctgtaaaggacatgattttatttgttttaatgtctgtgtaataatccatggtatgcatatacaccacatattcttccagtccaccattgatgggcttgtttccatgtcttcgctattgtgaatagtgctctgataaacatgcaagtgcagctgactttttaaatacaactctgcttgaccttgacctttgtctcttctttcttatttcctatttaccaccatttgtaattgaaagtttgcttattgaattagggagaaaagagctatttgaagaatggagtataagtaaagtaataaataggcaatttgttatgcttgagacgaggaaaatattttactcagtaaacacctttgttgaatagaatgctcaaaagtttgccagatcctactctattttattttattttattttttgagactggatcttgctcccaggctggagtgcagaggcatgatcttggcacactgcaacttctgcctcccaggttcaagtgattctcctgcctcagcctcccgagtagctgggattataggcacctaccaccaggcctggttaatatttgtatttttagtagaggtaaagtttcaccatgttggccaggctggtctcgaactcccaaccttaaatgatcctcctgccttggcctcccgaagtgctgagattacaggtgtgagccattgcgcctggcctaatttttgtatttttagcaggggaggggtttcaccatgttggccaaaactggtctcaaactcctgacctcaagtgatctgcccacctcagcctccgagagtgctgggattataggcatgagccaccgcacctggccaccaaatcctgctcttataggaagctttccatccctgcttccttgcttgccccactctcccattttttagggccctaaacatagaaacatttattacattatattcaaagtaaaatcaacttagaattcagtaaatagaacaggacattgcttaagagactttggatataaaccaaaataagtcacaacaaaactgcaatcagcttttgattatctaggagcatttttgttgttgagaattgggagaaagacccttactcttacttcttagattcctctttgccttgcaggaacccagctcctaggctaatgagaagtcacatccaatcagtttttacatagactatgttttgaaacaattagtcctcacacaggcccatcagaaaaccagttaatgtgtccctgaataattgaaaattatttatatatctttttccccactggatttcccactaagtttgtactggatctaattcattttggtgtccctggggcctctcattcatgataggagatctatcagtgtttgttcaagtaatctgaatggtttagagttaactctcaaaatatctagttaactaagaattaggttaccctagaaaatcattccattatcagttatcctaatactcagtgacctaacttcttatatccgaaaagtcccttatactgcaaagttcctgttgctactattattgaaagtaaagggctgggcagggtggctcacacctgtaataccagcactttggcaggctgaagcaggctctgaagtttgagaccaggctgggcaacataggaaacctcatttctacaaaagttacaaaaattagctgggcgaggtggtacacgcctgtggtcccaggagggagccagcttactcaggaggctgaggtaggaagattgcttgagcccaggagttcgaggctgtgattgtgccattgtactccagcctgggagacagagtgagaccctgtctcaaaaataaaaaattaaaattaaagaaagtttcattactgttattattgatgtttaataaaaaagggaaggacagtaagattggaggcaaagcgaaatcatgattaaggaagaaagttcagtgagcaaaaataaaaagccttccttatattctagaaggaatattttaaaatttcccaaatggtcagtcagcccgggagtgtagaacacttcacagttttcaaagcatgttaagccatttgatccttataacagctttgattttggtagcccatgtagtattatcctctttatgaaggtaaagaaacttgagttctgtggccctcataagttcacccagggtcacatatttggtaaacaaaaactgtgaccaaaatctggatctcccaccttactttgtcctgtatactttctactgtacttccttttctgtagcaaggtaaaatactgagcatttgaagatgggacaacttttagctttcatagctctttcaaaatgcaattaaatatatatatgtaacaagaataactcataaattacagaaattattgttaattgaaattcttttggcacattgagcttaattgctgttaactttggcattggtcctaattatatatttagagcttctgctacttctatatccagaattacttccattggtaaaatatcaggtaatgaatgtttccttatttttttttcaaggtgaagtctcactctgttgcccaggctggagtgcagtggtgcagtcttggcccactgcagcttcgacctccctgggctcaggtgatcctgctatctcagtctcccaagtaagcaagactacagatgtgtactaccatgtctggttatttatttatttatttatttttgagatggagtttcactcttgttgcccaggctggagtgcaatggcatgatcttggcccactgcaacctccgcctcccagattcaagtgattttcctgcctcagcctcccaagtagctgggattataggcatgtaccaccatgcccggctaattttgtatttttagtagagatggggttccaccatgttgatcaggctggtctcgatctcctgacctcaggtgatctacccacctcagcctcccaaagtgctgggattacagacgtgagccactacgcttggcctatgttttgtatttctttgtagagatggagttttgccatgttgcccaggctggtcttgaactcctgggttcaagtgatccacctgcctcagcctcccaaagttctggtattacaggcgtgagccaccatgcccagtccttatgaatttttcaaacatcagttatgcagaaacatttgagaggcagttcggcaatcactttttaatgtgtaggcactataggggacacagtaatgaacaaggtacagttcctggccttaaggaacttatttagacttgtaggtgaaacagacatctagcaacactaagaatgcccagaatatgaggcagaatgtgataagtgtgtcatgagggcacaaacaaatgtctgtgtaaacacagagtagaaattttactgagtttcttgttaactaaaatactgttgtcttgagttttcttgtctgcatatttcagaacacttaattctgtcacccagtcatgtttctttcagtgaaaatgtatatcatctagttggtttatattcagagatacaaaattgtttttttttaatttatattttttattattaatttttttttaatagagatggggtctcactatatgacccaactatgttgcccaggctggtcttgaactgctggatcaagcgatcctgctgccttggcctcgcaaagcgctgagattacaggagtgagccaccacaccccaccagttttaatttttttagaaacgattttgctctgttgcccaggctagaattcagtggcacaatcatagttcattgcagcctcaccctcctaggttcaagtgatccttcagcttcagccacctgagtagctgggattataggtgcatgccaccatgcccagttaatttttaaaaatagtttttaaagataatatctcactgtgttgcccaggctggtctcaaactcctggccttgagcagtgttggcctcccaaagtgttgagattacaggcgtgagctaccatgcctagctttataaacttcttttaatattaacccaatccatgcataattaggaaggtcccagtgatgtcaaacaagaaaataaaatatggccaggtgcagtggctcacactggtaatcccagcactttgggaggccaaggcgggctgggctgatcacccaaggtcaggagttcaggaccagcctggccaatatagtgaaaccctgtctctaccaaaaatacaaaaattagccggacatggtgggcgcctgtaatctcagctactcgagggactgaggtaggagaattgcttgaacatgggaggcggaggttgcaatgagctgagatagacaactctttcttctgtgaagaaccttgggggcagggagagtaaaaaggatttcatggaagaagagtgtttgacctttttttttttgagatgaagtctcactctcgcccaggctggagtgcaatggcacgatcttgtctcacggcaacttctgcctcccgggttcaagtgattctcctgtcttagcctcccgagtagctgggattacaggcatgcaccaccacacccggctaattttttgtatttttaatagagagggggtttcaccatgttggccaggctggtcttgaactcctgacctcaagtgatccacctgccctggcctcccaaagtgctgggattacaggcatgagccactgcgcctggcgaatatttgacttttaaggatgaggggtatttgaacaaaatggggctggaattccatactgaggacatggtaaaggcatggagatagggaaggcaggataggttacagttctatatcacaggaacaagaggctctgttgagactttgattcttggcattgaccaaggtgcattcaaaacttgcttttaactatattgagctacttttaaatttttttctttatattaaaagaatacccttttttgaacataggagaatctttcacaagcttttaaaaaagcagtttatagctgagcacggtggctcacacctgtaatcccagcactttgggaggccgaggcaggtggatcacgaggtcaggagatcgagaccatcctggctaacacggcgaaccccgtctctactaaaaatacaaaaaaattagccaggcgtggtgggggcctgtagtcccagctacttgggaggctgaggcaggagaatggcgtgaacctgggaggcggagcttgcagtgagcagagatcgcaccactgcactccagcctgggagacagagcaagactccgtctcaaaaacaaaacaaaacaacaacaacaaaaaaagaaaaacaattttggctcttgaatttgcaggtattctaaaaaaggaaaatatgctttaaaatgtaagcattttgattaagaaaagttaattttaaacaaatcatttcatatttcatcacttcaccaccaccaccccccctttataaactatgcaccttggaaaacccaaatactttatttttatttatttttttgagacagagtttcgctcttgcacaggctggagtgcaatagcatgatctcagctcactgcaaactccgcctcctgggttcgagcaattctcctgcctcagtctcccgagtagctgaccacgcctggctaattttgtatttttagtagagacaaagtttcaccatgttagtcaggctggtctcgaactccttgacctcaggtgatctgcccaccttggcctcccaaagtgttgggattacaggcgtgagccactgtgcctggccccagatacttcaagttctttcttggaaaggctggagtacccaaacacttttattttttttcttacctggagtccttgcgccttttactcactctgctagaaacattgttttcatctcttatcaatccttacttattttctcattcttcagagcaccttggacatcatctccactgaaaaggctttcttgaacctgcacaatttgtttggtagcctttctgtgtggcccatctttgccaatgtttaccattcctaacagtgcttatcctctatgttgtaattgtttgtctgtctctctcacaagcagactatacccttttgagggtagggactgagtcttgtttgttgttgaatccctagcccctagcacaggcctgtttcatactaaacagtaatgttggttgaatgagtaaaactagctttaaatttatggagaaaatatgctcaaattaaccaaatctgttttactgtttggggtttttgcagatggagctttatattgtgtttgtcataaatctacgtattctcctctaccagatgactataattggtatgtattaaaattcaattgaagaaataatagtcttagctatagctgaaatgatttaattttatttcttgttttgatgtctgatgctttcttttctcattattctttccttaattttgtttttaaaaattattttaatgattttatttacccagtatctgggcttataaacattttaaataaaaatcattgtcattgtgtttcattgaatatttaatttgttataagacagacatgctgtttagaactgctatcttttcttcctgaagcatgctttagctttttggaaaagttaattagtttttatagggttcatatctattagcttaagccattattatcttttcttttgtttgatattgaataatcctaaattatacatacttaatttagccaccatttatttggtacttattcaatttagtcactatgataagaactaggaataacatatgacattgtcttttttctctgcagcagagtctgatatgcagaaactgcaacctattttcttaatctatgttgtttttattacaaattataataaaaatattttttcttctctcttgacactagttttatttttattttgttttcgagatggggtcttgttctctcgctcaggctggagagcagtggtgtgatcttggctcactgcaacctgagatggggtcttgttctgtcacccaggctggagagcagtggtgtgatcttggctcactgcaacctccacctcctgtgttcaggagattctccagcctcagcctcctgagtagctgagactacaggcgcatgccaccatgcctggctaatttttgtatttttagtagagatggggtttcaccatgttagccaggctggtctcaaactcctgacctcaggtaatctgcccacctgggcctcccaaaatgctggaattacaggcatgaggcactgcacctgaccttttatttttgtgagacagagactcactttgtcacccaggctggaatgcagtggcacaatctcagctcactgcagcctcaacttctgaggttcaagtaatcctcttgcctcagccccccaagtagctgggactataggtgtgtgccaccacacccagctaattgtgtattttttgtagaaacggggtttcaccatgttgcccaggctggtcttaaactcctgagctcaagcaatctgcctccctcggcctcccagcgtacaaggattacaggtgtgagccatcatggttggccttttatttttgagacagggtctcgctttgtcacccagactggagtgcagtggcgctatgtcagctcattgcagcctcaacctcccaggttcaagctgtcctcctgcctcagtctgcccaagtaactggaactacaggtgtgtgccaccacacctggctaatttttttttattttttgtagagacaggatttttccatgttacccaggctggtctcaaactcctgagctcaagtgatccgccttggcctcccaaagtataaggattacagatgtgagctaccacgcctggccttgatactagttttaattgtacatctaatgagtactataatagcgatgaaattggaataggtaacagtttttgaacctggaaagactgagtcatataagtgttttgcattatataaaactatcttctcgtgaagaaatcgtttgacagattaaatgttcattgtagccatgttatggtattcaatcttgaaaccacggtgaaacaatctaatgcctattctttgttagctacaaatgtattttgttgtggtatttaagctgacatattctgtgggatggtcttcatttgtgtcctgtgttatgggtaccaggtttgccaatccagtgatgtagtatcttcagcaatttgtgattaattttagcttttatttatttatttatttatttatttatttatttttttgagatggagtctcattcttttgcccaggctggagtgcagtggcgtgatcttgacttccttcagcctctgcctcctgggttcaagtgattctcctgcctcagcctcctgagtagctgggactacaggtgtgtgccaccacacctggctaatatttgtatttttagtagagacggggttttgccaggctggtcttgaactcctgacctcaagcaatctgcccaccttggccttacaaagtgctgggattacaggcatgagccaccacgctgggcccagaatgattattaggccgggcactaattttagctttaggctggagtgcccactgcactccagcctgggtgacatagtgagagtccatctcaaaaaaaaaaaaaaaggtaatcattttgccttgaatacagtataactttatttctaaaacattcttttttttagcaacgtagagcttgctctgacttctgatggcaggacaatagtatgctaccacccttctgtggacattccatatgaacacacaaaagtatgtatgagaaaatttcttgcagtttttaatttgctgttagaaatgtttgcacttctttatagtatccaaaaagaagggagtcatctgattttctttgttttagattttcttttggctttttaattttactattttgatttttctcttatttatttttcatctgctttctttacagtcttttttcagaatacaaaatgaaccatttaaacacaattatggcatcagttttctggtctaaaaaatttggtagatttctggttaaggatcaaatacatctagtataaaattataaaatgcattatcccatgctaccccatattataatctagacaattatgagaaagttgtattttagagtgctgggattacagctacttttttactattggttctgacagtttttttttttttttaacatttggtgaatttctttatttttatgttttaatgggccaacataggtatatattttgaatggcccagttagatttttttccctattttttaaaaagccaagtactagatagaagaggattttgtattgtttttaatataatttatttttagtttgacccaagtctttttattgttttgtatttgaaatgctttttcctatttctttaagcctccttctactaggtaatgtttgatttgctttttttttgagacagggtctcactctgtcacccaggcaggagtgcagtggcgtgatccggctcactgcagcctccacctcctgggttcaagctattctcctgtctcagcctcccgagtacctgggactacaggcacctgccaccacgcccggctaatttttgtatttttagtagagacggtgtttcaccatgttgcccaggctgatctcgaactcctaagcttaggtgatccgcctgcctcggcctcccaaagcgctgggattacaggcatgagccaccgtgcccggccttgatttgctttttgaggagaaaattagatggtttaagtcatcacatgatgtatttagtggtacttattttgaaaaatcatcattagggtcagggtgccggttgatttgacaaataatttcttttctttttttttttttgagactgagtctcactctgttgcccaggctggagtgcaatggcgcgatctcggctcacagcagcctctgcctcctgggttcaagcgattctcctgtctcagcctcccaagtagctgggactacaggcgtgcactaccacacccggctaatttttgtatttttagtagagacagggtttcaccatgttgggcagtatggtctcgatctcttgacctcatgatccgcctgcctcagcctcccaaagcgctgggattacaggtatgagccaccgcgcccgacaaataatttctgtattcctttttaaactcaccattttgtctccctgctttgttaggaaacaaaagccaggtatcataggtactaattcagtgcctcttttttatcacttatttgggcaacgtttagaaaaataggcctacatcactgagttttggcctataaaccctccaggtcacactatgttgtgcctttgtccattgttattttgttaaatatcttcggtttatttgctgtgttttagcaattatactaagaatgccaggtcatttcatagcatccagactcttatccccaaatggctctttatatctctgaatctgaccctcctcaactgtcaaaactttcccactgtacttgtagaacttactacccttggcaaaatctcttacaatcttagcctattccagaatgttgccttcaccttttgactctaatagaaacctgcctgtaccctggagacgttacttccccagcagttcttttaagtagttgctgttttctctcgcatactcttttaccactgggtctaaagatggggaaggtatctctgtagctcttcactgtcaaatctagatcatttctcttccttcctaacaatttctagctttgtagcttgtatcattaaactgcatcatttactatctttttttgttgctgttatctaccaactgccaggttatttctcctcctccaccactctgcacttccttgaatattctaagcttgctgtcacactttctccaatactgttttaccctcattcttttacttcaatatccatgtaggtgatctaataccatggtgtctcacttcttgatctctctctacatcagctacccacttccatgggaggattccctatgattccctagagatattctaattaccagtaattgctactcctccttcccagtctaaattttaagaaatccaatagttaactaccagtccctcttggtctcccagctccaagaattattcattccctctttgtaacctacatcgattgatccaaccactttttcacagtccctcatgtatctcacacattctcactccctacttaacccagcacagactgatatcatggtttatcattatcatcattcctctgtacacatgaccacctcccctgcatcctctttctttgttgtgtttcctttgttttgacaattatcttctctgccacatcatcaatattcatctctctagtttaggtaagtaatcactcctacaagttttcaagtaatcaccccactgccaccatactgaccacaactccagctgttcttcagctgtattaggtgagctctccactcagagcttttgtatttcctgcttccgttgcctggaatgcttttacttcatagtttactctctttccttaaggtctttttccttatttgttatcttgtgtggccttccttggctactgcatttaaagttgtacctctgctcctgcactccttgttgtcctttgatttacttttctcaacagcatttatcatttctagcatactggatgttttctggctatctcccatcactaaaatgtaagcttgatgaggacagggccttgtgtgtttttttcccctgcttggtcttcagcacctggaataacgctttgaacttggtaggtgcacaataaatatttttctattaagtgaatgaagttgttccttcctcttcatgcttaagggttttttgttttagggctaagagacattcacatcagaaagcatggaaagtttttgtttgtcaagcaataaattgtagattgggctgcaaaataagaaacactcttgagaacatgttactattagtagaataatagtaacatgggctcaagcaatcctcccactttagcctcatgagtagcttggactataggcacacaccaccatgcccagctaattttttaaatttttgtagagacagggtctcactatgttgtccaaactgatcttgaattcctggactcaagcagtcctctcaccttggcttcccaaagtgccgggcttacaagcatgagccactgtaccttgcccaatctggttctttttttttttttgagacagagtctcactctgtcaaccaggctagaatgcagtggtgtgatcttgtctcattgcaacctccatgcctccccaggttcaagcgattcttatgcctcagccacccaaatagctgggattacaggcactcgtgaccacgcctggctaatttttgtattttcagtggagagggggtttcgccatgttggccaggctggtctctaactcctggcctcaagtgatctgcctgccttggcctcccaaagtgctgggattaccaggcatgagccaccacacctggccccattctggtttttgtgacaaggatctggcttgtctccctttctacttttcactgatatctttgttactttgcatttctgtagtacagtcatgcattgcttactgatggggatatgttctgagaaatgcattgttaggcaatttcattgttacgtgaacatcatagagtgtcacttacgcaaacctagatggtgtagcctactacacacccagactttatggtatagcctattgctcccaggctgcaaacgtatacagcatattactgtagtgaatactataggcaattgtaacacaatggtcaatatttatgtatctaaacgtatttaaacatagaaaaggcacaataaaaatgtgctataaaagataaaatgtaatatacctgtatagggtacttaaccaaaaatggagcttataggactggaagttgccctgggtgagtcagtgagtgtaaaggcctagtacattactgtacactgctgtatactttataaacaaacactgtatgcttaggctacaccaaatttttaaaaaaatatttttctttctttaataataaattaaccttaggttactgtcacttttaaacttaataaacttaaaaaaaatttaatacttttttactcttttgtaataacacttagcttaaaatatcgtgtacagctatacaaaaatattttctttatatccttattctataagcttttttgtattaaaatttttgtttgcactttttaaactttttttgtgagaactaagacacaaacacagtctaggcccacacagggtcaggatgatcaatattactgtcttctacctccacattttgtcccactggaaggtcttcaggtacagtaacatgcctggagctgtcatctcctatgataacagtgtcttcttctggaatacctcctgaggggcttgcctgaggctgttttacaattgacttttttttaacaagtaggagtacgctctaaaataatgataaaaagtatatagtatagtaaatgcataaaccagttgcctagtcatttattattatttttattatttaattattttggttgagacggggtctcactacatgttactctggctggttttgaactcctgagctcaagcctcacaaagtgctggaattacagccatgagccactgtagcctgccgttatttattattattatcaagtattatgtgctatacataattgtatgtgctatacttttatacagctggcagtgcagttggtttgtttacattggcaccaccacaaacatgtaagcaatgcattgcactatggcgttctgcaccatcactaggtgacaggaatttttttagcttcatgataatcttatggtaccactgtagtatacactgtccttcatcactgtacattgttgactaaaacattgttatttcaggcagaatcttgccctgtcacccagggtggaatgcggtggcatgatcttggctcactgaaacctctgcctactgggttcaaacgattcttctgcctcagcctcccgagtagctgaggttacaggcatgcaccacaacacctggctaattttttgtattttcagtagagacagagtttcaacatgttggccaggctggtcatgaactcttgacctcatgtgatccgctcaccatggcctcccaaagtgctgggattacaggcatgagtcactgcgcccggcctcaaaacattcttatgcagcccatgactttacttaattgtgccacctccattgctttttaaaaaacacacacacacacacacatatatatatatatatatatatatatatatatatatatatatatatataaacagagatggggggtcttaccatggtgcctaggctggtctcaacctcctaggctcaagcattcctttgccactttgaccttcctaagtgctgggattacaggtgtgagccactgcacgtggcccacattgcctttttttttttttttaattgacacagggtctgtctgtgtcaccaagactggaatgcagtggcgtgatcttggctcactgcagcctcagcttcccaggcttaagtgatcctcccatttcagcctcctgagtagccgggactgcaggtgtgagctaccatgcctggctaattttttgtattttttgtagagacagcgtctccaactcctgagctcaaagtgatctgcctgtctcagtctcccaaagtgctaggattaacacatgtgagccaccgcacctggccacattgccttttaaagaggtcttgtttcatgtgcataaactagatataaatatatgctataatatttaatacagtggtagaatgtagttgtcactaatagcgtatgaatgtaaagaaaatatgtttgaattgtttcttactggttgtaaattcagattttcattgtattataatacatacatattgttattttaaagcaaggcagtgttacaatcttgttacatatatattattattgaatatgttactttcattatgatagcgttatatagtattgaatgttacaatctttgttacataccttaatatcacttaatatttaaaatataggtaacttgaccctccaagatagtgattccttttgttttccgttttgttttgttttgagacagggtctcactcttgctcaggcaggagggtactgtgcagtcatggctcactgcagccttgaactcctgggctcaaaagatcatcctgcctcagaccccaagtagctgggactgcagccatgcaccaccacacctggctaatttattttttgtttttaaattttttgtagagatgaggtttttaaattttttgtagagatgttgcccaggctggtctcaaactcctgggctcaagtggttctgccaccttgacctctgaaagtgctgggattacagatgtgagccacatagctggccaagacactgattcttaaagtctttagtgagtcactattactggtggaatatgttgtatatcattcatgtgtgttgaggagataagatttttagtaatcattaactttgggggaaagctatttaaattacaataaagcactgtttggtggcattttagtcacctgaaatgaaaatgttgaaaatttttctgcttccattggatgtaagaaatgtcattttctttcttttttctttttgagacagtcttgctctttcgcccaggctggagtgcaatggtgcaatcttggctcactgcaacctctgcctcctgggctacagcgattctccttcctcagcctcctgagtagctgggattacaggtgtgcgctaccgcaccaagctaatttttaagtagagatggggtttcaccatgttggccaggctagtcttgaactcctgacctcaggtgatccacctgccttggcctcccaaagtgctgggattacaggcgtgagccaccgcacccggccaaaaaatgtcattttcaatgaaaagtttttaattatttctcatcttaatgatataaaaggtaaatggtaaacttttaagttaaaaaataataataggcataatttatacctttgagaaacagaaactaaagtaataagtactttattactgcagaaaataagaacattaaatgagggctttctttttttcttttttttttatttgtagtagagacacggtctcgctgtgttgcccaggctggtcttgaactcttgaactgaagtgatcctcccaccttggcctcccaaagtgctggaattacaggcatgagccaccacacccggcctttctatttttctttctcttttttgagacagggtttcactctgtcacccaggctggagcacagtagtgtgatcacaggtagcctcgacctcctggtctcaagtgatcctcccacttcagcctcttgagtagctgggactgcaggtgcatgccatcacacctagatagtttttaaattttttttgtctgaccatgttgtccaagctggtcccatgctttggaactcctgggctcaagtgattctcctgccttggtttcccaaagtgctgggattacaggcatgagccactcactgcacctggcctaaataagaactttattattggaaaagaaacctaaaatttgctgtgagaagaaaaatatttctgactaatgaataatgcactaagtgaaactttgttttgataacttatttgcccaccctaaagtactatagtgaattactgaatatggtaattgttttattgtgatctcaaacaaatgctggctaacattcccacatcttcatgatgtttgttactgattattttgtagcctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtaagttttcttttcttttcttcaatccctactacatacagtaaaggaacacatggattttcttgcaataacaaacttctgaagtggtgttttgcatgaggaaattaaccctaagtagaatcacctactatgttgtactttttttttcttttctgagacaggatctcgctctgtcacccaggctggagtgcagtgccacaatctcagctcactgcagcctcaacctccagtgctcaagtgatcttcgcactttagccttccgagtagctagtactacaggcatgtgccaccacacctggctaattttgttctttttttttttttttgagacaaagagtcttgctctgtcacccaggctggagtgcagtggcgagatctcgtttcactgcaacctccacctcccaggttcaagcgattctcctgcctcagcctcctgagtagctgggactacaggcgcatgccactatgcccagctaattttttgtattttcattagaggcggggttttaccgtgttagccaggatggtctcgaactcctgaccttgtgatccacccaccttggcctcccaaagtgctgggattacaggcgtgagccaccgagcctggctcttttttcttcttttgtagaggcaaggtctcactcactgtgttgcgcaggctgattttaaactcctggactcaagtgatcctcctccctcagctgggattgtaagaatgagccactgccactgtacttttaaatttacatataatttagctaaaatgaaatagtacttctttttttctttattttaatgggggaatttaaccagagctttcagtgaattttgtaagagttcttgaaaatttttacattctatgatgtattcatttaatatgttgtttttgttcattttcctgttaagtaattgattgtgtcttcagccctttatcaatttctttatcatattttgagttatcgaaaaaaacattggggtacagaaaatgattgggcagcgtatgttgttctcagttcccttggaaactgtaattgccctgatgtttgcaaatactcacattttccatcgattcttacctgccatttgactctggcattaattagttttcctctttttgatttttttcttttgtatctatcttcttccataccaaactataagatgtttttgttgtttatatttgaacaaacttttttttcttttttttttttgtgagaaggaggtctcattatgttacccaggctgatcttgaactcgtgggctcaagcaatcctccttcctcagcctcctaagtagctgggattacaggcacactctgccacgcccagctagtttgaacaaaactttgttcttagttgtttaactcagtaactagcactggctggcatatttatggcagggtacatttatagaattaatgaatatacatttatcaagtggctctaagtgctggttagtgtaaaacataatccccagttacaaattgtttatagtcaaggagggaagatagtagagtaaataaacggttaaatcaagtgtgatagagccttgaaggagggttaggagttaacccatggagaatgaggggtaaacttcacagatagaggaaacagcatttcggataaagtgtgtgggggaaattactaataggttgggttatggcacccagaatattaatttattataacaaaacatagcccatcatttcctgtcttaagaagcccctttcttaataatctctataataaaagtgatttttttgtatcattttcccaaggaaaaatattgattttttgggggggcaggcaacatagtctttcaattcctgcttctcttttgtatctccttccttgatttttccttcttattttattttatttatttatttattgagacatagtcttgctctgtcacctaggctggagtgcagtggtgtgatctcagctcactgcaacttccgcctcccaggttcgagtgattctcctgcctcagcctcccaagtaactgggactacaagcatgttgccaccatacctggctaattttttgtatttttagtagagacaaggtttcgccatgttggccaggctggtctcgaactcctgacctcaggtgatctgccccacttggcctcccaaagtgctgggattacaggcgtgagccactgctcccggccttccttcttatttaatacccactttgtttatgcatgctatctggatttttctctatatttttaattgtaaggttaggatatgtgcaaacaaattaggaaaccatctcatagccctgtgccttaaatcattaaatctcattatattctgagatttctttttatgattcttaacatctcaggtttatttttgatttatatcacattatccaggtatttgagttcaaaccttgtttcaacttcttctgtaatggctttcagtacctgtttctttcctgcatgttccatattgctacaatctgttttaagcattcataaccaaatcactctaaaggtatgtaacttgacggagacaagactgaagacagggagactaggagtcttaaaaccgagcatgttgtctttagacatttgtgtctagtaccctatgtttaatcttatttacttaatcttactgctaatcagcttttgactgctagttaatttaatctcctgatattttttcccatcaaaattactaggcgttttttaattgtaaagtgactttaattagattatcccaatatatatcctaataaagagcttggcagagaaaccccagagactagtttatgtgtataaagagaaattttatctgtaggccttgtccttgtagatgtatcatcttgctgaattttaaatatgcctatgtgtcatcacttatcattcaacacatatttatttgatatctacatatgtattttggattaatgtgagtcattttcaagtgttggtttctggatgtcagtggccatttctttctttttgtctgtctatctgtccatctgtccattcatccattgattcattcattcattctcagcttgttttccctagtcagaccatttcattttaaacctcatttaatatatagaaggatgatttactaaatatttcacagttcttaagttacagcagtcaaaagaatgggactcattatgaatttaataactgggggtatataacttcttcttaaataagtttttattaaaaggtataaaacacattttatttttatttttattttttatttttctgagacagagtcttgctgtgtcgcccaggctggagtgcagtggtgccatctcggctcactgcaacctccgcctcccggattcaagcgattctagtgcctcagcctcccaagtaactgggactacaggtgcacatcaccatgcctggctgttttttgtatttttagtagagacggggtttcaccatgttggccaggctggtctcaaactccagacttcaagtgatcccactgccttgggctcccaaagtgctgggattacaggtgtgagccaccatgcctggccaaaacacacatttttaaaaagtatttttaaactatgcagaagtatttaaaatataaaatagaagtgttctctatttctgtgttctccatagggaattgggtataatatgaggtaggactattcatagaggtagaggttaacctacctagatgttgaacatcttttcatgtgcttattggccattcatatgtttgggttttggtttttgtttgttttcagttaagtatctgtagaaatattttgcctattttttaaaaagcaaattggttgtcttattaaggtataaaacttagagaccaaagtgctatatgagctatatgctttgtaaatttttttatctaagcttgcctttcactatgtatatatgtatgtatgtattttaatagatgctgtcttagatgtggtttcctaggagaccctaagataaggattttttttttgttgttttatttcaatttttagcttcagagggtacacaagggtatattgtgtgatgctgaggtttggagtatgattgaacccatcacccaggcagtgaggtagtgcccaataggtagttcttcagctttctctcacctctttccctcctgtctgttgtccccagtgttttttgtttccatctttgtgtccgtgtgtacccagtgtttggctcccacttacacgtgagaacgtgtggtatttggttttctgtttctgtgttaattcgcttaggataatggcttccagctgcatctgtgctgctgcaaaggacatgattttgttctttttttatgtctgtatagtattccatggtgtatgtgtaccacattttctttatccagttcaccattgacaggcacctggattgattccatgtctttgctgttgtgagtagtgctacagtgaacatacaattacatgtgtctttttggtggaacagtttctattcctttgggtatttacctagtaatgggattggtgggtcgaatgggagttctgtttttagttctttgagaaatctccaaattgctttccacagtggctgaactaatttacattcccaccaatagtatgtaagcatttgcttttctttgcagccttgccaacatttattatttttatctatttttaataatagccattctaactagtatcagctggtatcacactgtgatttttttaaatttgcatttctctgatgattagtgatgttgagcattttttcatatgtttgttggctgcttgtatgtcttcttttgagaagtgtctgttcatgttccctagcccactttttaatggaattacttatttttgcttgttgatttaagttccttacagattctggttctagaaggggtttgggaagtcattaacctcttgaaattatttgtaaaaattttgaataggtgtttttctgggcagtggattcaaaacttttatcagactctcaatgaagtatgagaccttcagaatgctaagaactgtccattaaaagtgtcattcagcatacactgttcaattatatttactactcaagactgaaaatgtttgagactctgatagccctaaactgaacaaagtcaagttctaaaatatgctcaataaatgtcaaatagcatttacacatatcttatcatgcatgaattttaatgtgcactacaatcactagccaaaagcaagcaccttaattttacgatgaccttattctatcatccagattgggaaccttgcagacactattaattaatacaagagttaaattgagattgctcctggcaaaccaagttatattgttacacttcttagattacacaatgactcagtgacatctggaacactggtctacagctcttaacccagaaaactttacctcctggttcatactaagctaggtaatcaaatctgtttcctactgatggaagtagctaatttttgttgtctccatgggaaaatattaaagtagtttcttaaataaagtggtactattattcatgcatttgtaagattgccctatatttcagaaatttagaattattttctcctgcctgcctgcctgcctgcctccctcccccgaccccctctctttttctctcctcctttctttcttagagtcacggtcttgctctaacacccaggatggagtgtaatgacacaatcatagctcactgcaccctcaagctcctgggctcaagtgatcctcccatctcagtcttctgagtaggtaggactacaggcatgcaccaccatgcccagctaatttttaaaaatcgtgggggctgggcacagtggctcatccctgtaattccagcactctggtaggccaaggtgggcagatcagttgagcccaggagttcgagaccagcctgggcaacatggtgaaaccacatctctacaaaaaatttaaaaagtagccaggcatggtggtatgcatctgtagtcccagctactcaggaggctgaggcaggagaatctcttgaacctgggaggcgaaggttgtagtgagccgagatcaggtcactgcattccagtttgggtgacagggcaagaccctgtctcaaaaaaaaaaaaaaaaaaaaaaaaagttattatgagaatcagaatcatttatccattttaaaatgtgtgagcacctactatgtgtagatcctaatgattctgtagtacacaaaacaagataaaaatcccgactttcatggatcttacattccaatacaggagataggaaaataagatgaataagctggtcagggaagccttcattgagtaaaaacctgaaggaagtaagagagctagctttactgatactgtgagaaagagtgttctatgcagacaaacagcaagtataaaagccctgagatggaaggaaggacatgttcaaaagcaaaaaagaggccatgtagccagaatacatgaacaaggaaaagacagtagggcatgagagcagagaggtaatgcaggaccaaatcatgtaggtagttgtaggcctagagtgtttctgagtgagataggaagctgtttgaggattttcaacagaaaaattacaagaaccaagggaagtgttaacagtaggttactctggctgctacgctacaaacagactgcagcaaagcaaaggaagcagctgggagaccagttaggaagttatttcaacaaaacaggcaagaatgatgatttggactaggatagcggcagagggaatggtgacaaatggtcaaatctagatacattttggagatagagctaacaagattcgctaatagaccagatgttgggtatgagacagagagaggagtcaagagtggtaccaaggtttttggcccaagcacctagaagaatagaactggcattaactgagagagcaggctgcaggagaagctggtttgtggaggaccatcagaagcacagttagacacataccaagttaaggatacctactacacatgtcaagtaggcagttggatatgtaagtctagaggtcaagggacaggtcttgaccacagatggatttggaagtcatcatcacacagatggtatttaatgccatgggactggacgagattcctgtcctagagaatggaacagaaaagtggagcagtccaaggactgattcttggggcactccaaaatctagagacaagggagatgaaagggaagcaccaagataaatcaagatagtatattaactttagatatgtaaaaagaatttcaaccgttactaaggtcgaattaatgagaaaagtaacagacacaccatcaggaactctagagatatagtgatacaggggtccccagagaaactccgaccagcttgtgcactgggaaaatggggtggagcttcgtgaagttcacgctgtttgcagggaaaaggagcctggcctctgtgatctggtgtggtaacctggggattcaatctgtgagatgtgggcctgttaacaggaacctctcttgctttgctgagttttttccttttcacccaataaaccctgtccttcctcacccttcaaattgtctgtgagcctaattttttgtggttgtgtgtctttagctgacctaagaaaaaagtcctacaataataatattgctcaaatgatgtgttctaggaagattatattagaaggaatactttatgacttgattttttttcatgtcaactaaggaagactaaagactcagcctcctaagtagctgggactacagaagcatactaccatacctggctgatttttttgttgttgtttgtattttttggagagatagggtttgccatgttgcccatgctggtctccaactgctgggctcaagcaatctgtccaccttggcctcccaaagtgctgggattacaagcttgtaatcctggcccacacatttaatagtaaacacttcagattttcagacatgagataatctaatcaacgatacttattagccactggcctattcagcattgattctttagagtcatacaacttacactcccagttcacccaccttgggtgaggccaataattagactcaggtagcttcaagactgaatgaagtggggcaacacttctggatcattaaggatctgctgaccttgattaagaatctgataatgaggaacatcttaacccacctgtgacccacctagataaaatggataaacccatgtaacctggtagctgaactctggaaataaaacttccaagaatcactgggaaatttaccagtgcatcctcaaaacttccataaagtatggtttcaaagaggaactgaacaccttaaagaagctgtgaagacaattaggtgagatagtattccatcagacaatcatttaatacccatacattgtattaaggatactgtgttagaattattgtggaaaattacacaacagatgtttgggttttttgtttttgtttttgtttgacacggagtcttgctttgtcacctaggctggagcgcagttgcacaatctcagctaactgcagccaccacctcctgagttcaagcaattctcctgcctcagcctcccgagtacctgggattacaggcagttaccacaacacccggctaatttttgtatttttagtaaaggcagggtttcgccatgttggccaggctggtcttgaactcctgacctcaagcgatccacccacctcgggctcccaaagtgctaagattacaagcatgagccaccacgcccagacaacatccttaacaaagagaaaatactccagagaagatttaaccaaaaaaagtcacctaaaaatgtaaatataacattaatagatacctaataaactataattatatgcagttgtgctaagagggacagtagatattcaaagtgaatataaaaaagtaaaatgtcatgaagaaagtaagataagagcaaatagcagaggaagagtaaaagtgctgaaaactgagggataaagcatttgaaatagcttgatgttgaaatgagatggggcactgaggtcagattaggtaaaaaaaaaaaaaaaaaaaaaaggcaagctccaactatatgctgcctataagaaatccactttaaaaataaagacagccaggttaaaagtaatacagaaatgacaaaggtgacatcacaaccaatcccagagaaatacaacagattctcagagactattttttttgggggggtttgggggcgggtggggacggagttctgctcttgtcccccagcctggagtgcaatggcacaatctaggctcactgtaacctccgtctcccaggtacaagtgattcctcagagactattattaggaacacttcaagcacacaactagaaaatctagaggcaatggacaaattcctgaaaacatacaacctcgcatgtttgaatcaggaagaaactgaaaccctgaacagatgaataatgaattctgaaactgaatcagtaataaaaaaacaacaaccaaaaagctctggaccagacagatccacagctgaattctaccagatgtgcaaagagccagtaccaatcctactgatactattcccccaacaacaacaacaaaaaatcgaggaggaaggactcctccccaactcattctacaaaaacggcatcatcctgatacccaaatctgacagagacataacagaaaaacaaaactatgggccagtatccctgataaacatggatgctaaaatcctcaacaaaatacgagcaaaccaaatctagcagcacatcaaaaaattaattcaccatgatcaagcaggctttctgcctgagatgcaaggctgattcaagatacgcaaataaataaatgtgatacatcatataaacagaattaaaaacaaaaaacatatgatcatttcagtaaacacagaaaaaaactttcaataaaatccaacatcctttcatgatgaaaatcctcaacaaactaggcattgagggaacatactccaaaataataagagccatttatgacaaacccacagccaacatactgaacaagcaaaagctgagatcatttcctttaagaacagaaacaagacaaggatgcccactcacactactcctattcaacatagtactggggaagtcctagccagagcaatcaggcaagaaaaaaaaaaaaggcgtccactcaggaaaagaaaaagtcaaataatctctcttcactggttcttgtaatttttctgttgaaaatcctcaaacagcttcctatctcactcagaaacactctaggcctacaactacctacatgatttggtcctgcattacctctctgctctcatgccctactgtcttttccttgttcatgtattctggctacatggcctcttttttgcttttgaacatgtccttccttccatctcagggcttttatacttgctgtttgtctgcatagaacactctttctcacagtatcagtaaagctagctctcttacttccttcaggtttttactcaatgaaggcttccctgaccagcttattcatcttattttcctatctcctgtattggaatgtaagatccatgaaagtcgggatttttatcttgttttgtgtactacagaatcattaggatctacacatagtaggtgctcacacattttaaaatggataaatgattctgattctcataataactttttttttttttttttttttttttgagacagggtcttgccctgtcacccaaactggaatgcagtgacctgatctcggctcactacaaccttcgcctcccaggttcaagagattctcctgcctcagcctcctgagtagctgggactacagatgcataccaccatgcctggctactttttaaattttttgtagagatgtggtttcaccatgttgcccaggctggtctcgaactcctgggctcaactgatctgcccaccttggcctaccagagtgctggaattacagggatgagccactgtgcccagcccccacgatttttaaaaattagctgggcatggtggtgcatgcctgtagtcctacctactcagaagactgagatgggaggatcacttgagcccaggagcttgagggtgcagtgagctatgattgtgtcattacactccatcctgggtgttagagcaagaccgtgactctaagaaagaaaggaggagagaaaaagagagggggtcgggggagggaggcaggcaggcaggcaggcaggagaaaataattctaaatttctgaaatatagggcaatcttacaaatgcatgaataatagtaccactttatttaagaaactactttaatattttcccatggagacaacaaaaattagctacttccatcagtaggaaacagatttgattacctagcttagtatgaaccaggaggtaaagttttctgggttaagagctgtagaccagtgttccagatgtcactgagtcattgtgtaatctaagaagtgtaacaatataacttggtttgccaggagcaatctcaatttaactcttgtattaattaatagtgtctgcaaggttcccaatctggatgatagaataaggtcatcgtaaaattaaggtgcttgcttttggctagtgattgtagtgcacattaaaattcatgcatgataagatatgtgtaaatgctatttgacatttattgagcatattttagaacttgactttgttcaatttagggctatcagagtctcaaacattttcagtcttgagtagtaaatataattgaacagtgtatgctgaatgacacttttaatggatagttcttagcattctgaaggtctcatacttcattgagagtctgataaaagttttgaatccactgcccagagaaacacctattcaaaatttttacaaataatttcaagaggttaatgacttcccaaactccttctagaaccactattctgatgaccgttctccctgctttgagagaatgcctttcagagacactattgtactagtacaaccttgattatctggtatgtcaatggaaccttttagaaaaaaacagaattttctgtatgccaacataagtacatgtagaaatgtttatgcagatggtattttactgtgtgtattttttgacagcttactgttccatgttagtatagacagctgtacttcgttcatttcaacttaattcctgtattttgcaaattttcaaaaataaaatcagtgtatcaggaagttgcccatatgaaacctgaagcaaaaaaatgctttagatatcttaatcacaacaactaaagatcacagggtacatgtcttaccatttatagtataaaactgaatttccacattagcaaaagattgaaaacaaaaattaacttgtgaccaacttgccaaaatctgacctgaaggaaatttttgaacgtaactcatcacaaaaacacatgtactctgtgcagaaatgtttcttaaatcagtaaagaaaataaggaaatgcagaggagcaaaaagaattctccatggtgaaatcactcaaaaactatcactgctgacaatgcatttcatttctctatatctatacataagttttgttagtttgcctatttttacatggttatcatcatactgtatatgtaaattttctcctgtgttcttccttaatattttaactactttttctatattcctttgggacagagtgctagaagaggaattactaggtcaaaaattatgaatatttcttgatacatcttatcatactgcttttcaaaagtattttgaagtaaaagtttatacttttaaccagtcgggtctcatactgctaatttcaccacacctgtgcttggattgggcattatgatttttaacatgtttgtgatctcaaaaacaaaaggttcctcactgttctgatttgcagtccctccattttgcatgacattacacatttttccacagacatattactagttttattttatattaaaacatgattttgcatttatagagacctccatttagaggacaatagccccttgtaaataaaacttttaacagaacacgttcatgttcacgatgtggtgtttctttatgttttggaagcctaaatctcaccagatgtgatatttcttcactactaagacaaaaaaccattagtttttatcagaatcagtcatctgggttaccatgttgaaattatcctcaagatatgaaagaaaactatttcaaatgcttaatttaattaatagtcaacaacttagccacgtgtggtggtgtgcctgtagtcccagctactaggcagggtaaggtaggaggagcccttgtgccaggagtttgaggctgtagtacactattattgagcttatgaataacctctgcacttcagcctgggcaataaagcaagacccagtctctagaaaaaaaaaatgattaggtaaagaaaagaaaacaaattttcacaatgggagaatgtggcttattactaagaaatggctgatacgtagtttcattgattttttaaaaaaatagttccaatagcaaaataatcatagaagttagatttttatcaggaataatttttattaaaatcatcttattccaagtattttcttcttttcaaggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtacttttatataaagtaattctggatttgacattctcatttagagaaacctattttcttttttctttttctattttagtgtttcatttatgtgcggtctccaatttaggacttttccatagtgccaaagccatacatattcagtagaacatcaataaattacatcagaaattcaacactttattataaaacgggcttcgtgttagataattttgctaaacagtaggctactgtaagtgttctgagcatatttaagacaggctagcattttcaatttacaatattttcaactgatagtaggtttattgggatgtaaccctatgataagttgagaaacatctctttttgtgtgtctactgtgatttaagtatttttaatcatcagccaagcattgttagtagtataaatatgattaataaaaatgtgcatggctttcctgaaggagattttttaattgcctttgagaataaactcataaggtctaccaagaaaataaatgttatgatgtttcagttggcttctaggaaataattaaattagtgatattttaatcaggttttactatctgctaggccccttccatcaattcttattaaattctcaaaataatcctttgaaaagggagtataattacattttacagtgactcgaaccttacccaaacaagtgggagagccaggagccaaactatcaggctccaaagcttttttttagtgcatcacaatgacaaaggggtggttttctttcacccaagaatgtgctttcctggaaatttttctagatagaatattatgtaatttgttttgaaggttttttttcctgactgtcttaaagattatgctagctttagaacacatgcaaacagctgcagctctgtgattaaaatgttaaggtcactagaatagtgttaggaaaatgttaatagataattctgctgcctctattagcttatgtatgatccttaatagcattgcttccccttcagtttctatttaggaggtgaagaatcttttaataaggtagaaagttgctttatttaaatttgtactgtagaatgtttgtgatacagtatttgtaaaattgatatgaaaaataatttctcaaagtctattgtttgatctagttattttaataaaggaactctagaagtttcaagtggccagtgaagtgtgaggaatagagagtaaaggaaataattaataatggtgaccctctgttaagtggtttactttttccattaatataaatttcatttggaaagattaaaaaaacaagtttgattgaacttgataaatcagaaatatttaccagctttgtcgatggtgtattcttgaaaaatgtttggttttctttcaggttgacttatatccaaaattctacaaattcttagctatgttataaatgtagaaagaagtgaaaaatcaaaatatgattatgaagattttcttctcttccgagtacaaagctctgctaaataaggatttacccaagatgcccacatccacatacttatgtgtcagtgctttggagaattaactttgactttattctactggaagtatagattaacactgtgctttctgggattttgcttttcatgggttgctgatttttaattttgctaaataagcacatagtccgtgatcaccagcatcacctgccctctgttcctcccccgtcccccagggataagaacctgttatccaccatcagtaacattttatgaaagatctacttatttgtctgttttgcagacattttaaaattcgtaaagtgggatgcttctttaatttaaatacatttagcttcatgaaaaactcactacacagttcttgttcaagcattattgggaaaccaccagagggcactctcacccagggcttaatttgaacatctcgcccaaaagtgacttttaaaagcacttaattagcagagaatttggatgttcattagttgagaatgactagtagaataaatggtaatagtgaaattaagtgctggaatattctgagtagaccaatagcaaaaactgatttttttttttttttaaagaaaaggtcttgctgtgtcgcccaggatggagtgcagtggcacaatcacattgcactgcaacctcaatatcctgggctcaagcaatcctcccaccgcagcctcccgaattgctgagactacacatgtgtgctaccatgcctggctaattgttttaattttttttatagagacggggtttcgccatgttgcccaggctggtcttgaactcctgggctcaaagcgatccacccaccttggcctccaaaagtatgggattacaggtgtgagccactgtgcccagccttattttttttttttaagataatattgttaacattttgtatttctctgcataaatatatttcaaaaataaaaatagagctcataatata

SEQ ID NO: 309 - DNA, 36283 bp, Homo sapiens; identical to SEQ ID NO: 308
  source 1..36283: mol_type = genomic DNA

SEQ ID NO: 310 - DNA, 36283 bp, Homo sapiens; identical to SEQ ID NO: 308
  source 1..36283: mol_type = genomic DNA

SEQ ID NO: 311 - DNA, 36283 bp, Homo sapiens; identical to SEQ ID NO: 308
  source 1..36283: mol_type = genomic DNA

SEQ ID NO: 312 - DNA, 36283 bp, Homo sapiens; identical to SEQ ID NO: 308
  source 1..36283: mol_type = genomic DNA

SEQ ID NO: 313 - DNA, 5771 bp, Homo sapiens
  source 1..5771: mol_type = genomic DNA
ccatgcggatttagagtgaggtgtcaggttgtcaatcaagcccccaaatctgtgcatctagaacatttttctgcagagaaagtcttaggtgtagcctgccaataaatgcctgcagagctaggtgggaatatagaagaatgaaatacatcaggtgtgagaacccagtctcttaaacacagaggaatattattttcttccacagagaaatatgccttctcccttttattctgacatattcagccttctgggtctgtcttttatttcgtcacttctggtagagacttgggtccaaataaatatctctccaccataagaaacagtaatgcaagggtgatgacaaaaggcaagcaatgctcagtgttggggagaccttggggcgggtgaggattgggcaaacgggagggcacatgccttctaaggcaggcactcactcctctgcttcagttgatcactgccttgaggaaatgggacccagtattgacagaccttatggctgattaagagaaagcagaaatctggttctctttggagatgaaatctcaatttagttcacattttctttagagaatcctggcataccaaccagaacactctgagtgagtcaaatatggtcccgataggcaggtggtttgtgacctctggtctctagattctaccggaatttctgattgattcatgtcttaaataagattgatgactgctgtcctagaacatgtttcccctccattctgtgggcggaaagacagacggcatggacatttaccatgttcttgggtcccagaagtccaggagaaagccatctgcctcactgctccctgccccatcctgggcccagagcactaatgccagtggcatcagctctgctcctctccctcttcctttgtctaccagtgagtgtcctccattatggggatggagcaagcagtatattgtaaaagggacttagtgctgagaagcaccagaggaaaagtaggagatgctcattaaagtggaaggcagctctcttcttccccttctcaattctgcattctgctctctcccctaaatgccccccacccaacccccaaactcttgagaatgcccaaatccaaccaggtcaggaaaaaataaactcactggctcctgtattgagaagtccaagtgtggtgcggcttccggcatgtgggattcaagcactcaggaatttctccctctcacccaacctcagctctgctctcttctctgttgcctttgttctttgacaggctccctccaagtggtggaaaagttgacctgtatggtcattatcactcatcatttcagaaggggagagcctgcttctcttgtagcatttccatcaaatcctgaaaataaaaataatctggttggttctactggacttgtgatactggacaaacctctatgtccaagagctcgagtcattcccattggctcacctgggccacacactcttcgttgagtgcatcccaggatcacagggagtcttgagggtgctgtgtgtggtggtggtggtggtacggagatggcaaactctaaaaggaagagatggtggatacttaaagcctaccttctgcccacaggtgtgtcagacacaatctccaaaggccatcctattgttaccctatcccccaaacaaacactgaaaaactctcctggcaatttggcagtagctcagtgtggagcatttgttaattccagtactagaacgtctgcattgcaaaaccagaaatgtccagttctggtttggcacacagaagagattttcaagccttggcaactcctcagtgcaggcagtggaggaaatgctccagctttgtgaaaatcttctcccttcgctcctcatggagaataaccgttcatcactgcagccatgaatctgccacactgaatagatatggtctgaaaatctaggaacaaatggaatcactttggaaacctgtaaattttaaagccgaaagggcgctccagggaaccaactacatgaagttctctggaagccacaggatgggaggtttggtgggggtggaggtgaccattgaattttacataggcaaatgtaagacaatcttatccatagacagaaaaatccaaactcaccgagagtaaaaggatgacagttgaaataacagctaattgttattaagtatttgctaagttccaaagcacttttcatagattagctcaattaattctcacaacagccctgtaaggtagggaccatgatcatctccagaagaggctaaataaattgccaaagatcacatatgtagcaagtggtggcagagtgaggattcatacctggacagcttaactttaaagccatggtgctaatgcattcattcattcatccatccattcattcatccatccattcattcaatgattatattggatgcctactacatgctaagaactatgttcaaggtgctgaactacagctgtgaacaatgcaagtacaaatacatgaagcagagttggggagaaagtaagctggagaaataagacataaactaggttagatggtgaacatgattaaggaaaaaactagagcagggaggaaagagaaatgtgcagggggaaggtcaattctgagtgagccaacaggcaaggtctcactaagaaagcggcattaaataaagatttgaggaagtgagggagtaaaccttgcagctatctaaaaggagagcatgagaggtagaggagacagcaaatacaaagaccctgaagcaggggcaaggctaatgagttctagaattagcaaggagtccagtgtaacttgaacagagtgatcaaagaacagagcaggaggaaatgaggtcagagaggtaaacaggctggagtgcagtggcaccgtctcggctcactgcaacctccacctcccgggttcaagcgattctcctgcctcagtctccctagtagctgggattacaggcatgcaccaccacacccggctaatttttgtatttttagtaaagacggtgtttcaccatgttggccaggctggtcttgaactcctgacctcaagtgatccacccgcctcaacctcccaaagtgctgggattacaggcgtgagccaccgcgcccggccaggattcttttaatcaagtatgatgcagccatcagggttggagcattctaggaagagggaacagcatgcaccaaggcaacaggaaagcacataaaaaaggagttgctggaagattcatttcaacccactatcaagtaaatattaaacttactgtataaaaatgttagggccaggaggggtggctcacgcctgtaaacccggcactttgagaggccgaggcaggaggatcggttgaacccaggagttcgagaccagcctgaccaacagggcgaaaccccgtctctactaaaaatacaaaaactagccgggcgtggtggtgggcgcctgtaatcccagcttctcgggaggctgaggcaggagaattgcttgaacctgggaggcggaggttgcagtgagctgagatcacgccctgcactccagcctgggcgacagagggagacttggtcatgctccctccccgccctccgtcagttttaggaataaatacctttttatttaagctaaagtgtgggtacacccttcctctaggattctccatcaaggaataagaagccatattaggacaatttagagggcagttaaccctagtagacatagtggttcttaaaaggcttggggcctcagactgtacacaggcttcacatggaatctgatttgttcctttatcccagtccctcacccagaacccgaatctagcccttcatgttataaaaagggccagaggtccaaagagggtaagtgccttgtgcaaaattattcaactactttgtagaggattttaactagggttcagttagctccgcccacactataaaaggctctttctaaaaaacgaaacatgattaagggcacacggctccagcgttaacaaagctctttgttagctgggaaatgcccccctccccgactcatctgcttatcatctgcatagaattatgtactcaaaagcaggaaaattattgagaaaaccattggtccccggctgcagaccccaaggttgggagctggttcccgtttcctcccagagccggcagggggggcaccaggcaaagtttgcaagacgcgcctccctcccacccctcccccttcctcgcccaacttcccatagccgcggcctcaactaaaagtggccattgacctttcaagctttcgagcagtgatgcaatagaatagtatttcaaagaaaaatgcttatcgaaattttggatccggttttcccgtgattgttaagggtttcttttaaaaagtaggtcacatttcaagtaggtcatatttcgggggcgggtgcgcagacaaggagatgagtttccactaaggccagggggcctccaacggggttggaggtgagaatcccaggtagggtagaggtgccgagatccttccgaatcccagccctggggcgtcagccctgcagggaatggcagagacactctccggactgagggaaccgaggccagtcaccaagccccttccgggcgcgcaggtaagggcgcccccttagcagccggcgcaggtgacccgggcgggccgccgggtctaccggagacgttggagcagaggggaggaggaagggaggagccgggtgggtgcgggtgacaaggagccggagcgccagggggaggggactaaggacggccggcgccgcttaaggaggcgctgctctcccgctcgctgccttccaggacctgatcaaggggaccgcctccggtccccggccgtgggcaccgggacgagcacggcgtccccacgccatcgatgtgtcttagagccggagagtctggtttccgaggacccacagtcgctcctgcacgcccaccccccgcaaaagtgcggccaggagggtcgcatcgagggggcgccgccgggatgtttagaggaacccacccccgtggcaggccaagggccaaggatcgctatccttccctgaacccgggcgctcagctggcccgggtagggggcaggctccggccgccgaaacggggttggctgtagccggtggccggggagatctctagcttgcgcccgagcaccccggggtgtggggccagaggcaggccgaccccggcgtgcacaccgcccgccctgcacccgagcgctctcacccggtcttccctgaagcctgtgtattgcgaccgagcctctttaaagcagtagcggggcccgcggtcacgtgaggccgattcctggaaagttcctggaaagccgcctccgcagcagccgggcggggcgcgagcggagcgctgactggggagggaggcggggagcaagggaggcgcgtcggtctgggaagtcgcgcgcactcgctgctcctgggaccgacgtttaactcttgccaagtctcgtcgcagccgccgcggctggcgggccttgggcttcccctgaagcatgagccctctcgcccgcagccaccctcaccgcgtggcccgcggacagtgcgcgccggggtcccgggtgcacagcctcaggataccccgtgcccgcagctcgggcgcccgcggcaggtaccggtagtgggggaagcccgaaggctccgccccgaggagagttaccggggagggcggcgaggcgcggccgcgtgcgccggggagcggcggacggcctgggcttccgcagctcggagcgccggggaagagagagtccgaaccgcggctctgccccgcggcctagcgttgctgcctgcttt

SEQ ID NO: 314 - DNA, 6924 bp, Homo sapiens
  source 1..6924: mol_type = genomic DNA
agccgcggcctcaactaaaagtggccattgacctttcaagctttcgagcagtgatgcaatagaatagtatttcaaagaaaaatgcttatcgaaattttggatccggttttcccgtgattgttaagggtttcttttaaaaagtaggtcacatttcaagtaggtcatatttcgggggcgggtgcgcagacaaggagatgagtttccactaaggccagggggcctccaacggggttggaggtgagaatcccaggtagggtagaggtgccgagatccttccgaatcccagccctggggcgtcagccctgcagggaatggcagagacactctccggactgagggaaccgaggccagtcaccaagccccttccgggcgcgcaggtaagggcgcccccttagcagccggcgcaggtgacccgggcgggccgccgggtctaccggagacgttggagcagaggggaggaggaagggaggagccgggtgggtgcgggtgacaaggagccggagcgccagggggaggggactaaggacggccggcgccgcttaaggaggcgctgctctcccgctcgctgccttccaggacctgatcaaggggaccgcctccggtccccggccgtgggcaccgggacgagcacggcgtccccacgccatcgatgtgtcttagagccggagagtctggtttccgaggacccacagtcgctcctgcacgcccaccccccgcaaaagtgcggccaggagggtcgcatcgagggggcgccgccgggatgtttagaggaacccacccccgtggcaggccaagggccaaggatcgctatccttccctgaacccgggcgctcagctggcccgggtagggggcaggctccggccgccgaaacggggttggctgtagccggtggccggggagatctctagcttgcgcccgagcaccccggggtgtggggccagaggcaggccgaccccggcgtgcacaccgcccgccctgcacccgagcgctctcacccggtcttccctgaagcctgtgtattgcgaccgagcctctttaaagcagtagcggggcccgcggtcacgtgaggccgattcctggaaagttcctggaaagccgcctccgcagcagccgggcggggcgcgagcggagcgctgactggggagggaggcggggagcaagggaggcgcgtcggtctgggaagtcgcgcgcactcgctgctcctgggaccgacgtttaactcttgccaagtctcgtcgcagccgccgcggctggcgggccttgggcttcccctgaagcatgagccctctcgcccgcagccaccctcaccgcgtggcccgcggacagtgcgcgccggggtcccgggtgcacagcctcaggataccccgtgcccgcagctcgggcgcccgcggcaggtaccggtagtgggggaagcccgaaggctccgccccgaggagagttaccggggagggcggcgaggcgcggccgcgtgcgccggggagcggcggacggcctgggcttccgcagctcggagcgccggggaagagagagtccgaaccgcggctctgccccgcggcctagcgttgctgcctgctttctccagccccttctcggcgtctggaagtgtctggagtttcttttttttatttcccctaaactgccattcaaattaataatcctcctaataacctgatctcccgctcctccccaccggcctgcctcccgccctcgctccttcctccctccctccctctctccttcccacctccagggtcgcagccggagggaaacccggcagcagtccgagagtggaggtgtcccagcccgtagggggcgtcgccgcgcggtgggggatggggtcgaggcaatgatcctcgaggcttttgtgtgccctctgcgcacggaactccgaccgccgcctccgagcgcggggctggttgcatccccgggcatctcgttcccaaattaaacgttaacgggggaaacaagggcagacgcccctcctctcccgggcccctcccacctccccttttccccccacccccccgccccatgtccgctgaggaggctgcctggtgcggaggcggcggcggcggccgcggccgaggtcgaggtaagagcgcggcgttggtggtttgcattttccgcagcgctcgcgaccgcccgctcggccccggcctcgcctcggagccccgcgagggctgcgcgctcgggccgattcctcgacagcgcccgcggcggcgagaaccaccgcagccatcctggtccgggagcgaccgccgcggcacccccaaccccgccagagcgggcaccaggaagcggggggaggggagcgaggagcctcccgggcggagatgcggcagctcccgcacctccgcaccccgggttggtgcctcggggccccgcagcgctttagggcggagaaccaagtttgtgtgggtgcttcttcctgggggccctcgggctgcgccaggtgtgagaccggaatgccaatttggggaatctctcctgttctttcctttttaattttttctacttgtccttgacaagggcctattcccactggatctgcaggtgactatttgctcttcctaggtcgccagtctttgatttcagctagtgaccctgggcgggaagacaccctgttcaccctcctcctgacctccgccccccacctcttcagccaactttatcttggatctctgctctctttatcttttctctagagctgggccagggcgctaactggaagcttggggttaaatggtgcaggaacgtagaggcggaggagtccctgggattttccacgtctatttccccacccccaccccagccgcaggggtccagtttggactgacccaacctcccgctttctctttgtaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggtagggagccgatcggccgcgacgcgtgcgggagggagcgcctccccaaggaagcagctaggaagcggggtcgaggtgggaagcaaagaataagatggaaatacgtcccttgcttccaagggaccgcggagagcacgctcgcagggtcctgggtccttgggaatgcgtaaggaaagtggttctccagggactcaggcctggcggagcgcagagcgcgggaagagcttcttggaaatagcttcttagcacgctggaagatttactgttttccgcagctgctcagggttaggctcccgggctcgaaccccggccggggaaagcgtcgggcgcctccctttgcacggggtgcaatcagcaagtcggtgccgcgggccccgcaggcccagcagcatctggctcccgggcggagctgcggctgcagcccaggatcttggcggccaagttcagggactgacactgccgcgagggcggctgcccgggcgtcgagagtaggctgcgaagcccccgccgagcgcggcttccatggtcggcgcgcccagggtactgccgctttcaagtacagtcaggcaattcgcgcggcacgctgtctctaggcatctgaaaaaagaaaaaagaaaaaaagtaaagtatctggcaaatcattctggctttccaaatccgtatcctaaaagcttacagttgtggcacagttgaaattttggtagcaacagggggagggagagggaaaagttctctcgcttgcgattccggtctttccgtgtgggccacgggctttccctcccggggaggcaccggcagattgcaagtatcccggtaattgtgggggtggggggagcacaaatgttcagacttcttaaatacggacggtctctgagccttcttagaaagcagagtgggccggggagatggtgcaggcagatgaaatcaagaatgcaggggagatggatggttgtgattgggtttggattagggcaaagttcaaaagagtttagggaagattgtaaacttgaagtagtaattatcacttgggaattcccatttcttagtgactggtaaggtagtcataaagcagcgaacagaagctattgtactagagctgtgcttttacaacaagtacatagcagtgctttctacatagaaggctgttcatagcaggctttgcagattctttttttttttttttttttttttttggtggggggcacaccaaccatccaaaaaagttgcttctgtttttactgtagttcaattacaggagttgggttttccactttttaaagggcatggcttttatttctaacttctgatttttttctaatttacctaaatctttattttacttaaataatgttaaaagtgtcatgcttcatcagccagtgtgtcatgctgcagatgttcttttggttcattagaagaaaatcttaagaagagcttcagaaagttgattttttaaaaaagaaagaaaactggctcgccgtttgtgttcataaaatggacccaaatttttattaaattcctactgaaagtatttgtggtggcccggtaaactttcgctcacacaccaccttttttttttttcttttttagagctaaaaaaattattgccaattacttgctctgttctaagaattcttataataactgttttaccctcttttctttttctttttgaacaaaaaccccaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttctacaagttgcacttattgagttctagagaacgtacactttcatggtaatagaggattgccataaaaacttacgtcaagtgaaataagccaattattcaacaaaaggtagaacattacttgccattctgtaaagttatgggctgtacctgccccctttgcaatttggaaagcatggtttagaaactacaggcattgtcaagtggccgggtcttttataatttgaataggcataacactgatgtcctctgtgtttccaaaaacatggtttagaaactacaaacattatgacatggccagtcttttacaagttgagtaggcataatactaaagaaaaatacaaagttttgtggccacttattttttgctatgttagtctgcataactgttataaatgtaccatcttttctagagtccagacattatttattttatggctttaaaattttcctgcatagctacaatcctgtggtgtgtcaccataaaggtggaccctgtgtgaatgagaaaattcagttataaattgtaataaaacctgcttactgga

SEQ ID NO: 315 - DNA, 6347 bp, Homo sapiens
  source 1..6347: mol_type = genomic DNA
acctgatcaaggggaccgcctccggtccccggccgtgggcaccgggacgagcacggcgtccccacgccatcgatgtgtcttagagccggagagtctggtttccgaggacccacagtcgctcctgcacgcccaccccccgcaaaagtgcggccaggagggtcgcatcgagggggcgccgccgggatgtttagaggaacccacccccgtggcaggccaagggccaaggatcgctatccttccctgaacccgggcgctcagctggcccgggtagggggcaggctccggccgccgaaacggggttggctgtagccggtggccggggagatctctagcttgcgcccgagcaccccggggtgtggggccagaggcaggccgaccccggcgtgcacaccgcccgccctgcacccgagcgctctcacccggtcttccctgaagcctgtgtattgcgaccgagcctctttaaagcagtagcggggcccgcggtcacgtgaggccgattcctggaaagttcctggaaagccgcctccgcagcagccgggcggggcgcgagcggagcgctgactggggagggaggcggggagcaagggaggcgcgtcggtctgggaagtcgcgcgcactcgctgctcctgggaccgacgtttaactcttgccaagtctcgtcgcagccgccgcggctggcgggccttgggcttcccctgaagcatgagccctctcgcccgcagccaccctcaccgcgtggcccgcggacagtgcgcgccggggtcccgggtgcacagcctcaggataccccgtgcccgcagctcgggcgcccgcggcaggtaccggtagtgggggaagcccgaaggctccgccccgaggagagttaccggggagggcggcgaggcgcggccgcgtgcgccggggagcggcggacggcctgggcttccgcagctcggagcgccggggaagagagagtccgaaccgcggctctgccccgcggcctagcgttgctgcctgctttctccagccccttctcggcgtctggaagtgtctggagtttcttttttttatttcccctaaactgccattcaaattaataatcctcctaataacctgatctcccgctcctccccaccggcctgcctcccgccctcgctccttcctccctccctccctctctccttcccacctccagggtcgcagccggagggaaacccggcagcagtccgagagtggaggtgtcccagcccgtagggggcgtcgccgcgcggtgggggatggggtcgaggcaatgatcctcgaggcttttgtgtgccctctgcgcacggaactccgaccgccgcctccgagcgcggggctggttgcatccccgggcatctcgttcccaaattaaacgttaacgggggaaacaagggcagacgcccctcctctcccgggcccctcccacctccccttttccccccacccccccgccccatgtccgctgaggaggctgcctggtgcggaggcggcggcggcggccgcggccgaggtcgaggtaagagcgcggcgttggtggtttgcattttccgcagcgctcgcgaccgcccgctcggccccggcctcgcctcggagccccgcgagggctgcgcgctcgggccgattcctcgacagcgcccgcggcggcgagaaccaccgcagccatcctggtccgggagcgaccgccgcggcacccccaaccccgccagagcgggcaccaggaagcggggggaggggagcgaggagcctcccgggcggagatgcggcagctcccgcacctccgcaccccgggttggtgcctcggggccccgcagcgctttagggcggagaaccaagtttgtgtgggtgcttcttcctgggggccctcgggctgcgccaggtgtgagaccggaatgccaatttggggaatctctcctgttctttcctttttaattttttctacttgtccttgacaagggcctattcccactggatctgcaggtgactatttgctcttcctaggtcgccagtctttgatttcagctagtgaccctgggcgggaagacaccctgttcaccctcctcctgacctccgccccccacctcttcagccaactttatcttggatctctgctctctttatcttttctctagagctgggccagggcgctaactggaagcttggggttaaatggtgcaggaacgtagaggcggaggagtccctgggattttccacgtctatttccccacccccaccccagccgcaggggtccagtttggactgacccaacctcccgctttctctttgtaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggtagggagccgatcggccgcgacgcgtgcgggagggagcgcctccccaaggaagcagctaggaagcggggtcgaggtgggaagcaaagaataagatggaaatacgtcccttgcttccaagggaccgcggagagcacgctcgcagggtcctgggtccttgggaatgcgtaaggaaagtggttctccagggactcaggcctggcggagcgcagagcgcgggaagagcttcttggaaatagcttcttagcacgctggaagatttactgttttccgcagctgctcagggttaggctcccgggctcgaaccccggccggggaaagcgtcgggcgcctccctttgcacggggtgcaatcagcaagtcggtgccgcgggccccgcaggcccagcagcatctggctcccgggcggagctgcggctgcagcccaggatcttggcggccaagttcagggactgacactgccgcgagggcggctgcccgggcgtcgagagtaggctgcgaagcccccgccgagcgcggcttccatggtcggcgcgcccagggtactgccgctttcaagtacagtcaggcaattcgcgcggcacgctgtctctaggcatctgaaaaaagaaaaaagaaaaaaagtaaagtatctggcaaatcattctggctttccaaatccgtatcctaaaagcttacagttgtggcacagttgaaattttggtagcaacagggggagggagagggaaaagttctctcgcttgcgattccggtctttccgtgtgggccacgggctttccctcccggggaggcaccggcagattgcaagtatcccggtaattgtgggggtggggggagcacaaatgttcagacttcttaaatacggacggtctctgagccttcttagaaagcagagtgggccggggagatggtgcaggcagatgaaatcaagaatgcaggggagatggatggttgtgattgggtttggattagggcaaagttcaaaagagtttagggaagattgtaaacttgaagtagtaattatcacttgggaattcccatttcttagtgactggtaaggtagtcataaagcagcgaacagaagctattgtactagagctgtgcttttacaacaagtacatagcagtgctttctacatagaaggctgttcatagcaggctttgcagattctttttttttttttttttttttttttggtggggggcacaccaaccatccaaaaaagttgcttctgtttttactgtagttcaattacaggagttgggttttccactttttaaagggcatggcttttatttctaacttctgatttttttctaatttacctaaatctttattttacttaaataatgttaaaagtgtcatgcttcatcagccagtgtgtcatgctgcagatgttcttttggttcattagaagaaaatcttaagaagagcttcagaaagttgattttttaaaaaagaaagaaaactggctcgccgtttgtgttcataaaatggacccaaatttttattaaattcctactgaaagtatttgtggtggcccggtaaactttcgctcacacaccaccttttttttttttcttttttagagctaaaaaaattattgccaattacttgctctgttctaagaattcttataataactgttttaccctcttttctttttctttttgaacaaaaaccccaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttctacaagttgcacttattgagttctagagaacgtacactttcatggtaatagaggattgccataaaaacttacgtcaagtgaaataagccaattattcaacaaaaggtagaacattacttgccattctgtaaagttatgggctgtacctgccccctttgcaatttggaaagcatggtttagaaactacaggcattgtcaagtggccgggtcttttataatttgaataggcataacactgatgtcctctgtgtttccaaaaacatggtttagaaactacaaacattatgacatggccagtcttttacaagttgagtaggcataatactaaagaaaaatacaaagttttgtggccacttattttttgctatgttagtctgcataactgttataaatgtaccatcttttctagagtccagacattatttattttatggctttaaaattttcctgcatagctacaatcctgtggtgtgtcaccataaaggtggaccctgtgtgaatgagaaaattcagttataaattgtaataaaacctgcttactgga

SEQ ID NO: 316 - DNA, 5765 bp, Homo sapiens
  source 1..5765: mol_type = genomic DNA
aagggaggcgcgtcggtctgggaagtcgcgcgcactcgctgctcctgggaccgacgtttaactcttgccaagtctcgtcgcagccgccgcggctggcgggccttgggcttcccctgaagcatgagccctctcgcccgcagccaccctcaccgcgtggcccgcggacagtgcgcgccggggtcccgggtgcacagcctcaggataccccgtgcccgcagctcgggcgcccgcggcaggtaccggtagtgggggaagcccgaaggctccgccccgaggagagttaccggggagggcggcgaggcgcggccgcgtgcgccggggagcggcggacggcctgggcttccgcagctcggagcgccggggaagagagagtccgaaccgcggctctgccccgcggcctagcgttgctgcctgctttctccagccccttctcggcgtctggaagtgtctggagtttcttttttttatttcccctaaactgccattcaaattaataatcctcctaataacctgatctcccgctcctccccaccggcctgcctcccgccctcgctccttcctccctccctccctctctccttcccacctccagggtcgcagccggagggaaacccggcagcagtccgagagtggaggtgtcccagcccgtagggggcgtcgccgcgcggtgggggatggggtcgaggcaatgatcctcgaggcttttgtgtgccctctgcgcacggaactccgaccgccgcctccgagcgcggggctggttgcatccccgggcatctcgttcccaaattaaacgttaacgggggaaacaagggcagacgcccctcctctcccgggcccctcccacctccccttttccccccacccccccgccccatgtccgctgaggaggctgcctggtgcggaggcggcggcggcggccgcggccgaggtcgaggtaagagcgcggcgttggtggtttgcattttccgcagcgctcgcgaccgcccgctcggccccggcctcgcctcggagccccgcgagggctgcgcgctcgggccgattcctcgacagcgcccgcggcggcgagaaccaccgcagccatcctggtccgggagcgaccgccgcggcacccccaaccccgccagagcgggcaccaggaagcggggggaggggagcgaggagcctcccgggcggagatgcggcagctcccgcacctccgcaccccgggttggtgcctcggggccccgcagcgctttagggcggagaaccaagtttgtgtgggtgcttcttcctgggggccctcgggctgcgccaggtgtgagaccggaatgccaatttggggaatctctcctgttctttcctttttaattttttctacttgtccttgacaagggcctattcccactggatctgcaggtgactatttgctcttcctaggtcgccagtctttgatttcagctagtgaccctgggcgggaagacaccctgttcaccctcctcctgacctccgccccccacctcttcagccaactttatcttggatctctgctctctttatcttttctctagagctgggccagggcgctaactggaagcttggggttaaatggtgcaggaacgtagaggcggaggagtccctgggattttccacgtctatttccccacccccaccccagccgcaggggtccagtttggactgacccaacctcccgctttctctttgtaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggtagggagccgatcggccgcgacgcgtgcgggagggagcgcctccccaaggaagcagctaggaagcggggtcgaggtgggaagcaaagaataagatggaaatacgtcccttgcttccaagggaccgcggagagcacgctcgcagggtcctgggtccttgggaatgcgtaaggaaagtggttctccagggactcaggcctggcggagcgcagagcgcgggaagagcttcttggaaatagcttcttagcacgctggaagatttactgttttccgcagctgctcagggttaggctcccgggctcgaaccccggccggggaaagcgtcgggcgcctccctttgcacggggtgcaatcagcaagtcggtgccgcgggccccgcaggcccagcagcatctggctcccgggcggagctgcggctgcagcccaggatcttggcggccaagttcagggactgacactgccgcgagggcggctgcccgggcgtcgagagtaggctgcgaagcccccgccgagcgcggcttccatggtcggcgcgcccagggtactgccgctttcaagtacagtcaggcaattcgcgcggcacgctgtctctaggcatctgaaaaaagaaaaaagaaaaaaagtaaagtatctggcaaatcattctggctttccaaatccgtatcctaaaagcttacagttgtggcacagttgaaattttggtagcaacagggggagggagagggaaaagttctctcgcttgcgattccggtctttccgtgtgggccacgggctttccctcccggggaggcaccggcagattgcaagtatcccggtaattgtgggggtggggggagcacaaatgttcagacttcttaaatacggacggtctctgagccttcttagaaagcagagtgggccggggagatggtgcaggcagatgaaatcaagaatgcaggggagatggatggttgtgattgggtttggattagggcaaagttcaaaagagtttagggaagattgtaaacttgaagtagtaattatcacttgggaattcccatttcttagtgactggtaaggtagtcataaagcagcgaacagaagctattgtactagagctgtgcttttacaacaagtacatagcagtgctttctacatagaaggctgttcatagcaggctttgcagattctttttttttttttttttttttttttggtggggggcacaccaaccatccaaaaaagttgcttctgtttttactgtagttcaattacaggagttgggttttccactttttaaagggcatggcttttatttctaacttctgatttttttctaatttacctaaatctttattttacttaaataatgttaaaagtgtcatgcttcatcagccagtgtgtcatgctgcagatgttcttttggttcattagaagaaaatcttaagaagagcttcagaaagttgattttttaaaaaagaaagaaaactggctcgccgtttgtgttcataaaatggacccaaatttttattaaattcctactgaaagtatttgtggtggcccggtaaactttcgctcacacaccaccttttttttttttcttttttagagctaaaaaaattattgccaattacttgctctgttctaagaattcttataataactgttttaccctcttttctttttctttttgaacaaaaaccccaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttctacaagttgcacttattgagttctagagaacgtacactttcatggtaatagaggattgccataaaaacttacgtcaagtgaaataagccaattattcaacaaaaggtagaacattacttgccattctgtaaagttatgggctgtacctgccccctttgcaatttggaaagcatggtttagaaactacaggcattgtcaagtggccgggtcttttataatttgaataggcataacactgatgtcctctgtgtttccaaaaacatggtttagaaactacaaacattatgacatggccagtcttttacaagttgagtaggcataatactaaagaaaaatacaaagttttgtggccacttattttttgctatgttagtctgcataactgttataaatgtaccatcttttctagagtccagacattatttattttatggctttaaaattttcctgcatagctacaatcctgtggtgtgtcaccataaaggtggaccctgtgtgaatgagaaaattcagttataaattgtaataaaacctgcttactgga

SEQ ID NO: 317 - DNA, 5065 bp, Homo sapiens
  source 1..5065: mol_type = genomic DNA
gcttttgtgtgccctctgcgcacggaactccgaccgccgcctccgagcgcggggctggttgcatccccgggcatctcgttcccaaattaaacgttaacgggggaaacaagggcagacgcccctcctctcccgggcccctcccacctccccttttccccccacccccccgccccatgtccgctgaggaggctgcctggtgcggaggcggcggcggcggccgcggccgaggtcgaggtaagagcgcggcgttggtggtttgcattttccgcagcgctcgcgaccgcccgctcggccccggcctcgcctcggagccccgcgagggctgcgcgctcgggccgattcctcgacagcgcccgcggcggcgagaaccaccgcagccatcctggtccgggagcgaccgccgcggcacccccaaccccgccagagcgggcaccaggaagcggggggaggggagcgaggagcctcccgggcggagatgcggcagctcccgcacctccgcaccccgggttggtgcctcggggccccgcagcgctttagggcggagaaccaagtttgtgtgggtgcttcttcctgggggccctcgggctgcgccaggtgtgagaccggaatgccaatttggggaatctctcctgttctttcctttttaattttttctacttgtccttgacaagggcctattcccactggatctgcaggtgactatttgctcttcctaggtcgccagtctttgatttcagctagtgaccctgggcgggaagacaccctgttcaccctcctcctgacctccgccccccacctcttcagccaactttatcttggatctctgctctctttatcttttctctagagctgggccagggcgctaactggaagcttggggttaaatggtgcaggaacgtagaggcggaggagtccctgggattttccacgtctatttccccacccccaccccagccgcaggggtccagtttggactgacccaacctcccgctttctctttgtaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggtagggagccgatcggccgcgacgcgtgcgggagggagcgcctccccaaggaagcagctaggaagcggggtcgaggtgggaagcaaagaataagatggaaatacgtcccttgcttccaagggaccgcggagagcacgctcgcagggtcctgggtccttgggaatgcgtaaggaaagtggttctccagggactcaggcctggcggagcgcagagcgcgggaagagcttcttggaaatagcttcttagcacgctggaagatttactgttttccgcagctgctcagggttaggctcccgggctcgaaccccggccggggaaagcgtcgggcgcctccctttgcacggggtgcaatcagcaagtcggtgccgcgggccccgcaggcccagcagcatctggctcccgggcggagctgcggctgcagcccaggatcttggcggccaagttcagggactgacactgccgcgagggcggctgcccgggcgtcgagagtaggctgcgaagcccccgccgagcgcggcttccatggtcggcgcgcccagggtactgccgctttcaagtacagtcaggcaattcgcgcggcacgctgtctctaggcatctgaaaaaagaaaaaagaaaaaaagtaaagtatctggcaaatcattctggctttccaaatccgtatcctaaaagcttacagttgtggcacagttgaaattttggtagcaacagggggagggagagggaaaagttctctcgcttgcgattccggtctttccgtgtgggccacgggctttccctcccggggaggcaccggcagattgcaagtatcccggtaattgtgggggtggggggagcacaaatgttcagacttcttaaatacggacggtctctgagccttcttagaaagcagagtgggccggggagatggtgcaggcagatgaaatcaagaatgcaggggagatggatggttgtgattgggtttggattagggcaaagttcaaaagagtttagggaagattgtaaacttgaagtagtaattatcacttgggaattcccatttcttagtgactggtaaggtagtcataaagcagcgaacagaagctattgtactagagctgtgcttttacaacaagtacatagcagtgctttctacatagaaggctgttcatagcaggctttgcagattctttttttttttttttttttttttttggtggggggcacaccaaccatccaaaaaagttgcttctgtttttactgtagttcaattacaggagttgggttttccactttttaaagggcatggcttttatttctaacttctgatttttttctaatttacctaaatctttattttacttaaataatgttaaaagtgtcatgcttcatcagccagtgtgtcatgctgcagatgttcttttggttcattagaagaaaatcttaagaagagcttcagaaagttgattttttaaaaaagaaagaaaactggctcgccgtttgtgttcataaaatggacccaaatttttattaaattcctactgaaagtatttgtggtggcccggtaaactttcgctcacacaccaccttttttttttttcttttttagagctaaaaaaattattgccaattacttgctctgttctaagaattcttataataactgttttaccctcttttctttttctttttgaacaaaaaccccaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttctacaagttgcacttattgagttctagagaacgtacactttcatggtaatagaggattgccataaaaacttacgtcaagtgaaataagccaattattcaacaaaaggtagaacattacttgccattctgtaaagttatgggctgtacctgccccctttgcaatttggaaagcatggtttagaaactacaggcattgtcaagtggccgggtcttttataatttgaataggcataacactgatgtcctctgtgtttccaaaaacatggtttagaaactacaaacattatgacatggccagtcttttacaagttgagtaggcataatactaaagaaaaatacaaagttttgtggccacttattttttgctatgttagtctgcataactgttataaatgtaccatcttttctagagtccagacattatttattttatggctttaaaattttcctgcatagctacaatcctgtggtgtgtcaccataaaggtggaccctgtgtgaatgagaaaattcagttataaattgtaataaaacctgcttactgga

SEQ ID NO: 318 - DNA, 5065 bp, Homo sapiens; identical to SEQ ID NO: 317
  source 1..5065: mol_type = genomic DNA

SEQ ID NO: 319 - DNA, 4220 bp, Homo sapiens
  source 1..4220: mol_type = genomic DNA
agagctgggccagggcgctaactggaagcttggggttaaatggtgcaggaacgtagaggcggaggagtccctgggattttccacgtctatttccccacccccaccccagccgcaggggtccagtttggactgacccaacctcccgctttctctttgtaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggtagggagccgatcggccgcgacgcgtgcgggagggagcgcctccccaaggaagcagctaggaagcggggtcgaggtgggaagcaaagaataagatggaaatacgtcccttgcttccaagggaccgcggagagcacgctcgcagggtcctgggtccttgggaatgcgtaaggaaagtggttctccagggactcaggcctggcggagcgcagagcgcgggaagagcttcttggaaatagcttcttagcacgctggaagatttactgttttccgcagctgctcagggttaggctcccgggctcgaaccccggccggggaaagcgtcgggcgcctccctttgcacggggtgcaatcagcaagtcggtgccgcgggccccgcaggcccagcagcatctggctcccgggcggagctgcggctgcagcccaggatcttggcggccaagttcagggactgacactgccgcgagggcggctgcccgggcgtcgagagtaggctgcgaagcccccgccgagcgcggcttccatggtcggcgcgcccagggtactgccgctttcaagtacagtcaggcaattcgcgcggcacgctgtctctaggcatctgaaaaaagaaaaaagaaaaaaagtaaagtatctggcaaatcattctggctttccaaatccgtatcctaaaagcttacagttgtggcacagttgaaattttggtagcaacagggggagggagagggaaaagttctctcgcttgcgattccggtctttccgtgtgggccacgggctttccctcccggggaggcaccggcagattgcaagtatcccggtaattgtgggggtggggggagcacaaatgttcagacttcttaaatacggacggtctctgagccttcttagaaagcagagtgggccggggagatggtgcaggcagatgaaatcaagaatgcaggggagatggatggttgtgattgggtttggattagggcaaagttcaaaagagtttagggaagattgtaaacttgaagtagtaattatcacttgggaattcccatttcttagtgactggtaaggtagtcataaagcagcgaacagaagctattgtactagagctgtgcttttacaacaagtacatagcagtgctttctacatagaaggctgttcatagcaggctttgcagattctttttttttttttttttttttttttggtggggggcacaccaaccatccaaaaaagttgcttctgtttttactgtagttcaattacaggagttgggttttccactttttaaagggcatggcttttatttctaacttctgatttttttctaatttacctaaatctttattttacttaaataatgttaaaagtgtcatgcttcatcagccagtgtgtcatgctgcagatgttcttttggttcattagaagaaaatcttaagaagagcttcagaaagttgattttttaaaaaagaaagaaaactggctcgccgtttgtgttcataaaatggacccaaatttttattaaattcctactgaaagtatttgtggtggcccggtaaactttcgctcacacaccaccttttttttttttcttttttagagctaaaaaaattattgccaattacttgctctgttctaagaattcttataataactgttttaccctcttttctttttctttttgaacaaaaaccccaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttctacaagttgcacttattgagttctagagaacgtacactttcatggtaatagaggattgccataaaaacttacgtcaagtgaaataagccaattattcaacaaaaggtagaacattacttgccattctgtaaagttatgggctgtacctgccccctttgcaatttggaaagcatggtttagaaactacaggcattgtcaagtggccgggtcttttataatttgaataggcataacactgatgtcctctgtgtttccaaaaacatggtttagaaactacaaacattatgacatggccagtcttttacaagttgagtaggcataatactaaagaaaaatacaaagttttgtggccacttattttttgctatgttagtctgcataactgttataaatgtaccatcttttctagagtccagacattatttattttatggctttaaaattttcctgcatagctacaatcctgtggtgtgtcaccataaaggtggaccctgtgtgaatgagaaaattcagttataaattgtaataaaacctgcttactgga

SEQ ID NO: 320 - DNA, 173381 bp, Homo sapiens
  source 1..173381: mol_type = genomic DNA
gccattaacaaagatggtgcttatggggcaggttccctaacagtcaggattccggttgcagtttttctcccccgccccaaagatacgtggttgcagacgtaagtaacaggaatccatctttctttgaaagtcctgcattgtagcgtctgcgacctgggccctgcgggggcttccccgccccgctaacttgctccgcatttccgatccgggccaaggctgggtggctgcggcagtgccggaggcccgctctccccttggtccgctctttagttcattcccagcactccctctttagcgggtcaagttgccgcagaaaccgcccgtagtcttcctgtttgatacaagggtttcagcggccgaagcagagcctttttaaatagttcccaatgggcgctcacggccaaacgtgaacacctcccctcctcacctgtcacctcctgaactttacagggttgcgagggggagtgtgggatcgggtgtcgcctagccgtggtcgtactgcccgggtgtgtctgaagccccatctgtcatccctgcctgccttcccggtcacttaaccttcactgccttacacacaaccaagccacagcacactggtgcaggggtggtggaactgcaccttcaaatcgtgcctggctactgaccagtgctggggtgtgtgctttttttgaaagaaaaaaatcccataaaatgtcccatgcatgtgcggccacgacagtgttgtgctggagattcggaattcttagtgggaaggaatggagtctgtgactgtatattgtgtaaagtttattgtagactgggcacaaacaacaattttcttaaaggtgatcgtgtagaggacttttagcgaaaagagccttaaattctgaacctgctgatttctgtcctgcactcctattactgatcaggttttgcaaatacttgtgatcaaaaaaaggggacctgcgtccaccttggcagtttctgccttggtggtggtggtgcaggtctgatgagggcaatgtgaaaataaaaccaccatttcttctccagcgtgttaaaattagtgctgctctgtaatcttcagataaaaattgcttgttcagaagggtctctgacccactttttttttttctttttccaaatttctttattgaacgaggaattgagctgggaccccattgtgtgaaaagcagaaacagaaaagatgattcatcttcattgttgttcattatgttaggaaacattcaaaattaacctggcttggcttaatcagtgaattaaataccatgacctggcagtctgctatggtttaaagatgtgcttgacctgaaggaacttacattgcagtgacactgtctttagggccacatcaacatgtctgtaatttgagctgtgattttggctctttccagggagaaatggaggccagagacaaacaagtactccgctcacttcgcctggagctgggtgcagaggtattggtggagggactggttcttcagtacctctaccaggaaggaatcttgacggaaaaccatattcaagaaatcaatgctcaaaccacaggcctccggaaaacaatgctcctgctggatatcctaccttccaggggccctaaagcatttgatacattcctagattccctacaggagtttccctgggtcagggagaagctgaagaaggcaagggaagaggccatgaccgacctgcctgcaggtaggcctcagaaagatcactttgaaccagctccaaaatgttgtaactatgctctttgcttttttgtttatttgtttgtttgtttttgagacagagtcttgctctgttgcccaggctggagtgcaatggtgtgatctcggctcactgcaacctctgcttcctgggttcaagcaattcacttgcttcagcctcccgagttgctgggaatacaggcatttgccaccatgccctgctaagttttgtatttttagtagagatggggtttcatcatgttggccaggctggtctcgaactccgtacctcaggtgatccacccacctccgcctcccaaagtgctgggattacagacgtgagccaccacacctagccagaactatgccctttggatttgaagttgggatgtaaggcaggacaagggtcaatggttgatgaaagtgggtaaggatttgggactgaagggacatgacgttggaggaataggatcaggaggtggcattaggaagtgcagggaaggaagaatgaaccgtgactgggaggtgagggagggagctcagagaatgcatttagaaatgcttccaggaaacctggcatgtcacttgggaagcatgttctcatcagagagccaggtcatatctcagccgttggcatcaggagccatttggaaagtgcagatgggaaagcaggcattcggcctactgacaactgatttgtgaggtgccagagctaccagctggaaaaggtcagattcatggaggaggagacagcctctaggaaggcatgccctgcacctgtcccctgggctgtcctgtgtggccaaaggggattattttgaaggctgacttagtttgtttttaaaggttattcgtttaaagtgtcctttttagtttagctttgttcagacactggagtatttaattttgcaaagagcaatagtttggggagggtctcagtttaatttgaaggagaattggaagctggagaagagagaaacagttctggttctgttagcctggcttgtagcaggaagaagatgtgatatggaaacacttgctttttcttaacctcccttgactctgtttcacaaagatagaggggcagagaactgaactggcaaaaattaaaaattgaaaaaaaaaagtaattgaaagttggcttgcaaatttttaacaaagttagagaatcaaggttctctggggtttctgataagagtgatagaactattccggttcagtgggccccagacttcgtggttgctattttttaaatactggttaaaaaaaatgaatactgataataagaccacttttactatttttgctccatggacctcatattttgacatatgtctgaatacctgatcagcatgacatagccagctaactttaggaagacctggtaagatcccagtggaaaaagcaaaagtattttcattcctagtctgggctcgttacagttaaatgtatctttaggctttttgaaatattagacatagctggcttttgaggaccactggaattcactgcttggattgtccttacaaaattaaatactccacatgtctgaacaaaatgtatctagatgtttttatgactttattgaaagcagaatagataacatagagttggagaaatgttaaaaaattattggtgttttcctgatatttgacttagaggtttctgctggcatcatatagttggaaacaacaaaacaggtgaactgaaagcctttcactatcaaaatactgaatttaattttatggtcattttgggtgatacagatcatgctgttgtatgtcattcgtagaggtataataccatttttttttttttgagacggagtttcactcttgttgcccaggctggagtgcaatggcgcgatctcggctctctgcaacctctgcctcccgggtttaagcaattcttctgcctcagcctcccgagtagctgggattacaggcatgtgccaccatgctcggctaattttgtatttttagtagagatggggtttctccatgttggtcaggctggtcttaaactcccgacctcaggtgatccgcccacctcggcctcccaaagtgctgggattacaggcgtgagccaccatgctcggccataaccccattatttcttcagattcattcagagagttagaaagaattaaggcattttttacaaaatgatgagagttacagagaagctgaggaaaaatagctttttaaaaaagcaaacagaatgaagcagtacataatgggaaaaaaattgagcatatctgtgtagaagtttagaaaaataaggtttttctcaagatttgttaattctgtagaaggttggctctggaacaaattcgtacagtcatcttaattgttttactttttactgagtaacactgctattgaaaaaaacattctgaagtgagggtttgatttatatatgtctttgaataccttccacggtgacaatcacataaactcttttaaaaaagacttgtatttattaaatattgactattttaaataatattacaaaatataagtaagatatggagaataatggtacagcgaacacccgtctcctcatcactcagtttaagaaaaataatattacgattgcctttaaaaaccccgggcactccttcccaatcttgtctcattcccaacccccacgcagtgaaaagccctgaattgggggtttatcattcattcacttcttcactttatagtttcctatctcctaaaaatcacttttaaaatcttcatatgtttttgaaaatcctgtataccgtaagttctagaggtgtgtgtgtgtgtatatgtatatatgtatatagagagagatatatatgttttttgtgtgtgtgggaaggaaagggtggaagtaatggaagaaattatgcatttaaacttgatagttaacaccttctcttgtttcagaacttaaaatattttttacatgtttaaagtaatttaattggtggcaatattttaattctaaaattaaattgggatttactgaattggaaacctaggttttgttattttgtaaatcctgggaagagtatcagagttgaaatcccttcaatttaacgtccctataaaaaagaaatccagaacctactgcctaagacctcggtgcttctccagtgttgtaattgagtaattttagtaagatttaaaatagtccacttaaatttttgtaaagatatctttgagttttgaggatctagactataggagaatgtgtgtacacattaacctcttaatgtatgtacacattaaactcttcctaccttttcctcattttgatcatacttattaattaatttgtatggattcagtagtctcttgggaggccttgagaacaaatgggaaggaatggccttcttttttagccaagacgttgatccttctctaagaatgaactgattttatcttattaaggttttcttgtgttggtcttcccagagatgcttggtttcccctttattggtttgttgttttaattttcgttgtttcacttgtaaattttgagctgtctcagaggctttattttggtgattgttcctggttagttgctttttacttatgtgctggatgtaatttgtttagagaattgagctgtatcttgttcttctctactcttctgaacgccacccccatcaaatctcaaaacatacaaaaacaccctaaaccttttgattctctcagaatctgcctctgtgactagtctcccaatctctgttaggaaaaaaaaaaaggtttaagttgttaaagttgttaatggatcattggttttgtgtttttctcaccctgtaaggactcttaccttttaaaagaggaattctggtgataaaatgacttaatccaccttggcaccgtggagagaacacttcatggtttgtctctctggccaaggtcacatactagacattagatcagctggaaatcctctctgggctcctgtcaggtcatttaggagatagggacagtgccgtgtctgggtgaaggcagcctgtgcctgcctgcctggcttctcactgctcatggggcctgtcggcactgacaggctccctccagtgcctgagctaatctggatctggaaaggaggttgatggcagcccagcctccccatctggtgggactcagcgtaaatcacggtgggagtgactcctgggccacaggaccccctccctgttccactgtgttggccctggctgtgggtctgggtgtctgccatgattctctgccttttgccccagtcttcctttaagcttgggagtgtttttgtttttctctcctccgttggtttgattcatgctttatgtattcttagccatggcgagagtgaagaacagagctctgggaacacagctcggtgcctccggcatcagcattggatgtctcaactcttgagcctgttggaatggctgtccctaagctgacacttgcttcaaccttctctgggcttgatcttgtcctccccatagactctgtgccctggactccctggctgctcttacaacagcagtgcgcaggactggctagtccatttcccctctacctgtgggctcaagggctctgcctgccccttgtggcgccagccttgagtgacaacacagaaccacacctgccgccctcctgagatacattctagctctgagttgcatacttggatgcatctaaagtcactgagctcttaatggcagatattttagatattgtgatgggtttattagagaggtttctagcttgggattcttttcataggttcctccaatcataccacgtaattgaccttgctctgcatgtaagttcagtgttggtctcagtgtatctagcttgcagtctatccatgtgcttccactgtgactgagtagtgtttgcctagtggcgtcctgtgtgctagagtgagaacagtgggtcagtatccatagcaagacccttccctcggtaaagggagagtctgcagagggcccaggtttctgtgtatacccagcccgattttcatatacttcctaaggacctactgaatgccaggtactgggtatataaagacaaatggaggatctccagatcagttgagggcattcatgcgttcatccagcaaatatttgctgagtcttgaccatgtgctaaaccagaggtccccagcctttttggcgtcagagactggttttgtggaagacaatttttcaaccaacgggagagttggggggaatgatggtttcgggatgaaactgttccaccttagattattaccaggcattagattctcataaggagtgcgcgacctcgatctctggcatgtgcagttcacaataggttcatgctcctatgagagtctaatgccactgctgatccaataggaggaggagctcaggtggtaatcctcgcttgcctgccacttacctcctgctctgcgatccggttcctaataggccacggaccggtatgggagttggggacccctgtgcaagacagtaggtgctggagatataacagtaaacaaaacaaagcccttattttcatggagttcaatgtattctagtagagggaggggataagggcagggacagataataagcaaatgaataaataacatttggtggtgaagagcgctatgaagagaagcggtatgtgtggtggtgggggtggtcagggaaagcctctctgatgaggggacactgagcagagaactgagtttggctgcagagttgatacagggaggagagctttcagatagaggggaccacaaatacacaggaagtcaagtgggagccacaggtgacaatgtggctaataagacaccttcctccctgggatgaatcacattccacatcagcagaggctcagtggctaccttttgttttgctctcaacatgtgagatgtgtgtgcagccgtgatcttgtgtggctcgtagcatgactttagttgatacgtggatgtgggattaagtaatattgaattacatgatgagaaagttatttcctttctatttctgtttcagttcggtaagaatgataggaggtcctcatgcttaaagccttctgtgggcaacagtatttagctagaatctagttgtattgctttttttgtgtcaacttaatgggttccttccatttatggcaagcaaaacttttctatttacgaagttccttttaaaaatacatgacttttagagactagaattgtggttattagggactgggaagggtatgagggaggcagggatggggaggttggttaatggatacaaaattacagctagatgggtggaataagttctaatgtcctagcactgtagggtgaatatggttaacaggaatttattatgtgttttcaaaatgctagaagagaggattttgaatattcccagcacaaagaaagaataaatgtttgacatgatggatatactgattgcccttatttgatcattacacattgtatgcatgtattgaaatgttaccctgtatcccataaatatatacaatttttatgtatcaaccaaaaataaaaagaaaaatgttcataggaatattgaataggaaataagattgaaagtataccaaattatttaggaaaaaaccattacttacatttaagtagaaatgtgtcaacataaaggagactataaaaaaataggccaggcacagtggctcactcctgtgatcccagcattttgggaggccgaggcgggcagatcacctgaggtcaggagtttgagaccagcctggccaacatggtgaaacccccatctctacttaaaatacaaaaattagccaggcgtggtggcaggcgcctggaatcccagctacttgggaggctgaggcaggagaatcgcttgaacctggcaggtggaggttgtagtgagctgagatcgcgccattgcactccagcctgggggacaagagcgaaacttcgtctaaaaaacaaaaccaacggaaataatggttgggtgtagtggctcatgcctgtaatccctacactttgggaggctgaggcgggtgaatcacttgaggtcaggagtttgagaccagcctggccaacatggtgaaaccccatttttactaaaaatacaaaaaattaaccgggtgtggtggcaggcacctgtaatcctagctagtcaggaggctgaggcaggagaattgcttgaactcaggaggtggaggttgcagtgagccgagattgtgccactgcactccagcctgggcaacagagtgagactccatcccccccaaaaaaaaaaaaaaaaaaaaagaaaagaaaataataatggtgtgaggatgtggccaaaagttgcttttcatcatatatttttttaatttaaaaagaaagacaggcatttgggggaggagccatcacctggctggcatagttaaagcaggaaggctccagttctagtatagatagtagatagagctgttttcatgatgcttcacagttttgctctttcaatttatgcccagtgataggaattagttaaattaactagaatttcaaaattcgtaagttctctaaattttaaacacatttacttgctagtgaaacaaagtcagcaagatggagccatatcctggtattatgaattttagaactgggtgggactcacaggtcatctaatttttctctgagaaaacagaggcctagggagattaagtcaacttgcccatgatcacacagctagttaatgtaatttattactgggactagaatccaggctttgcaactcttgatttaggactttttctgctgcgcaatcttggcttcccactgagtttgaaatggaattgtattatgctgcagtgttaataattgaaagaggctttttaaaaattgtactaatgcatttttttttttttcattttaagaggagaatttccaagggcctttagaggtatgctggaatgagatttcactaaaatattttatttttatgaatgctaattttaatcatttaaaaggaaatgatgatcgttcagtactgcattttgtcacaagatttttttcttcctacctctgcaaggctgacataaaggaaaagcggaagactttcatcgagtatttatgggactgatgaaataatgcatctgttggcagctaattgcaggtctttctaggaatagcaaacatgtgacaggtcttgccccagcggagatgcctccatttcactttaaaacatggatttggtattcttttcacttagaaattctggctatgcctttttttctcccttctgtggatgtatagaccgttcggctgcatcagacactgtattgaacatcagggttgatttaactcattgttgctcagctgtggctatgctttggaatcacctggggagcttttacaaaactactgatgcccaggctctactccaggtgaatccattacacaatctctggagggtgggttctgggcaatgggatgttaaaggcacacacgggcatgcccatgtgtaagtcaggcacacgtacaaatgcttcgtgaggtcatcttaaattgcagccggggttgagaaccttgagctctgaccagctggttaggagcgtgcctccttcctcactcactgcttccaagtcgtggcttcccaaagctgtgtacttgcttgaagcattgttcttattttcaggtagcaccagatggaagggtggtaggaatcagggtgtagagggatattagtttgcaaatccttttattccttgaatttcctgagcattgttgctcaagaatgttccagaatctcagaccccatacagggggtgatgctgctaccaacattaaaatccattagggctctatggggatatataggctacacacatgaggcaacaattggaggagtttgaattgctagtgaatttgaatttgggaattatttttattgctattcacattgtttggtacagtcattacaaactacatgcagtaccttgtgctctgtagatcaggttatgtccaaatggagacagagtctcctgctgaagaacgagttggatgctcctctcagttaaaaagtgagctgaagatggctcgaggatggaagagagaaggagagacaaatggctagttgggaagagtgggactggcttagtctgtcagactggctgtctgtctgctcatggtctttattcataattaaaaatgaatttcaggccaggtgcattggctcacgcctgttaattccaacagtttgggagaccaaggtgggaggatcacatgaggtcaggagttcaagaccagcctgggcaacatggcaaaaccccgtttctactaaaaatacaaaaagtagctgggcatggtggcacacacctgtcatcccagcttcttgggtggctgaggcacaagaatcacttgaacccaggaggcagaggttgcaatgagtcgagagcacactccatcctgggtgacagagtgagaccctgtctcaaaaaaaaaaaaaaaagcaaaagcagtcttttgtgtctcacaaagaacttcagataacatcagtaaaataatcataatagctagtggggacttactgtctgccagctatattctaagtcctttgtgtttattaattcatttaatcctgacaataacttgatgagggaggtggtattattacccttttgaacagatgcgaaaatgtaagcacagagatagatgttaaataacttacttaaagtcacacaacataaagtcaaatttcacttcaaggcctactgattcatatcttataaaaccactttctcggcattcagttttctcctcttcctaattctgataacctgtggctgctccagagcccatcaccctaattcttcttcagaaactcccctacttccagtttcttccagacacacagcctcaggaggctttctctttcttgcctcttgtcctaaggctgattcctggttggtatctctctcgtatctctcattttatacttttttggttgggggaaggctagggtctaatggaagaccatacggtggggaggggtcatggaacagagcccctgaatctctcccatttcaacttgctactttgagagtaaaaaaaagactaaatctccttggctgtgatcaggagatagtgtgttggctcccctgatactggaatccagtcccacttttgcagctcttaaatcttgctatctaaagccctcagttccaataaccagcttttctggtggtgcagcttcagagtttcaccaaatgcttagcaaggtagtgttctctttttatgggtgtagttcaaacttgtaggctgctgttatagctagctgtgggaatgtttgctttacataatgttaataggcagctgtgtttatgcttgttcctcagtttaagcagtaaggagtgtatacatatgattctttgagggcatttcccccagactaaaaaaaagaaaaaaaggtatgttgtgttttttccaacagtaaattttaattgaaaaggaatgtagtttctagaagaagtttggggcaggttttactcctaggctttattttgttaatgttatgaaagaaactttaactccttctaagaagtgccaagttgacaattcctggaaatgttcatgttctatttatgctcagcaccatagcagacagggtggcaataccattaccaaaataataccgccgagatgtactaagtgacaaatgagaggcttctggttttataacctaaatacaagactttaaaagcatctcccaattctaccatttgttgataaggtctgtgggtgctgagtagtaatggtgaagttgctgtggagaattatagatcaagtagagcgtatctgcagtgacttgtcctgttgctagaactatagaaggttagagttggaagggatcttagaaacactttatagatgaggaaacgaagggatatccaagtctaacagcatgcatatgggttcttctgttcaaatagtagaacttcatgtaacataaaaataggaatttctctgaaatatattgggtagttcacaactttgaaggaatgataaaggtttcagggcttaataagggcaggaatgaggcaacagtgggggatctcaggccatcagatggtcatcttcaatcaagtttctacactgtaccttccttccagattcagactattggccaaacttgggtcctgagcccttcctctaggacaccagaatcacctgaagtggggaaaggaagttccaaaagaaagagtgaaagctgattgaagcaagagttgtctactgtgccatccttcttctttttggattgaataggtctcacgcccatgggcctggaaaacaaatgatagccctttaagggaggaggttgctttacctcttcttcatacagcaaggcccaggttgagggccaaaggtggtagataaaacgctggagagcagttttggagcagcataggtctccttaaacttttccaaaatcagaatgtattgggggagaaaaatggattgagaatgtagatgtaaagaggaggtttagaaagagaatttgaattgggtactggcctaagggctttagatatataaactcactttattatcataatagccctttgaggtaggcactactgttatcatttgcatttcacagatgaggagactaaggtgttagataaattgctcaaggtcacacagtttggcagtagcagagctgaggttcaaacactgacagtctggctcacagtctgtgcttctaatcactagggtcctgtctctatcggtctactaccagttcttagatctgattggagtcacatggcttagatgacctgacctgggctagctgcagcttctttattttctgacccttgcttgcctcaggtctcacacatagccggcattttcattatgtgtatgtcagtctcttttttaacagttaccaaattttaaaaaatacaaaagaaaatgaaagatgttttctaagaaatatgattaggtaaaataaaggttttgaatgtgattgatgtggacatttttgttcatttagtttttaaacatatctcttccctttcaatctctttattattaattagttatgtgctacgggcaaatgtgacttttcaggcctttcatatttgtttgagcccttttattccatcatgtgccagtcacaattcattcaggagacagaaaccacacagtaatttaaatagggaaaacttaatataaagaattttcttttgttttctttttttttttttttgagacagagttttactctcgtcgcccaggctggggtgcaatggcgcgatcctggctcactgcaacctccgcctcccgggttcaagcaattctcctgcctcagccttccgagtagctgggattacaggtgcccgccaccatgcctggctaatttttgtattgttagtagagacagggtttcaccatgttggccaggctggtctcgaactcctgacctcaggtgatctgcccgccttggcctcccaaagtgctgggattacaggcatgagccaccgtgcctggccaatataaagaatttttaactggtgaaaagcaaaccatggttaaccactaaatggggtaaaagaggtctctaagtaatacaggaatggcagaagctactttttctgaggttgaaaggtagtgcaggatacagtcactaagaatgtggaagagggccctccccacctctaaggctgagattcagacttcggtggagttgaagtgactgtcacactagctggtctgtaagagcagcctacctggtagctaacttcaagaaaatccagagaaataattgcatgaagtcagaaaagtaataaatgaccaaaatgagaaattttgaaattatttaaaaaaatcaaatagaaattctggagctgaattaggaaaaataactaatgcatgtgggcttaatacctaggtgatgggttgataggtgcagcaaaccatcatggcacacatttacctatgtaacaaacctgtatatcctgcacatgtagtccaggacttaaagtaaaaattaaaattaaattctggagccgaaataaaaattaatggactgaaaaatgcaatagagagtatcaacagcagaattaatcaagcagaagaaagaatctgtaaacttgaagacattatttaaaattacagttggaggagaaaaagaatgaaaaggaatgaagaaagctcatgggatttatgagacagcatcaaaagaacaaacatttgaataataggagttaaggcagaggaagagagataaagtggtagaaagctgttttaaagaaatattagcagaaaactttccaaatctggggaaagatataatatccaggtacaggaaggtcaaagtctctaattagattcaatccaaacaagactacactaagccttattataattaaactgtcaaaaaacaaagacaaagagaagaccctgacagcagcaagagaaaagaagcaaataacatataagacaatttcaataagcctagtagtacatttctcagcagaaactttataggccaggagagagtaggatgatatgttcaaaatgttgatggaaaaaaaaaattgctaacaatgaatagtgtagccggcaaaaccgttctttagaagtgaaggagagaatgatactttcccagataaagctgagaaagtttatcaccaccacacctgtttttacaagaaaggctagtggagtcttcaagtggaaagaaatggaaggttaataataacatggaaacgtacgaaagtataaaacttacatagtcaaatttggaatctccaatactgtaatggttgtatgtaaatcatttacatctttagtttgaaggttaaaagatgaaactattaaaatggatataacaacttataaagtatatacaaaacaaaaagacataaattgtgccatcaaaaactaaaatatgggggtgatggtggagtaaagtgtagaatttttgtatgtgatcaaaattgagttgttatcagcttaaaataactggctgtttataaaatgtttttgtaagcttcatggtaaccataaaacaaaaacctatggtatatacacaaaaaataaaaggtaagggaccaaaggatatcactagagaaaattacctaatcacactggaagacagccagaggaaggaaagaacaaagcatctacaaagcaaccaggaaacagttaacgaaatggcagaagcaagaccttatcattaattaccttgaatgtaaatggattaaattctccagttaaaagacagggtgtctgaatgggttttataaaaagcacaagacccaactatatgccatccacaaaagattcacttcctttttaagaacacatatagagtgaaaattaacgggtagaaaaatattttccatgcaaatggaaaccaaaagagagtaggagtggctatacttatgtcagaccaagtagattttaagtcaaaaattgtcaaaagagacaaagagggtcattatgtaataataagggggtcaattcattaagaaggtataatagccataaatatatatgcaccaatcactggagcacctaaatatataaatcaaatattaatagatctgaagggggagacagactagaatatagtaatagtagagaactttaataccccactttcagtaatggacaggttacccagataaaaaaagtaataaagaaacagtggatttagactacactttagaccaaatggacctaacagacatttacagaacattccatccaatggtatcaagaatacatattttgattagcttagtaatgtataaggatattgagtcagtaatacaaattctcccattaatgaaaagcccagaacctgatggcttcattgctgaattctgccaaacattcaaagaacaaataccaatctttctcaaactcttctacaaaattgaagaagaggaaatacttccaagcttattttgtaaggccagaatttactttgatatcaaagctagataaggatacaagaatagaaaattacagaccaatattctattcttgatcaacataggtgcaaaaattgtcaacaaaatactagcaaactgaatttaacagcacagtaaaagaatcattcactgtgatcaaaggatgcaaggatggtttaacatacacaaatcaataaatatgacataccacattaacagaatgaaggacaaaaactatatgatcatctcaatagttgcagaaaaagctttcgacaaatgtcaacatcccttcattataaaatctctcaacaaattaggtatagaaggaatatacttcaacacaaaaaaggttatatgggacagactcgtagctaacttcatactcaacagtggaaaactgaaagctttttcttttaagatcaggaacaagagaaggatgcccactctcaccactcttactcaacataatactggaggttctagccagaataattaggcaagataaagaaataaaaggtatctagattagaaagaaagaagttaaattatccctgtttgcaggtgacatgatcttaaatataggaaaccctaaagactctaccaaaaaactattagaactaataaatttagtaaagttgcagtatacaaaattaacataaaaatcagtagtgtttctgtacacaaacagcaaactatttgaaaaagagatcaaggaaacaatcccattttcaatagctaccaaaagaaaaatacttaggaatacttaaccaaggatgtgaaaaacctgtataatgaaaactgttaaaacattgatgaaagaaactgaagaagacacaaataaatgggaggaaacctcatgttcatggattgaaagaattaatactgttaaaatgtccatactacccaaagtgatttatagattcagtgcaatcactatcaaaattctagtgacatattttatagaaatagaaaaaacaattctgaaatttatatggaaccacaaaagaccctgaattgccaaagcagtcttgagcaaagaagaacagaactggaggcatcatactaccttctctgacttcaaaatgtgctacaaagctatactagtcagaacagcatggtgttggcataaaaacagacacatagaccaatggaacagaatagatagtccagaaatgaattcacacatttatggtcagttgattttcaacaaaggtgccaataagacacactggagaaaggacagtcttttcaataaatggtgttggaacaactggatatgcagaagaatttagaccctcatctcacaccatgtataaaaataaactcaaaatggattaaagacttaaacataagaccaaaattatgaaactactagaagaaaacctaggggaaatgctctatgacattggtctgggcaatggattttttggatatgaccccaaaagcacaagcaacaaatacaatagacaaatgggataaacaaaagcttctgcacaggaaacaacagagtaaagaagtaacctatggaatgggagaaattatttgcaaaccatatatatgataaggaattaatgtccaaaatacaccaggaactgtaaaaactcaatagcaagaaaacaacccaattaaaaaatgggcggccagcgcagtggttcatgcgtgtaatcccagcactttgggaggccgaggtgggtggcttgtctgaggtcaagagttcaagagcagcctggccaacatggtgaaaccctgtctctactaataatacaaaaattagtggtggcactcgcctgtattcccagctacttgggaggctgaggcaggagaatcacttgaaaccaggaggcggaagttgcagtgagccaagattgagattgtgccactgcactccagccttggtaacaagagcaaaactccgtctcaaaataaataaataaatgggcaaaggatgggaacagacatttctcaaaagacatacaaatggccaacaggtatatgaaaaaatgatcaacatcgcaaatcaccagggaaatggaaattaaaattataatgagatataacctcatacctattagaattctaggtgcttattaaaaatatgaaaggtaacaagtactggcatggatgtggagaaagtggaacctttgcatacttggtgagaatgtgaatcagtatagtcattatggaaaacagtatggaggttcctcaaaaaatttaaaatagaactctgtgtcttagcaatcccactactgggtatatatccagaagaagtggagtcagtatatcaaagagatagctacactttcatgttcactgcagcattatttacaatagccaagatacagaatcaacctgagtgtccatcaacagatgaatggataaagaaaatatagcatatatacataatgaaatactattcagtttttaaaaagaaataccgtcatttgtgacaacatggatgaacctaggtgatattatgcaaagtgaagtgaaacaaggcacaaaaggacagataccatataatctcacttatatgtagaatctaaaaaagttgaactcatggaagcagagagtagaatggtagataccagaggctggaggagatgtgattggggagatgttggtcacagaatgcaaaggttagttagacaggagaaataagttcaagagatctattgtgcaacatgatgactatagataattaacaacctacagttggccctttgtatctatggattcaaccaaccacaaatagaaaatatttgaaaaaaaaaaccacaataaaaaataacaattcagcaataaaaaagaatacaagtgaaaatatagtaggacaaccatttacatagcacttaccttgtattaggtattataagtaatctagagattatttaaaatatatgggaggatgtatgcaggttatatggaaatattattatcattttatatcagggacttgagcatccatggattttggtatcttgggtggtagtgggggcctgtagtccccctgcagatactgacaaatgactgtagactgtattgcattcttgaaaatcacctgagtaaatctgacatgttttcttcacaaaaagtgataagtgtatgagataatgcatattttaatcatctctatttagccatcctgcaatgaccatcctgctatggtcccaatgtctcccagaattcaacttaatccccattgtggtggtattaaggggtggtaatagggggtggtattaaggggtgaagtaattaagtcataggggctttaccctcatgaatagattagtgcctgactaaagggctggagggaactcgcttaggctcttgttgccctttggcattctgctgcgggaggacacagtgttaacctcttctgccacgtgaagatgcagcaagactgccctcaccagacaccaaatgcttgatcttgcacctttatcttggacttccagcctccagaactgtgagaagtaaatttctattgtttataaattacccaatctgtgatattttgttatagcagcaaaaatggactgccagttttcgtatttcaaaacatcatgttatacacgataaacgtgtacaatttttatttgtcagttaaaataataagttaaataagttaatttaaaaaagagatagccagtgtttataataaatgaatcatcttaacatttgagtttttgctgtaggggaggaaaaatctcttttcctcattcattctaggttcatgactgaggcccttataccaaaggacagataaacaagagcaagcatagaaatttatttaatataaattttacatgacacaggaacttttataagggagtgaagacccaaagagatggttaaacttgtgtatttttatgctaggtttgatggcatgtggatggttgtggggaaatgggattggaaaaagaatatgagctctaatgataatgaactagggtaaactttgctagggctaggtgttcctgttctctctgtgatctgcatcttccgaaataaggatgctcctttcctctggggatagggaaggcattgcacatgagagtcaccttacctgtttcaggggaaggtcagaaaatcctttctagggtttacaacctgctttaagggagaatcgggagaattgtgggagctgaggggaggtcagagtgacctgcctgcttatgctgtcttctcagattccaagtgccatatcttgggccagtgtgtcttgaatcccatcattactgttggaaattccgtttcagaagcccactctttgctaaactccagttacttctagaactggacactgctgctgaaatctggaatttcttatgtgatgccaaaaaaaggagaaaatttagaagattacgagtatgtgtgtgtttaacaaagtatatatacttttttcttcagagagtaaaacctctgaatcaacttgaagtagtcttttcaaattgttatcaaggcatgctgctatttcaactattagagagatagcaccggacttaaaagaccttctctaaatgactcttcaggaactaggaagagcatttttcactctgctgtttaaagtattttgtttgtctttctatgagtatactgtttcaaagtgtttcactagattataacctgatttttttcagtgtcttctgtttgtatgcttttaagtttctaaatcttttctcttcattgtttttccccaaattgttggactctgagtaagcttctgccagtgtcattttaaaatatatttatatccttcagatgctaaaaatagtttgtgcacttttaaatggttgaaaaagaaaagaagattacatgatgtttgaaaatcacatgaaatgcaaatttcagtgtctataaataaagttttattggaacacagccatgcttatttgttaacacgttgtctctggctgctttcacaatacaccagcagggcagagtcaggtagctgcaacagagaccttatggtccacaaaacctaaaatgtttactatctggccctttacagaaaaagcctaccacccctggtatagagtgagaaaggccagaaaccagaaaaaaaacctgtggcttttcccaaaaaagctttggtttttttcttatgaccggaatcagctttatttgcctttctttacttggtgcctaactgagtgctggattaaagcaaatgcttagttctaaaattgttttgagagtcaaaactggggaggcctttcttcagggtaaacttttcctatgaatatatatcattatctttgccattttttgagttagattttgccagaagagatttgtcataccagggccattgaagcttttctttcatttctaaaattgtacataagagaaaaagaattagataaaccaaacagataaaacccttttgtgctctgcacattcacacgaggatttagtttcagcttatcctgtgtatttactcatggtttagtctcaagatttttaagtattggcatgatgagataatgttagcatttgaatactaaccacagaaagcattaagcaaggtctgcagtcatgaagcatttgccttttgttcccatccattaggtatttaatgtattttttacatccccccaccttgtctttgttttcacctcctttgaaggaaatcttttgtcattgagactcaaacgttctgatgagtaatgctacgccagggtatgaatttcttcccattccctgagatagccattgtactattaatatttctgtctgttgtttagaagtgtagcctgtattaggttctcaatcccctaaggaatataacattttaagtgctcgtagagtgctgtgggctctaaaaggtatcaaaagcattccatcagaaatagaagctagagagcccttgtccttcaaggagtttgaagtctgtatggtaagagaggggtaacatgcatacgaattctgaacatgtactagcagcctacaaagtgaatggaatttcagcagagcatgcagcatgaaggagcgatctcagcggggaagggaataaagtagggagtgcttcgaaggtgaatctgggttttatggaaggtagagtcattggttccaggggaagaagccagtccagatggaggagacgccaagtacttccctgacatctcaggatgccttgctagaacattaaacccagcatgttgcagatggaatgagtttttctcactaaatctaggtcctgctcctgccctcagtatttccgtcaatgtcatggttttctgagttatgcacctgccacttactttaggcttttattgcttctccaaactactttgtaactggtttgcctgtacagagaagctgccagatttgtcttccaaagctttcttcctatcactgtgacccctgcacaccattccagcatccattgtgccattctctggagagctgctcttctgcatactagccaaatttgtcttccttcagtaattttttttttcttttgagatggagtctggctctgtcacccaggctggagtgcagtggcttgatctctgctcagtacaagctctgcctcctgggttcacgccattctcctgcctcagcctcccgagtagctggaacgacaggcgcccaccaccatgcccggctaattttttgtatttttagtagagacggggtttcaccttgttagccaggctggtctcgatctcctgacctcgtgatctgcccgccttggtctcccaaagtgcttggattacaggtgtgagccaccgcatccggtccagtttgttttttaatgtgctgtgctgttgggttttgtttgtttgatttttgttttgcctgagtgtctttgcctatagtgtgaatgtttttacttctctctttgccacgttaactccagttcctcctttgggctttagcttaggtgttttttcaggaagccttcccataccttctatgttggattaagtcctctctcatgcgcttctgagcatcttgcacctcctatttggtgtgcttctctataataggttgtaacttccagagggcagggacctagtgctattggacaaatggcaagtgctcaaataaaagatgttgtttttttcttaaaatatatttaaattttcctcattgtctacaaaattaatttcagacatttttaaattcatttcagaccttctgtaatatggcccgaccttatctatattaattattgaattagatttggcaacatttaacagaaaacccaaatgacagtgattttaacaagatggaaggtttatttttcccttctcctcctcttcctcctgtttctcctccatatccttctctctctctctctgtgacacacacacacacacacacacacacacacacacacaatctgtaagtagtctccagggctgtgggctggtgtgactgctccacagttaccagaggccaaggcttcttctctctttatgctttgccatccttggcacgtgatttccactctcaagattccctcatggtcctaactggctgctggagccccaggccatcttgtcccttgtgggaatagtgctagcagagtagaagggagactcagagagaggaagacaaaaaggaagctaacatgaaaaagacattttcgtcaaatgctagttctttgaacttctgggaagaaaagagtttctaggagaccacaactttttactgctttgaagattccaaattcctgagaatatgattcagttagtgagtaacattctctatgctggcaaaggaggaaattacctggatctggacctatctttggaggatgagagaggagctgttatctctcccccactgatacaatgatgttgtaatgtcttttcagtaggcatttgcctgagctcttttttttggactataatttccccccaccccactttctctaatctctgcttctcaaaatcttatctattcttcagagcctaattcctttcttttcccagaagcttttccacattctcctcatctgggatttttttttttctttgaacctccacagatttttgtgatgatctttctccatgttttaacatagataccggtaaacttatctaacgcttccctagctccctctcaccatcgaatgccatccccttgagttaagtcagggactatgccttgttcacatctgctgcagccatcacagaacctttaaaaaagtaggttcttaaatcttaaatgagtgcatgctgtgagggaaggaaagcaaatagactttttggctcaaataaagaattgatgtgtttagaagacaggtaaagagaaaagggacgagttgttggatgatcttgatatctaggctttgaatctgggcttggcagggtaggtgcatgagccctgaatataagggagctggcctagggagagaaaaaaaaccatcacttcaactcctgtcttccagggtgttgacatcattaactgccccacatccaccagatttccccagatcttagttgacatagagacattcattctgtttctcaccttaagaaaatccatcctgagttagcttcagttggtgctgctgctaggctttatggtgataggctttgggaggaactgagaatcccaaatgctaggtggtatctgaatgtggcattacgagatataatgctctaaactctgcaatttctcttgtaagacggaaacaattcaacctgttctttgactccttttctgggttttcttggctccaggcttcttagaacactgatcacactgttccaccacccccaatctttacctccattctctctaccctcccagcccccaccaaaacacaattcttttcaggcaagtgcaccatacaggtgctctggtggtcccgtaactgaggatgtagttgccagccttttagcaatatcaagagttctctggaggctcttgagagctgtggccttggttaaattggacagaatcacctttttggtaaattcccttccgattcatttcacaaatggcttaaatcatttatgttgttttgttcaatccagtcaggaaatgaaagcattgccattttaattgttttagaacagcattttacacctaatatagactcccaaagccagccaaatgcagattttggctcctagatcgctgactgcatgctgactgtgttcttgagtgtggaagaaaacagatccagccaaagactgattaccttccaaaggtcacaaaagaagtttctctttatctaagaaagaaagtaggtgccattaggtgttgattttttttaaaaagtccttttaatttaaacaatatttgaataaaaattatggtatagtcaaccacaaatcagttgatgaagtctcaaattttggcagtctcccttggttctgtgttcttgggcaagtttactttctttttctttttcttttttttttttttttgagacagggtctggttctgttgcccaggcttgagtgcagcagcgtgatcttggctcactgcaacctctgcctcaagcattgctcaagcaaccctcccacttcaacctcccagttagctgggactacaggcgcatgccaccacacctggctaatttttgtatttttttgtagagacgaggttttaccatgttgtccaggctggtgtagaacttctgagctcaagcgatctgcccacctcagcctcccaaagtgctgggattacaggcaggaaccaccatacccagcctctttttttaaaaaataattttttactttgaaataatttaagacaagaagttgcaaaaatagtactgagagatcccaggtacctttcactcagcttcccccaatgataatatcttacatgatcatagcacattgttaaaagcaggaaattgacattggtgcaatactagtaattcaagaacagaccttattggaataggttttacatgcaatctgtttttagtgtgtgtagttctgtgaaattttattacctttgtagattcatacatgcttttgatttttaatgctcacttaccgtcaaattatttggagcctttcttttttttttttttttttttttgtagagatgggggttccaccatgttacccaggctggtcttgaactcctgagctcaagggatctgcctgccttggcctcccaaagtgctggaattacaggtgtgagccaccacacctggcctatttggagcctttgtgtgaataattaataatagcaaaactggaaattatttaatctggaaatctcaatttaatactcttaacaaaaagactactggattagaaagtagaaagtcaggttctaattccagctcttcaactaggcagttaaacttctttggttaagtcatttacatatttggtacatcatgtactcatctctgaaatgagtgagctaaatgaaacaaatcttgatttccactttcccttctctaaacatccttctgtgtactgtattttaaaaggcaccatctgtattttaccacattgttctagccaaaaacttaggcatcatccttgtttccttctttgctgtacctaccctctttccttctgtatattccattagcaagtcttctacaacattccccaaatctgtctacttgagtccatcccttgcctggattactgcagtagcctccacatgtactttcccgtaaaacgttttccacatggcaatcagagccatcttttaaaaatagaaatcagactttgttattcctctgcttaaaacctcctcctaggactttacattgcactgagaatcagagctcctcaccagggcccaaaagggacaccgtgacctggggactcctgctggcttcttcagtcacatctaccattccctgccttctccctgtagcccagcacaggcctcctctgtcactccagtcggccaagtcagtgcccacctcgaggcctttgttccagcctagccgttctctgtgcctggtgtgccctgctcccagttttgctctaataagtggctccctctggtaatttaggtgtcaggcctccttgatgaggcctgcctgatcaaattagccacctcccaagtcactttctgcaacattatcctgttttgtttcttgcacagcatttaacactatctggaattatcctccgcacttgattggacttgttacttgacaagcgaatttcccttctctagactgtaagctctttcagaagtagggcagctttaactgcctggtttatcctgcatccccagaccccaggacagtgcctgtcccatcaataattatgtgttgagcagatgcatttatggaccagatcatcacagaggattttgaaattgaaaaaattacttaattaaatgaaatgtttaaaattaattttttgggattctgaagggaacttttatgattaaatttctgtgtactacaggttgcctattgtgtagtcatgttttagtaaaagttcttttcctgaggcaggaccatttcagatgggaaagataagttttctgtgctctagggacagtctcctgtctgccttgaacacattagacagatgaccttaatgatcggaagagatgcattggaaatacattcctttccctcatcagcagtgcttttgcattagcattgagcagggtttgactttcttggtgatacagaaggtgcaagaagcttagtatcatgtggtttgacatttaatcagacttgctttccttgttaacctaaaggccttcctcttctttggaatttaatgtgtcagtaatggctcctagagctggaacagatggagctgttgatgttctcacttaaacgaaaaaaaacatgatttatatcctcagcttcatttcttaaattcttgttgaactttcatttgattgtcagagccacataaccagaatgtcactaaatttgctttcgcggcattaccatctacttttgctttttaagcagttttggaaatgtgatgtagtataggaacatgagtacatgtttttaaacatgtattattcggagttaatgattcactgctgctgaaggagtagtttctgtgtgaaggcaatggttatttttttcattaaatattctcatcagaagttaatatgtttttcttctcttattctggacttgtcttataaaaaatacatgtactcgtatagctgccaatgagacaagtgttgacattttggtttcttttgttatggttttattgttgttattgctaatgaatgatttttgaagcaaatatgtactttcaagcaaatatgtgcaaatatgaagttggaagatgatattttctcttaaaagcattttaccattttcacattgccatgcccttagctttcagggtgttttcttgagtcattattttcttttgttgattctttaaaatgtaccaatggtgagtgtgaattcatagtatgaaaaatgtgggtgatagactatgattagacatagttcaagataatagtttatatgaaaaattgatgctctaaagcatttgctaccaaaatttgtttttttgtgtgtgtgttacctttactcttctccctgggtccacttaatggttctgtatttttttggagagccaaatatgtcttgaaggtagtcggggagagggaggaggagcaacatgaaatgagtgtgctgttttatcagaagccacttattcacagggcctgaagtgatagctgttgggagaagtgatattcatactgatgggggtaaaactgcctactcattttggggagcttttgttttcataataaaaattgtttgtacaaataaaggatgttctaaaggagaggactatttgcaattgagtgttttctattctggcagcatccgattgaaaatcatttcagaaattcttagtattgcatgcaatcattgtttagtagctagatctttttaactttatgatagaattgtgcatttcatttctgttttaagtcctatccatgtatttaagtagtgtaataaattattttcttgccagcagggtgacttgagtgaaaaaatatgtataatttggccaatagcctaattctgtgacctctacaatccaaatggatgccgtggcttttactttggttacatttcaaatgactttaattggcctgaaattctattagtatgattgattcaggatacccattcaaagtcatctcatttgtctgtgtcatttgtcatggatcaaatctctgggcaaagcagtcattgaaccttggttaaacctcagactgtgtccgtctgtcaattttataaatgattgggaggaaggcactcttgtgagttctggatcagtagtgatataattctgtttctgttttttgcttttttaaatctactgctacataataaaccactccaaaacttggtgccttaaaataaccattttaccttggtcatgattttgtgggttaggaattaagaaagggctcagctgggcagtttgtctctgatccacatggtgtcagctgaggaatctggggataggggatccacttttgagatctcagactcagatgtctggtgccttgactggggtgcgtggctctgggcagggggcttagctggggcccagcatgtggtctctccatgtggcttaggtttctttcagcatgggagctgggtttcccaaaatgtgaggatggaagcttcaaggctgaaggtttctcaggatgtagactcataagtcccagaacaccagttctcctgcttattggtcaagtaagtcactaaattcaacccagacttggggtcaggagggggtcagggaggggagtagcattatccttcacttttcattgggagaagaaacaaaggatttgaggccatcattaatggctagtgatgagatcacatcagaatagcatttatttaatagcaatttattactctcctgaggttcaggtggcttaaagtgcaaatattagtaggtagttccatgtaagggaatcccattccaagtggcacagccttcatttagacaaaactctgatgtaattcattctagtcatttgatggatggagactctaaaagtggcatgaatataatctcaaaatatctagaaagatgtcagtcctctgagtcattgtgcaaactagtttgttgagagagttcaaaggcatcatggatcttaacagctagaaaagattctaagagattacatcatcattatcaccttctggaaagatttattgagcatctgttaggtgccaggccctgggaatacagaagagaatatgactgattcttgccgttgagacatagttgaggacatagaattgatacacaagagatgaatagaaatccatggaatatagactaactggtaaataaaagtacaggtgataagagcacaagaaggagaagtaatcaatagaggcttagctaggggctgggaaaggctgtagggactttccgtcactccgaaaacatgaagtccaaagtggtggccattacctacaagtccctttgagatctggatccctgtatcctctctgatcccctttgctacctctcttttcctcactcactggccttcttccatggaagtataggcatttgaggatctttgccacttgctcattcctctgcctggaatgctctttttccagatattcccatagtttgctttctcacttccatcagatctctggtcaactgtgctctccaccagccttctctgaccactctatctacttcctgttcatcaacacatttatctccatgaagccagggcattgtctgccttattaattattgtatcctgagcacctagagtagtgcctggcatcattggtgcccaacaaaatatggttgaatgtatgaatgagtaaatgaatgcagaatcttgaaacagggtgtgctttttgggctgatagaacaaagtagtgtaaactgggtagcttataaacaatagaaatttaattcccacagttctagaagctgggaagtccaagatcaaggcaccagcagattaggtgtctggtgagggcccatttcctggttcatagacggtaccttgttgtgtcttcacatggtaggagggtcaagatagctctctcgggcttcttttatatgggtaccaatcttgttcatgaaggctctgccaaaggtaagatttagcaaagtggagaatagatgatattgctggatgcctgcaaggcagagtgaaagagaagcagaaagttacataatatattcatagatcatgtgcatcagctctctgacaccaggggtccttattttacaactctgagtcctgcaaaccattttgcgaatatgtaagcattgtaatagggcttgcacaggaagtgatttatttttttctttatttttaacttttattataggtttggcaatacatatgaaggtttgttaggtaggtaaacatgtgtcacagaggtttgttgtacagattatttcatcacccaggtattaagcccagtacccagtagttatcttttctgctcctctccctcttcctaccctctcccctcaagtagacccgagtatctattgtttccttctttgtattcatatgttcttaccattcagctcccactaaaaagtgagaacatgcagtatttggttttctgttcctgagttagtctgctaagggtaattagccttcagctctatccatattcccacaaaagacatgatcttattcttttttatggctgtgtagtattccatggtgcatatgtaccacattttttaaatccagtttgtcattgatgggcgtttaagttgattccatgtctttgctgttgtgaatagtgcttcggtgaacattcatgtgtgtgtgtctttatggttggatgatttatattcgtctggctatatacccagtaatgggattgctgggtcgaatggtagttctgcttttaggtctttgagccatagtactttccacaagtggttcattttaactagaatagctggttcatgactggtggcagttattggagaacttgcctttcttgaaaaatattctgtactataccatttctttgtcttttctcctgctcatatttctgtctggaatatccagctttttgtattgacctgttgaaattccacatgaatgttccaaaatatagtgacttaaaaccacagtttattatttctcacaatttggtgtgttggctgggttcagctgagtggttttctgttccatgtggtggtgtctgctagcatcactaatacagcagatgttttcagtttcagaacttggctggactagaatgcccaagaaagctttactctcatgtttcctgttggctgtgcactagagttccttagttttcctccataatatctcatttcccctggtatctagaccagccaccttacagcatggtggctgggttccaagtgtgagaataaggaagcttttacttcattttccttttccttttttttttttttttttgagacggagtcttgctctgttgcccaggctggagtgcagtggcacaatcttggctcactgcaacctctgcctcctgggttcaagcgattctccttcctcagcctccctagtagctgagattacaggtgcacaccaccacactggctaaattctgtatttttagtagagatggggtttcaccatgttggccaggctggtctcgaactcttgacctcaggtgatccacccaccttggcctcccaaagggctgggattacaggcgtgaaccaccatgcctggccagcttctatttctcttgaagcctagatctagaactggcacatcagtttcatcacatcctattggtcaaaatgagtcacaaggccagcccaaattcaaagggaggggaagtaaatgccccttcttgatgggatagttgggatgcgcagacagggataggaagaatgattagtggtgaagtttgctgacagtcctcctcagtatgcttagatatttgttagcattatcttttcagtaaaagataggtattattagtgaagtccaaggcctttgagtattatttgaaccctttggttttgagctatgaattgtttatagagtgaattgcttgaacattttgggctttattgagccacagctgaagatgatcattgattgactgcccccctccaccccaccctcccacccccgcctttttttttttttttttttgctttacttgccattcatattgtgttgtacatgttcctctgggtatattagaggttgaaatcaaaagccaaaggaatctgaagggggtcctcagctcttctctgggtcttactgtaacctagagcaagtgactccatcagcaggacaagtaaactcaggaaaagaagcaaaaaggaaacaagccagttgctctgggctgagataatgttaaatggcagagggaagcttgagttactcaactgctgcttggcttccatcttcactgtccttgtttctctgattcaattcttgcttcctacagttgatttcccacataggcaagcagagggatcttttaaaaatgtaagtcagatcatgttattctccagcttaaaaacccgaggggggatttcattgtacttgtaataaaatccagactcctcatcataaattagctcccactcttgcctctttacctcttctcttactcttctcccctccctctttatcagccacattttatttctttctgttccttgagcccttgaggttcattctgccaaattcatcccattttaggggttttgtacttgctgttccctctctctggaacactctgaccctagatctttgtgtggctggttcttcattcaagcctcagcccagaggacctcataaaaaccttttgtaccctcctagactcttttttttttttttctggagacagagtctcactctgtcccccaggttggagtgcagtggcacaatctcagctcactgcaacctccacctccccagttcaagtgattcttgtgcctcagcctcctgagtagttgggattacaggcgtgagccaccactcctggctaatttttgtatttttagtagaattggggtttcaccatgttggccaagctgctcttgaactcctgacctcaggtgatctgcccacctcggtctcccaaagtgctgggattacaggcatgagccaccacacctggtctcctagactcttaacagtgcactagacactcgccctctcacagttcctatgttctgtttttttctagcactgactgttctttttctctattttctcatgtataaaggtggggttaatgaaagaggtacatacttcgtagagttgttaagaggattaaactagttactatttagaagagtatctggagcatgatattgctctcaaatatagctttattgttatatcattctttactacctgaaattgtcctgcttagttatatgctagtttattgtctttcacttattgctagtgtcagccttttgcaagcaaggacagcatttacatatcttttttacagctcatccgtattcctagtgtgttgtcatacacagtaggtccttgacaagtactcgtaaagtcaataaatgaaaggcaggaatatttattttgaacaggccagaaaaaacattagtaacattaaattaaagcttgcgaaagttgaatggattgtaaaagattgtttagttgttcaaaatgggttttggatttttgatccagaagcattctgttccaggacactgaaagaacccagggataattcattgttaatttttatttttatggaattttgaagagtgagaaattgttggaattatgaagacaggtaaatgacattctgattttcgagagtgaggaatgtgggcttaaaaactgtagactaggagctttatgctacttgtgggcagaattctagaatgggttattaaaaggatgatttgtgaatgcttaggacagtgttgtttagtgggaaagtggagcacccttagagaaaagaggcctggagaaatgaattgattttttttttcaggtgactactgagcttggtggcagaattgagaataaagactccctgacttcagaccagtgttctctctgttccagtagtgttttcaatctgggaccatagagctgctcaaattcaagcaaaatagaatcttttttgtgtgtgtctttattttgaagatcgtttttttttaaagccattttcaaaaacagtttttcagttggggtacattgacctctgaaagttctaggacacagtctcaggagcccatgagatttagttctccttcccaccacttcaaaagaggtctgtgcggtactctaggttcagaaacttggcaccatgatattttgccagtttatcttattaactgaatgctgtctgtagtgactctgcagaaaacagtgttatgttcttctgtcagacttgtgctgttcaatatggttgcacgtagctatgtgtggccattgagcgtgaaaatgtgactcctgtaagttgattatagactaccatgtaatatagtcacccctcagtgtccgaggggtattggttccaggaccccctgcacataccaaaatccacagatgctcaagttcctcatataaaaatggcatcgtatttttatgtgatctacatacagcctcctgtatactttaaatcatctctggataatttataatacctaatacaatataaatgctttgtaaatagttgttatattgtttgtttgttttcttaacgttttttttaatggttgtattgttattgtttatttaaaaaatattttcaattcaaggttggctgaatctgcatatacagaacctggggatacagagggctgactatatcatacacattagatttcaaagacttagtatgaaaaaataatgtaaatatctcatgatttattttgaatatctgttgaaatgatatttttgatatattgggttacataaaatatattaaaattaatttcatctggcttttcctttttaaaacgtggctactagacaatttaaaattatatatgtgactggcattcattagaacttgacacctctctcaggaggaaaggtggaaggaactggtggatatcactgtgcagatgaggtgatatgacagctgccttcagctctttggatggctctcattcgtaaaagagattctttctgttctgtgtttctcaaaaggtcgaacgaagacatagaaaaagcaagttaatgtaagatagacccttctaaaatagttgtccaaagaaaatataggctccttctagagataatgaattccttgtcactatacataattcaagaagaggctaaatagctgcttaatgaggttgtttagagggagatcaggtggttaaaagtaatgcctttccaatcctgagaatttgtgacttgatgaaattgggcaaagggctgattttacagctacatgaaataaatggattccgtgggcaggagaagaaagcattttatttcactccctgtgcttttcctttaaactttcacatgagtattttccagttgaggagcttttgcattcttggttacagaaagatgtttgattgtctaatcccagggaatctggtgaacagtgtatcagttaggaatgtgcttggcaacaagtaaacaaacaaacaaaccaaagtgacaatggcaaataagtagagatttattttaatcctgtaacaagaactctggaggtcagctgcttctggcattgattcattggctcaaaggcatcagagcgagtgtctctgctattctcttggccttccttttcctcgtagtagcaaggcagtcacagctaccaacagcacatccgtaaggctggaagaggcacggaagttgctcagcccctactgcgtctgtcactttttcttgggaaaagaagtagtctttccagaaatcctcaacacaattcctcttctgattcattgggcagaattgtctcatggccactccttggtacaagggaggctgcaaagtgaatgtttgctcttctagactctacgattgagacaagacaggaggagaaggaggttgggaatggcatttgtgtcagccaaaaagaacagggtctgccgcagatagttttaggtgtgactgagggcaccactcccaagtcaaacatcaagtgcttgggagttgagacatcatccaatgtcctttttttattaaaaaaaaaattctttcactaagtggttttagctgccattgatgattgtagccttggatgagttttattaaacaattctttctttttagagaagaaaaaattgaggacccgagaagttaacgcctttgatttctattgaaattactcatagggtaagagtgagagttcttgctttgccctttccaccttcctgacttcatcagcaaagaagagaatcttggttttatttttcattatctgcaaatgatatgtccataacagtagttatttgtcacaaaaatacttcacaagaacattggtaaacacatacaaatgttagcagttctgaacaggcatttattgtagaggaacctgtttatgatgagaaatatgaaagaattgagacagtgggcctctaccatagaggagggaagaaactagttgggtgaaatttagtgttaggatgttttgtcaaaaaactatttttgggaggctgaggcaggaggatggtttgagcccaggagttccagaccagcctggacaacatggcaagattccatatctacaaaaataaataaatagaaatttaaaaaaatttttttcatctttagcattaatggcaaatatttagagctatatttaatggaagtatatgtgaattggtggtataaacagatttttccaaactctttttacttgtaatttctgtggctgtaacaacttttactagcctcttaggagtttcttaaatcctttttccccattttctttggtctatgataaagaagtaatctgaagtagaaaaaaattatttaggctgggcacagtggctcatgcctgtaatcccagcactttgagaggctgaggcggggggatcgcttgaggtcaggagttcgagattagcttggccaacatggtgaaatacaaaaatacaaaaattagccaggcgtagtggcagatgcctgtaatccaagctactcgggaggctgaggcatgagaatcgcttgaatccaggaggcggaggttgcagtgagctgagattgtgccactgcactctagcctgtgtgacagagcaagactccacctcaaaaaaaaaaaaaaggaaaaaaattacttagatgagctaatttttgaagatggtcttataaagtttattttttattaatacactttattttttagagcagttttagattcccagcaatattgggtggaaagtatgaagaattgctatatactcccttcccctgcagatgcacagctcctcccactgtctacagttcccaggagaggtgtgacatttgttatcattgatgaacttatattgacacatcgttattacccaaagtccatagtttaccttagggttcattcttgatattgtacatcctatgggttgggacaaatatataacgacatgtatccacatttatggaatcatacagagtattttcactgccctaaaaattctctgtgctcttgattgttcatccctccttccacacaacccctagaaaccactgattgttttactatcgccatagttttgcgtttctagactactatatcgttggaatcatgtagtgtgtggcctttgcagattggcttcttttacttggcaatatgcattgaagttccccccatgttttttcatgacttaatagctcgtttccttttagtgctgaataatatcccattgtctggatatcaccgtttatttatccattcacctactgaaggatatcttgaatgctccaagttttggcaattatgaataaagctgcttataaacatctatgtgcaggttcctgtgtggacatgcattttcagttcatttaggtaaatatcaagaagcatgactgctggatcatattttaagaatatgtttagttttgtgaagaattaccaaactgtcttccaaagtggctataccattttgtgttcctaccagcaataaatgagagttcctgttgcatcacactataccagcatttggtgttgtcagagttttggattgtgaccgtctaatgggtgtatagtggtatctcattgtgttttaatttgtgtttccttaatgatatatgatgttgaacatcttttcacatacttacttgccatctgtatatcttctttggtgagatatctgtacaggtctttggccattttttaaatcaagttgttcattttcttgttgaattttaagagttctttgtctatttttggtaacagccctttatcatatgtgtcctctgcaaatattttttctagtctaactcatcttctcattctcttgacagtgcctttcacagagcacactttttaattttaatgaaatctagcttatcaattatttctttcatggatttctgcctttggtgttatacctaaaaagtcatcaccatacccataataacctagattttctcctatgttatcttccaggaattttaaagttttgtgttttacatttaggtctgtgatctatttttaatttttttagagtttcgctctgttgcctaggctggagtgcagtggcatgatcttggcttactacaacctccgcctcctggggtttaagcaattctcctgcctcagcctctcaagtagctgggactacaggcatgcaccaccacatctgggtaatttttgtatttttagtagagatgggatttcaccatgttggccaggcaggtctcaaactcctgacctcaagtgatccacccaccttgggctccccaagtgttaggattacaggtatgagccgccgcacccttcctgtgatctattttgagttaacttttatgaagggtctaacatctgtgcctggattctttttgtttttttgcacgtggatgttcagttgttccagcaccatttgttgaacggactgtctttgccccattgtattgcttttgctccattgtcaaagatcacttaactttgtttatgtgagtttagttttgggttctctgttctattccattcatctatttgtctgttcttctaccgatatcacactctcttgatgactgtagctgtacattaagccgtaaagtcaggtagtggcagtccttaaactttgtcctttaacattgagttggctgttctgggtcttttgcctctatatataaactttagaatcagtttgccagtatccacaaaatagtgtgctgggatttttgttgggattgcattgaatctatgaagttgagaatagctgacattttgacagtgttgagtccatgaacatgggatatctgtttattcaattcttctttggtttctttcaccagttttgtggttttcctcatatagatcttgtacgtattttattagatttatacctaagcattttgatctttgggggggtgctaatgtaaatggtaatgtgtttttaatttttaatttcacttggtcattgctggtatatggggaggtaattgacttttgtatattaaacttttattctgaatcttcttataattgcttattagttccaggaatttcttgtttattcttttggaattttctacatagacaatcatgtcatctgtgaagaagacagttttgtgtcttccttcttaatctacataccttttgtttctttttcttgtcttattgcaccagttatgacttccaatttgatcttgaaaagcagtggtaataacggacatccttgcctggttcctggtcttagtgggaaagtctcaattttctctctttttttttttttgagacacggtctggctctgtcacccaggctggagtgcagtggtgtgaacatggctcactgcagccttgatctcatgggctgaagtaatcctgccacttcagtcttccaagtagcttgaaatacagatgtgcaccaccatgcctgactaatttttgtattttttgtagagatggggttttgtcatgttgcccaggctggtcttgaactcctaggctctagcaatcttcttgcctcagcctcccaaagtgctgggattacaggtgtgggtcactgtgcctggctgactttctcactgttaagtatgatgttagctgcagggtttttaaaaatatgttttttatcaagttgaggagattcccttctattcctagtttgatgaaagtttttattatgaataggtggtgagttttgtcaaatgatatgatcatgtgatttttctaattaagtctgttgatgtgatggattagattacatttattgattttgtatgttgaaccagccttgcataattgggataaatcccacttggtcatggtgtataattctttttatacatttttagatttgatttgctaatacttttttgaggatttttgcgtttatgttcaagagagacattggtccatagttttcttttcttgtaatgtctttggtgttggtattagggtgatgctgacttcatagaatgagttaggaagtatttccactgcttctagtttctgaaagatattgcagagaattgttacaatttcttccttaaatgtttgatagaatttatcagtgaactcacctgggcttggtactttctattttaaaggttattaaatattgattcaaatgtttaatagatgcaggccaacttagattgtttatttttgtgtgtgagtattggcagattgtgtttttcaatgaattgttccttttcaggtatgttatcaaatttgtgggcataaagttgtttataaaacttctttatccttttaatgttcatgggatctgtaatgatgttctctttttcatttctgatattagtaatttgtattctgtctccttttttcttagcctgtctagatgcttactgatttcatctatcttttcaaagagcaaacattgctttattgattttttccattgatttcttgtgttctctttcgttaatttctgctctaatttttatacttttttttgcttttgcttactttggatttaatttgcttttctttttctagtttctaaaggggaaaacttgggttgttgatcttaggtctttcttctttcctaatttttgcatccaaatcctatgcatttccctttgctttagctagaaactacaaattttgataagttgtttccatttttatttagttcaaaatatttttttaaattatcttgagaattctcttacccctatgttacttagaagtgtattgttttatctccaagtactttggaattttccagctatgtttttgttattaattttttatttaagtccattgtgatctgacagcagattttatatggtttctatatttttaaatttattagagtgtgttttatggcctaaaatgtggtctatcatggtgaatagtccacatgagcttgagaaaaatgtgtaatctgctgttgtttgatggaatagtctatagatgtcatttacatacaattgattgatgttgagtttatgtccttcctgattttttgcctgctagatatgcctatttctgagggatgctaagcctccaaatgtaatagtggattcacctcttttttcttacagttctatcagttttacctcatgtattttaatgctctgttgttaggcacatacacactaatgattgttacgtattcttggaatattgacccctttatcattttgtaacgcctctctctatctctgataacctttcttgctctgtagtttgctatgtctgaaattactgtagctactcccacttgcttttgattattgttagtgtggtatagctttctccaaccatttaaatctacatatgtctttatatttaaagtggactttttgtagaccacatatgattgggttttgttttttgatctaccttgacaattcctgtttttcaattagtgtgtttagaccattggcatttgaggtgattgttagttgggtatatagttggatacctaccatatttgttattgtgttttatttgttgcccttgttttttgtttctatttttatcttccacacttttttgccttttatggtttattatttagtattaaatcattttacattattccattttctcttttgtaacatataaagtatacttgtttttaaaaattatttgtagaaatgaagtctcaactgtgttgcccaggcaggtctcaaactcatgggctcaaacagtcttcccatcttggcctcccaaagtgctgggattaacagatgtgagccaccatgctcctttttttgtttttttaaacttttttaaagtggtttccctagaagtttgctgtatatatttacaactcatccaagaccaatttcaaataactctgtactaatacatgggcagtgtatttcattataataatgaaatattcctaatttctccctcctgtcttatgctgtcattcatttcacttatacgttagtgtatataactatatgtgtatgcacatacacaaacacacacacatatatatatacacacacagccctccatatatgtgggctttgcctccatggagtcaaccaactgtggatcagaatatttgaaaaataagggataattgcatctgtactgcacatgtacagatgtttttctcttgtcattattttctaaacaatacagtataacaactatttgcatagtattaggtattataagtaatctagagatgatttaaagtacataagatgatgtatgtagattaaaagcaaataatgcatcattttatataagggacttgagcattcatggattttggtatccactgggggtggggccctgaagccaatctcccatggataataagggactactgtacacataagcatacataaccaaatacattgttgccattattattttgaacaaactttgatctgttagatcaattaaaaaaataaacatttttgttttacctccacttactccttcttgatgctcttgttttctttatgtagatcttatttctgacctaacattattttccttctctcaaaagaacttcttttaacatttcttgtaaggcaggtctactgccaacaaactctgtcaatttttgttagtctgagaaagtcgttatttctccatcagttttgaaggatagtttcacaaggtacaagaattctaagttggtgggttttttcttttcctctccacactaaatagttcactccactttgttcttgattatgtgatttctgagaaggcagatataatttttatctttgtttctctatagccaatttactttttttctctgatttctttcaggaatttttctttatcttttactttttgtagtttgaaacgatagcctaggtatagtttttgttggcatttatgctgcttggtattctctaagcttcctggatctgtggtttggtgtctggcattaatttgggggcaattctcagcctatattgtttcgtatattttttctgtttctttctttttctccatctagtatttccactatacctatgttaaaccttgtatacttgtcccacagttcttggatattctgtttttcagtctttcttctctttgcttatcagttttggaggtttctattgatacattcttaagctcagatattctctccttagctatgtccagtctactaataagcctaccaaagacgttcttcatttctgttacagtgtttttgatccttaacatttttttttcttaagatttctatttctttggttacattgcctatgtgtccttgcatgctgactatctattagagcccttaacaaattaaccatagttgttttaaattccctatctgataattccaacatccttgtcatgtctgtttctgatgcttggtctgtctcttcaaactgtgttgttttgccttttagtatgccttgtaattttttcttgatagctgggcatgaatatggggtaaagggatcactcttaagtaggcctttagtaatgtagtgatagaagtgtgggaggagaggaagtgaaaccatctttgcaaaaattatgaccatgagaaaaattttggcataggaaagttatggcagtgaaagaaatctaacctaactgactccatgttgcttctcacctccaagctgttcctattcattcctgggcataggccaaacaaaatataggaggaatttactttatagtttaattttgaagcaaagatgataacagccccttcctgagacaaaccccctctttgcttagggattagaccatctttgtaaaactgaaacgttagccacaagattagaaattctggctcaggagtcatgtagccagaggccacaagattcctaaacttcccaattgctcctatagataacatcactattgtaaaacctaagattggtgtttgaggtatttttctgaccctgcattctgatgaaccaaccagctggtgccacccagactggtaaactggctcatctggtcttttggcccgcacccaggaactgactcagtacaagaagacaaacttcgactccctatgatttcaacccaaccaatcagcattccctattcccgaccctgctgcctccaaattatccttgaagaaccatagcctctggatttttggaaaggcatatttgagtaataataagctcctgtcctcttgcttagctgcctctgggtttattaaactctttctctattgcaaaaacctgctgttcagtgcatcggctttgctgggcagtgggaatgatgaaactgcctggtgaatacagaagtgttctcttgtcctatgagtaggtctcagtctttgagtaagcctgtgcctctggactgtgaacttcacagtgtttctcaggttttatttcctcttaggtgggacagggtcgctagactcggctggaattatatgtttctgttcatcacatggaaggcttgagtgggctagagctgagaatttctcttccctccaggcccgttaggctgtgggaaaatccactgtcagatgaggctctggttaggtagcttctcctgaggacaggccttgttaggaagaccccagtgctctggcatatttcaaaatggttccttttccttctcctcctgctggaaagggatttttcttggggaagtttctgctccaggccgggtgcagtggctcacacctgtaatcccagcacttactttgggaggccgaggtgggtagattatttgagcccaggaattcgaggccagcctggataacatagagaaacccagtctctcctaaaaatacaaaaactagctgggtgtgtggtgcatgcctgtagtcccagctacttgggaggctgaggcgagaggatcccttgaacctaggaggtcaaggctgcagagagccctgatcgtgccactgcactccagcctgggtgacagagccagaccctgtctcaaaaaaaaaaaaaaaaaatttctgctccagtatgttgtgattctctgtatctgcctgtctgttgcttcaatttcagaggcatcagtttaccttgtgatctcacttttcttacagaactaagaagacttgttgatttttcagtttgttcagcctttttacttgttaggatggagtggcgacttttcagctccttaaatacagagctggaaaccagaagcctcttgacttttcattttttgcctttgaaaaaagtcaggtagttaatacttctctttcagggtgctgtttgaaaattctgttatgcaaaaacataatgtagataatttgtattcccaataaatgataaggcacattggatataattgttactgttttgtattttttagcatagttttagatgttttattttgctacaaaggaattttgagcagaagattgtgacatatatctgtaaagaacagacttattattattattattatcattattattattattttgagatggagtctcgctctgttgcccaggctggagtgcagtggcgcgatctcggctcactgcaagctccgcctcccgggttcacgccattctcctgcctcagcctcgcaagtagctgggacttcaggcacccgccaccacgcttggctaattttttgtatttttagtagaggcggggtttcatcgtgttagccaggatggtctcgatctcctgacctcgtgattcgcctgccttggcctcccaaagtgctgggattacaggcgtgagccaccacgcccggcccagacttattattttttatgttcatccccctgttaattatctttcactcacaatattccctttgcttttcctttttaccagtggtccagtatgggtatcagtggaacaatatatgtcttaagaataaagcaattttaaaccaccatgactagtagcagtgtttagctgagttctgttgcccagttgtcaccaactactgcatatactccctagatatacagttgcatgttctcacactgtcctgttttgaagaaaaaaatgtttttaaaaagtagaaattgaaccaaatgccattactgtctttattgacttgaaaggccctcattccacccaatcctgccctactcctcttaccccaattcctttgtgaactactttgggaaatgctgctggtggtggtgtgtgatgatatttgtaagagcatgaaaataaaaagctgggaatatataagagattcagattttgctgaagcagagaatttgacttgtggagtattgtaatgcaaaatttggtgcactgttaatggaaagcatttgctatattaaacagtaagggtctattgtaggttgagaagctggggagatttattttaccatttagcatgtagagaatttgaataggaaagtaggtgtgtatagagtgcctgtttgtcccattcattgttggggtttatatatacctttctctcttaatcctcaaaactccctgcctgtaatgtaggtattttccccattttgcagataaggaagctcagacacatgaacttttccaaggtctcaaagctagtacatcgtggggctgtattcaaacccagggctgacttcaagacctattattcttctactgaattaacctgaatgcttgcaaagtctgtggctctaattgtttctgtggctaattaatgttcatgaactggtgaagagtaaatagtttagttttttttttttttttttttttttcttgagatggagtttcacttttgtcaccctggctgagtgcaatggtgcaatctcgactttctgcaaccttcgcctcccaggttcaagcgattctcctgtctcagcctgccaagtagctgggattacaggcacccaccaccatgcccagctaatttttgtattttgattagagatggagtttcaccatatgggccaggctggcctcgaactcctgacctcaggtgatccacctgccttggcctcccaaagtgctgggattataggcataagccccagcacctggccaatagtttagttttttaatgactccctcaactttgttaggtctgtttatttgagagcatgtatttatttggggccataaatgtatttttacatttacctattttatttatctcaggtcttgctttttacattagagaaggaagctttactagtactctacttggaggggtacatctctttatcaggaaaggatcttattcagatatatacatacatacattgtatttatttataaatacaataataacactgaagtataaagaaccacaatttattacttttttcctcattttttttttctgctgtggagcttaccagctagaattctggttttggtagcaggaaagaacaagtggcaactttgtgaattgtggcatttgagattagacggatatacaagatggtgtactacagcactctaacagaagggaatagcactgttgtcaaagacattggaaggtctcttgtaactgaaagagccctctttggcatttggccgtctcagtttcacgataacaagacgaagcaggaaccttgaaattgctcctctttgtattccattcctggataattaccatctatactcagatttcgaaaggtccttttattttatgattgcatctttcagcaacaactattattatcctattatgcaatttgccttatttatgatgctcaggtgggaaaacgttcagactccacaattgaaaagatcgccctgattgagcattttgtggtgcttttgcttgttttgctgttgaacaaacaagagttcaagacaggtgaattttttccagatgtgcatttgaataattggacagatccctgtggtctcttcagtaataacacaagtgactgcttattgtcgccttcttcctccatgcctggcttcctgtggtcactctgcaaagggctctgtagttgcaagatgactccacagttaatattgagctcatgaggagtaaatagttcatccaagctgggaatctctgagcttcattaggtctgcttatttgggtaccagaacctgtcactatccaggagacacacagcagatcagctttcacttgctttgttaccattttaggcatgaaatagaacgattttctcccagaacatgatgtccctgtgaagtaataagtgatagcactttatgggctttaaggaatctagagccaggccagttagcaactgaagctgtagtaactcagctggacactgatgtccttttcctgaagttatatgagcagaggcatgtaagggaaatgtggctcggtgacccacagtgctcagtgcccagttcagtgacaggcagccaggagagctgagccatggagaggccagcaagccaaagggatttgctgccatgctgtgacatggaaggcagggtgcactcagcactgtattgatgacgttcttaagtctgaaggacttaatgcagtttctggatgtgcctcctcatcaccacacctgttcaagggggaaactgggacccaccccaagagtcagctctatagaagtttttcctgacaatactctctactcctggaggtagactgtgtttttctcctgtactctcctctaacacagaacttgcgtgttactatatgcaacttgtttatctgccccctggactgtgaacccttgaggacagggatattgtcttatcactctttgaattctcagtgctgggtacatattacgtgttcaatacatgtttgttaaataaatgaaacagtcacgtttggctcctttcttccacaaggcattctacccttccacggaaacaattatagcagcatggaaacaattacagcagctatctataattgataatcagaactaatgaaatatggtagcacaggcatgaatagagttgaaattatcagagtgattataaaatacataggaataaacttaacagaaattgggcaagacctttatgaagaactcttccaaacttaactaaggcacataaaagaacacttgaataaatagagaaacatgttcattggtgaaacgagtcaatgtagtaaatacgtcaatatcactttttgtccatattaacctaaaatttaatacagttccagcataagctgtaatgttatttttattctatgaaatttgataaaatacggtaaagttcagaaaaacattgcctgagactagtgaagaatgaaaaagaggggaaaattttatctcatcaagtattaaaacataaaatatagtaaatataaacaaaatggtagacaaactaagaaattggaagccagtataatctggataccaaaacttgacaaaggcactacaagaaaaagttatagccttaagcatagatgcaaaaatcatcaacaatatattaacaaatggaatccagcaaaacagaaaaaggataatatatcattaccaaatgggatttatcctggaaatacaagggtttagcatttgaaaatcaatgtaatttattgcatttattgaaataaaagagaaaataagagcatagctacaacaggaagtctagaagcaggcttgagtatacatggaaacctagtacaggttcacagtcctttatctgaaatgtttggggccagttatatttcaaaatttagggtttttagcagtatctcataatcaaattcatgtaaatttccacagcagaacagattaatacggacactaaatgggatgataaagaccagaaatagcctcacattagctcaggtcaagttttgccaccaaatgaatttaagcaccaaaccgcaaaaaacaaaagactctgttttcagagctttatgatttcagaatttcaggttaggaattatcaactctttaatgccagggtggcacatcaagtcagtgatgagatttgtaaaaggcattgggattacatactagtcatttagaggaagaaaaggataaagttaaattcctacttaatagcaatattgtttatgtttaaagattttatgttaaaaaactaaagaatctataaaagcacaaaatatatacttaatctttatttataatcttgtggtagcagagatctttgtaagcatgataccaatagcagaaactaaataaattttaaaaagagatcttacagccagccacggtggctcatgcctgtaattgcagcactttgggaggccaaggcgggcagatcacctgaggttggagtttgagaccagcctgaccaacatggagaaaccccatctctactaaaaatacagaattaccctggcgtggtggtgcatgtctgaaatcccagctactcgggaggctgaggcaggagaattgcttgaacctgggaggcagagattgcagtgagccgagattgcgccagtgcacttcagcctgggcaacaagagagagactccgtctcaaaaaaaaaaaaaaaaaatcttagattactaagcaaaaattacaaagaacaccataatattaaaaactaatgtcaatgtggagaaaatgttggctatatatatagtggccaaagggttattgcccatagtttataaagagctcttacaggttaataaataagagatgcattctccacgacaaaatcagaccaaagatatgaaaaggtaatttgcaagagaagaaatacaaatggccgctgaattctttactactactatatcactatcactactactagcaggtaccatttactgtttattgtctgccaagcactgggctagtatcatatcttgcttaagaaaatactatgagacaggtgcaattatttacattgtgcaatgaggacagtccaatttagggagctaaagcagcttgtcctagatcacacatttagcaaaactgttgcagcccagggctgtctgcctctgaaattcttgctcttcagtataacacggacctactgctcctatatatcagtatttgtataaaaagaaaattcagtgaaagcaaccagaagttaccatttgttttgcctattagattggcaacaattgaaaaggaatattcatagccagggaagatcagagtgtgaagcctgcactctcatatattgctgctggtagtgtcaactggcatgatttttctggaaggcactttggcaatatgtattgaaagctacattctttgatacagtctttctacttctaagaatttgtctgaaaggactaatttgataagtgcttatatgtaaacagtgttcatttcagtattgtttataaaagcaaaatgttgaaagaaacttgtccatcagtgaaagatgggttaaatgagttatgagagaattgaagatgtagagctatatttattatttaaacattgaccttcatttacttttttttttttttttttaatggagctttgccctgtcactctggctggagtgcagtggcacaatctcggctcactgcaacctccacctcccgggttcaagctattctcccacctcagcctcccaagtagctggaattacaggcacatgccaccacatctggctaatttttatatttttagtagagacggggtttcaccatgttggccaggctggtctccaactcctgacctctcaactgatctgcctgccttggcctcccaaagtgctgggattataggtgtgagccactgcacccggctgaccctcatttgctattggatggaaaaataaaataaaacaaagcatgttgcaaaacagttttgtggtgcaactttatatttgaaaaactccaagtcatatacacatatgccaagaaaaaagtctggggaggctgtgaaacacagtattgacagtggtataattattagtgttttatttttttcttcatatttttctgcagtatttattggtttatttttgctctatacatagactccagttgaaaaaagtatttaaaaatatatactataattttctcagactgatagaacatctcaacttgaagattaagcacagaatttggggatgttcatccagatctgtatatttactttgcttttgttagggagtatgtaggtacttcctgtacttatattttactttttgaaagttggcacaggcatgtgctcacacatacattatttcccacatgttagtccaagaattgccaggcttctatttcaatgactgtgtttaaagtaatagtttgccagcgacttggtttacatatccaatcagtgtgaaagttatgtatccttctccatagatacaaggaagtcctctttgcccaatcagtagatcaagaaggcgaacaccttcttaattacaaatgaggttttaaaaagttggcttaacaaatatagctatgtttgcttaacaaatatagccatatagcttaacgagtatagctaaggagacctacctgaggattcttctggtttagaaaagaattatttctgatagggagacaatcatgttgggtgtattttaaaatgcttgatataatcttcaaaatttattatgaaacagtgaaatctggccgagtgtggtggctcacgcctgtaatcccagcactttgggaggctgaggcaggcagatcacctgaggtcgggagttcgagaccagattgaccaacatggagaaactccatctctactaaaaatataaaattagccaggcatggtgatgggtgcctgtaatcccagctacttgggaggctgaggcaggagaatcgcttgaacgcaggaggtggaggttgcggtgagccgagatggcaccattgcactccagcctgggcgacaagagtgaaattccgtctcaagaaaaaaaaaaaaaagaaagaaagaaacagtgaaatctagtattttatatgacatgagcaatttgcacagtgactttgaacattatcctgaccatcaaagaacattatttaataagaattgtggactaagtaactttagtgtgcattttcagtgtctctaaagatttgggcgcagagttatgagctccatttggttgaactggtagttttagaaacagatttttaaattacttaccaaatgtaaaaggaaaacacttgtattgaaaacactggttgcagatcgttctaaaggccatttgggacaacagaacaaggcaacatctcagagaaaatggttagtaatgggctcttagagatggtgtcttaatgcagtagttattttgaattatctttaaaatggttttttgaccctgttcttctgttttgacattctcctttgaaggcatacaagttatactgatgatatttgaatagtggaactcttgtgtagcagttaagagggtgcattttagagtcagacagacctgggttaaaatccaggctctaccacttagtcgttttttgagctttggcaagtcactctagtctctctaagctttagtttcttcatttcaaaagtacagacctgacagagttgttgagaggattaaatgacataatttttgtaaagagcataactgcctggcagattaaatgttcagtaagtggttgctcttttttcataagtagtccaatttcttttagaagattttcataataatatgtagtgtaatggaaagaatgcacactgtcttgtctaatagacccagatttgaacactggttctgcccttaacaacctcctaaccttgggcaaatcattctgctctgtgcctcaattttcttccccaagaaatggagtcataatgctgacctttttaggggttgtaaggatttgaagtgatataggctaagtgtcaaactctatgcctggaggaaagtcagtattcaatgaatggttactatcattattgttataaagctaataaatatcaaagaacatgttaaggcttttaatatttttcctcttctcttttttatctttagttgtaattctttaagaaattgggtacacatagctaagactgtgcagtataagaaaagtgttaataagttatataaaaatgtattctaatactacatttggtaaacaaagaataagaatctgtaggtagggattatatgagtggagaaggatgtgtacttagggcttggctttggggtgcgtgtcagagactagtgtatgaggaagaagaagcaggaaaaggcagtgtttcatttctcacaatcgcccctctcaccagccacactgaagaggtgatgtcatgggcctctgatgctgtgcttgcccccatcacccagccgtctggaatagctgctggaggtgcccagtgtgccagcactgaaggaaggcctggctgcttggcaagcattggtgatgctgtgacattgagttcctggggaggctgcctgctcaggtggactgccacatgctgtatgtcttgcttcatatttgcacaatatggtgcttgatgtgattcattcatccattcatccatcctttgtttttttttttttttgaggcagcatctcactctgtcacccaggctagactgcagtggtgatcaaggcccactgcagcctcaatctcctaggctcaatcgatcctacaccacagccttctgagaagctgttactacaggcatgcgctaccacaccctgctaaatttttatattttttgaggagacagggttttgccatgttgcccaggctggtctcaaactcctgggctcaggccatctgtctacctcagcctcccaaggtgctcggattacaggcgtgagccacctgcctggcctgtccatccttttttcccttcctccctccttcccttcctttctttttttcccttcttgtcttcctccctcactttcttttatccagccatccgtctgttcatcagtccatccatctgtccatccatcccatccatccgtccatccatccatccatccgtccatccatcttctaggtcctaggtatagtagtaaaatagtcaaagtcccttccctcaaggagcttacattttagagattcaaagcattttcaaatgtattatttcatttgctttttaaaacaagtatgtgaattttgaattttttagtattttcatttgctagatgaggaaacaaaaatattttgagattaaatgacttacttgggataataatgctatgaataaaacccattattttttatttagaactcttttatctataccacttttgtattctaaacaagtttttcattaatgaaacatgttttcacactgtgtttttctcaatacttcaatcataggtagccaagggaattttaaagaacattaagtgcactcaactgagctgctttaacctttcaatatgttcccgctgctcttagaatgagatttgaaatccagaacaccactgcatcatcaggccagtgcttccttcccagctctgtctccggaccccgtccctcgtattgcctgtcttctgcaaatgctagccttctttcctgacctcagaggtattgtgttctttccagcttcagccctttgtatgcactgttccctcagcttggaatcctcttctctgtttccctccttgtccgtcttccccctatcttcaccaagctaatcccactcaactcacagatctcagctttcatgccacttcctaggggaggccttcctcatccccctgccaaggttaggtccctgtaccatatgtgctttctcatagcaccctgtgattttccttaatgactcacctatcacaatccaggattttgttgactgtctgcctccccttcctgtaaaggttagagggtaagctccatgggggcagaacactagttatgtcattttcaccgctgtttccctggctagcactgggcctcctgtaggccctccaaaatatgcaaataaatgaatgaacaaacaccctggcagcatggaaacccagagcggcacaagcgagttcaaatgcttatggtttgttccatctcacttccctctaggatgtgattttagcagtgtaggcagcttacgaaatggggcaggtttcttgtgttttactaatgtgtaaataaagatagagtaactcttaagatatggaaagtttgtaaagtggcagcaaaaagtgacaaggtgtggggatccaaatacagagcctagggaaaatagaataaaccaagttgtttttatgtctcttttccattagactgtgagcaagctgaagtcgagtcccagaacttatttatgtttatatcctcaaagagactatagtgcctggttcatcgtagctgtggaataaatgttgaatgaatgaatgatacacctcttacctttgaagctgacttcttgtgttcttcatgctgacattagaaataggaaaagtcagtcgagtacagtagttcaagcctgtaatcccagcactttgggagaccaaggcgagaagatcgcttgaagccaagagtttgagcccagcctgggtgacaaagtgagaccccatctctacaaaaagaaagaaaagaaagaaattggaaccgtattatttgtagaaaaaatactagatctagaaccagagacacctaggttaaaactgatttaaaatgagaataattattcctaccaagtggagttgttgggagggtggtatacatatagatggtgtatataaagtgcatagcaagctggttgtggtggctcaggcctgtatttccatctagtaggaggccgaggtgggatgatcccttgaaccctggaggcggaggttgcagtgagctgagatcacgccactgcactccagcctgggcaatagagggagactctgtctcaaaaagaagtgcatagcaagcaccaggcacatctaacagctcctcagaacatttaagctcccctttttttgcttctttccctttggtataattttagaaagacttttggggagcatgacatataaatcattaaaaaagagagagcctcaaagcagaatcatggcaattgagctagatttgtatttatcaaagcaagcatgatgctgggatgcttaaataacagtacagtacattgcaaaggaactagggaataatgttcctattatttttgtccatggtcagcctattactagaaaagagtgaccacattgatttctaaagtccttatattcaaaactttctgtgctgaccaccatcatttatgtttttcccatctctacttaaaaacgtcaactagccccaacttttcctctagttatttcttttattagatttattctgttctccacaataaaatctatcttctgttcccatccatgacaattcaagtagttataatgggtggatatagggtatgataaatgttggtaaatccactgagttccttgagttccacattgatgtcttttaggatgtgactaggggtaggctaaatattttctagtttctcagatcctacccctggtctaattatgatatagaggccagattagtgtcaccagtttttctttctcttctgaatgtagagcaagagcaaatgattgcagataacagcatgagaaacttaggatcaaccaccagcatctaagtgagtcttgtactaggctcattccagttaaaagctgtaaatcatttcatagccacatcagtttagttctcttttatagaactcattatgtgatacaaaatatgcaaggcactggagatacaaatacaattatttcctcaaggaactttgagttgagcaaacatggtactgtctggtgagaccagacatatgagcaaacatagtacttctctggtgagaccacatagagaaatgtacaaggggtagaggaggcagtgatgactactggtctgggatagttgagggaaggtggcataggctgcctattgaagaataaattagagtttgctatgtgaacaaggttgcagagggaatagtatatggaaaaacagggagatgtggacccatatattttgtgcagagatgtccaagtacttagatattactatattgcaagtatgaagaaagctttttttgagatctgacaatgccaaggtaggttatggactctctttggagtccccaaaataaaaataaaacattcacatctgctaaagatagcttgaatggtatttttgctaaaggcagagtcatatactgtatgtgccagataaaagtcaatgtctattatgtaaacattgagattacattaattaatttaaaagaaaggattcaaacttagtactaatctgcatctggagaactaatctggtatgtgttattttcaagtcacccaactaaagcagtctgttgtatggaactctgctccctcttagtcaaacaaatgcaaccataaaaagcagtgcaaattcagtgtcaccttttctccatgggattgggtggtttcttttggagcagagagagtttccagagaatcaatatagtagccagaagaaaagtggagggtggccttaccttgtccactccgtgctgcctgagggtgaaatggaacctcggatgttgtacacctttaaattgtccatgttgcctgtttcatagccttcccgggccagggagctgtgtagtcagtttatagttctaagaaccagagcaggactgctgtgcttgtaattgcatgctttttatggaacaggcaatgttgtttagggaatttgggcagctggaacctgccacattagcaatttggactgaggaagaatttcagggtgataaaataaagctcattatataaattcacttgggtatttaggaggctgagaagggagaggatgagagtattccaaaggcaagcaggagagtttcataaacaggtccctttctattcgtttttactgtaagtgttgaattgagctaggaggatcacatggcccattttgcaaagggcagtcatgttctgctgtttcttagctgttttgtcagttggaacaaaacaacagcgctgctcattttttgcagggttagaggaaaaaggaaggactggccgaagaatggggtggggagctggagaagagaagggccaaaagtgtcagactgtggggatgaggacctgaaggaggcccatgagacctcaggcatgggccctggaactctgcctttttgaagcctgttgacaatctcaccctaatttaaccctttgtggaattcttccatgagatgcagttgccatcatcaggcttcctagagaattgagcctgcccactctgttatgaagtctacccagaagagctggcagagtaggccccttcactgggactgcagcaacactgaccaaagcaaatccttctcttggaagaaacaaactcattcctcacacctgcctcaccccgctcccaccgccaccccctgcaccacacgccagcccttaataaaaactaaaactgatgtcattgtaacctttggttattcttttttgtgcgtaaagtgtcaacctcctgttttattctcataaataatggaaatcttaacttcatttcagaaaatcacaaaagataacagggaccctattcaaacagaataaaaataattagtaagtcacaaactctgactagaaagaaaaagagaagagagagagggaaggagaaagaaagaaggaaagagagggagagagagaaacgaggaaaggaaggaaggaagaaagtgaaagaagaaagtcctcttgttggtgttaaaatgtgtctttaaggggaaacttatcatttaggttactaatggtttctttcttcatcattttaatttccattaataaaatgtgactttgaaaggatgcagggagtttgggaatagagagttttatttttatttgtttattttttttccccttctcccagcaaaatacacaggtatctgactatgtagagacacgaagccacctatcctgaccaaacttggcagtggtcaggggataggaggaagtgtagtgccatgggatgggcaccagccctgatgaactcgactttctttccatttctctcctgcatccaaatgttgaggagactttgagtagtagtgtagcctcttttccttttaaaaatctgcaccctgcttatttccaatacagatatgaggttggtacccactaatcttaacaggatatatatatatatatctaaagtatataacatattatttaaaaactaatgtattatttaggttttattaaattatcctgtttttaggctatgctgatgggctaaatttgcctaaactcctgagatttagattctcatttattggcattagaggagttcctaaaaaaaaaaagctattaagattaaatatcataaaaatctttctaggaaaatataatcaaaagcatcaaggctgtctcctacagttagtggtttctattattttggttctcagagctatgacaatgtcactggatttcaagaattcagaaagacaaaaagaaaactcataattttgaaatggggaaagggaaagatcttggacatagtcttctgtttttaaaatagtcattctcattttaaaataggaaaaaaattatttttcatttaacaaagcaaaaaacccagtctgtacttttaaattaatgcaaacatcaatattttatagggagaacattaataatcattgtggagcccattaatcacaattctgcttttgatttattgtaaatatgcctcccattttcctcctcattaccaatcaccttctttaattataagagggctttcattaaaacttttgaatcatttattttggagcacctaactttagaagacatttattgatttttatagcataaaatacaaatgtttttattttagaaaacatcataaactaaaactttattggaggagtttggctaaagattcaaaaatatatagaagtaaaaatatatttaaaactgcacagtttttacaacagcatgtatggcatttggattcagaattttaactagcagtaacctcatctgtttagtaatgaattttaaaatagaaaaaaaatctgccaaaacagaccagttgtttattagctatttaactttgatgagctgaaatgagatagtgaagcagaataattagaacaactttttttctcaacatctaaatatttctctttttcattaacatttcagttaagtttgaagaaattccaaaaatgagattctcattaactaaaaggaattctaagggttataagccatctacattttttctatgacctgaagactttttttcgaaaaccaattttgggggaggattgtcagatttacctaaggttttggtttttaatttaaaaaaatttaaagaaactatcttagtgatttttgtcatcatttttatttgttgccatgattaatatatggaaataagataaattggattctatttctgtgaaagccatattcttaacatcaatgcctacctaaaaaatatacgagtcacacttgatcattcagaatcattttgaaattctctggtaatcttttaaaaagccagcgttgactagtattatgtggctagttatatttattacagcagtctagttattgtttgtgtaactatagtttttttctaatagaaataaaatgtctatttgcaggataaaaagaagtatgtatatttgatgattttgttgtagaaaatacttaataccttttaaaagctgtttgactttcggttttaaaacagctgtgtagcttggtgagtcctgcagattccggctttctctgtggcctttgagccaagtaattttttgcaacattttcctttgctttcttataaacactcaaaaattatacttgcttttcctgaaggccagctattaagttagaaagcaccaaaggtgttatgaaattgccctttattttttcgtacatcagggaggaatgatagattttgtgtatctcttgtgtgtcattagaacagaaatatttagggctgctaactcccggagttgtgtacttacccttattacagatgcaatgattttgtctgactgcattgctttaagatgagttttattgctttcatgcttaggcaaggatatttaattttatttgtgtttagagtatcttgttgtaatatacttctcccccatcttgtgctcctaaatttgggataagcatagaatccttttaagaatgtaggttattttccagtttactagaaagcatgacacatataaattagcgactaaggattatagcgtcctttcctaaaggttatcatgaaaaaaagttaaaatgtcaaagaagatcctactccagtaaaaacaatttactctgtaaaatcctgatacctcataggaagctttggatcttgttctcagctaccaaaattctttaaatatgaaagttaacatgacaggaaagtggaatacactctgtgctgaagacccactgttcaaggtgtgtggttattaatctgggtttgaatttacaaattatatggtctgattaatttgtagataggggtcggtggaggttagacgatgggctttagaacaaagaggctgataaaatactactcacaagcctttctgcttgtttgtgactctctggaaatgccattagatagttctcatagctatggtcaaaataagtaggcttagaaataaaagacattttctcccctgtaaaaggaggcggctggcctgtgctctttctaggctcttcccagagacagcaacctcggcttctgaacccttagtgctcattctatgctccaccgcgtctcctctacacgccatgatctttgttatctgatttgctagccattgttatggaaagttctcgactgtaatgcaaaaagctcagccttgggtccttgctaatgtcagcaacccaaaggcgcccctcaaaccacctcgaaaagaaaaatcctttaaaagatgtcaaactctcctttcatgttagcccaaaatgaagttcccgagcagcatctggcagagcagggtaattcaatctattttaatgcaaagattttccaagaaggcaggaagccgtcaaggagaaggctttgaggcatctgctgttttgtttccagatcccttgtgttaatttaatgtttctagggaacccggctctttcttttttctcggaatccctgctctaggaactggtgagtgcgggggcgctgtgggagctgcagataagccagcgcttggccgggcacccgcgggccgcgcagcggggcagggaggcgcgcggccccagccgccctagggcgccggctgcctctgcgggccccggctgcccagcccagcgcggggaggcggcgccgactgccggggggcgcctgcaagacctgtttatttgcatttgtccaatttggctcaagtgaaaggtaaatacggagcgatcagcttgtcctcactccagcaaaaccagggaaactcagctccatctccaggaaacaaacccaacccaaacctgagtgaaacgtaaatcttgcataaacaaacacgttcttttgcttctgggaaggaacaccggagaaatgggcattccttccgactgcccgcctcccactgtcggtaaaaatgagccgtcacaggttgccggcaatttcttgttgtgtcccgagccattccgcggatcttgttttgaaggggcgagtcaggtgtttgtgcggctccagatcctgaacaggttatgcgctgggtccttccttatcaggaggggggtcaggctgccctcccattctcatcttccgccccagaccagaggctacaccaaagttcacttttgaaaagaaatcctgcagaattaaaaataaatgtctgccctttaaaatagtttcgttttagtattatgcatatttctgtttaggaacttgtaatgctaataatttatgttgctatgacaattgtcctgcatacctaatattaaatttaatgaattaatgtggcgtatagagtaatagtaacttaactagtactccgataatgccagtattccctgtgttactaagttaatggaatcagaattttggagttacaatatagaggttttttaggccaatttttctatgggattctagggatctttttataacatttctgcttttcgaagcagtctataccattgctggagagccgtaattactaggatgctatttctttttgtttgtttgtttgagacagggtcttgctctgtcatccaggccggagtgcagtgggtccaactcagttcactgcaaccaccacctcctaggcttaagcgatcctcccacttcagcctccccagcacctgggaccacaggccctcgtcaccgtctggttaagttttgtattttttagtaaagatttggtttcgccatgttgcccaggctggtctcgaatagaacattattccttatagtaagctgaattccctgtgtaattattcttactgtcccttcaataataaaagcctaaaattattcttactcatatattttagtgagggtggtgcatgcttgaagaccgtgatgagtgttctcttcttatattcagggcaactatgatcacatattgggctccagatccttgctttatgcatcttcttttgaattgtttagaaacaatggcaaaatttccaatttcaaggtagtgcttgaaattatgcaataaaatgttatgttagcaacatttttttttattttaaaaattcctttgattatttcacacttatatcctgttctctgttatggtagttttgttttctattttatttttagtttctatgtaatttattgtgctttagctgaaatcactaaataaagataaatgagtttaacagactcttatgtgctcatttttggttcttttttgctttaccccttgtattcgttttctattacgggcataacagattaccacaaatgtagtggcttaccatatccatttattttctcatcatttctgtgggtcagaagcttggcacaggatggctctcctggcttctgtgcccagggccttcacaaggctgaagtaaagggagcagcaggcctggacttgtacctgtaggccttccaggggagaatccacttccaggctcactggcagaatttagttccatgtggtagttgtactgggggcccagttgcctttcttggagagcactaactgctggctgttaccaagggtcttctagaggttgcccatctacatcttcaaaggcagccacagtgtgcagaatttgctttagatttccctgccttcccctaatgtgtttctcttctacttttaaagggcatgtgattacagtggcccaactggataatccaggctaatctcgctagtcaacttattagtaaccttaatcacacttgcagtgtcccttcatagcagtacctagttaagtgcatgattgaataactgggtaatgggacttctcgggagagatctttgacattctgcttaccatacccctctgggtaccactttgttgtgatggtaacctcataagcagccatttaaaagagattttaagcatcttaattttgaaaattttgcaaggtaaaattaaaataaatccaagtaacatcaaatattacttatacataattctagaggtttaataaaaacaataaacattcaccataagtagttgttgcttttaaaacccaaagtttttctaccttgcaaaatcttccttgattttcttgttttgttttggtatcacaatagatcagtttctagtaccaccactatataaaataaaaataataattgcattttaaaaagaatggttttcctctgcactctgattttaaccatggaaagtttttggtatattcaaatataattctattagattccaattttgaataagaaactgggttccctgacctagctgccacttactcatatctaaaatgtacttgaatttgcagcttccaagttgggcacatgtaaaccccctcttcacttcttatagagctgcataattcttaaagcttgtggtgacgggagggcacacttgcttatacgtccaaatttactgtttatggatctcgattactgttttctacttaaattctaatttttctcattcattaattttaactggacaactattcagaagtatgaattacatatgggcaaattctagtgctttgaaattactggaaaaaaaataaatggatgatcaacagatgcaaggaacagaaaatgtttggcttttaggggagttttatgaatactcttttggacttccccacttccttttagtaactccaatgtcttccagtaactctagcaaggaggaggcccagggagagaaatggggatctcacagtctcatactaggaagctgtgctatggggaagtgactggtggtctggagatgtgaggtagaggcataggcagcaggtatgttgacacttgaaaccagtacctcctcagcccttgcgggaaatgtgataatccaatcttagccatatatctcaggtgactctatatctgaaacgtgcaatgtaggtaaggtacttctgttgtttctcctaatttgtgactattttcatataatgaatgatggtcgtgggcattttggtatagaaggttttaattatggctcagtatttgtgtaattaaccaagtggaatgatttagagttctgatattactgaagtctttacagctggaagtcaatggatccatgccagtacattattaagtatacaattacttatttgcctatttatcccttctccaccttattacaaaaagatattgaggaaacttacacacatacacacactattaccaccaccacctaaaatgaatagatgaaattaaggtaaagggaaaataaggctaggagaaaaataaccatgctaggatgaatagggttagggcaaagaacatgtaatataaaattctatatggggctagagctaggctgtaaatttggctctggattttctagcagccaaaacaaaaagagagaaaattaatgagctacaggattcaccatattcataaaatgattaaagaagattgggattttcccttgaacccatcttgtttgaagtgggggcatttgatgctttctttctgctagaaaggttaactctgagttgcaataaaaatcataaaaacacaactttggcagaaacataaatgaacagtatgacagaatggaagcagttcacaggatttctaatattacctctcttttcctcggtccacattctaatattccaatatgctcctcagcacacagagtggtccaagaagattggccattctttccggaagttggacttccctgaagattatgtgggaatgggacgtggaacctgataattttttttgcagaatgaaaacttttatcatgaagaatttttctttattgcatacttttatacagttaggccccaacccgggaattagtggtattccaaaagttcctttttaagttgcttgtttgaaattaagaatgtatttccctccaaaaatgatgttggctacaatctaatttcagacttgcgatgaacccaaggttcaaagaggttaaatctgaataaatacagttctacaattctgtattcaaagccattgagaccagattttgctgaatttggatttttttttttttttgaagaaggaaagaaggataatattgtgcatgtaccagtcatatagcagtgtggtctggagcaggatcctataatcaagcacattaatatttctgcagtgaaactgatgaatattcacacgcagtggataaataaaaactataaatagcctcatgtcagttcaggtcaggtttgtcaccaaatgaattcaggccaaatgagttcaggtcaggtcaggttttgctgccaaatgaattataaaaaaaaaagaatggttttcaccacttttggggtttcagattagtggatctttattacactttttttaaaataaaaaggcactagtattataaactttaaccacaatgtaatgttattttatggaaaaacgtattgaattcctattaaggaagccaataagtcattgctgtattgcggccctgtagcaaaaatggagtgtttccatcaggctggagtcagagcagaaaaggacctcctctgtaacccaggagagagagggctcttgtcaggcaggtactggtgatagtattgggagacctagggctgggaactggggaggggcatgagacagggagacgggaaagcaagggtgagtattattcttttccttctcccttattcatttccctactttttctctttttttccttcctcttaatttttcttcttcttttttttttttcagatgtagtcttgctctgttgcccaggctggagtgcagtggtgcgatctcagctcaccacaacctccacctccccgcctcccaggttcaagtgattctcctgcctcagcctcccaagtagctgggcctacaggcatgcgccacagtgctggctaatttttgtatttttagtagagacagggtttcactatgttggccaggctggtctcgaactcctgacctcgtgatctgcctgccttggccttccaaggtgctaggattacaggcgtgagccaccactcctggcctaatttttccttcccttttaatgctagggcaaggagcatggcagtggtgtcaggtggccttacacttccctcttctcccactctttccttcagactacctgtaaagacactggagggtgctgaaataacaccgcttttaaaggtagttagaccacagtctcagtcttggctctgccctctggctgtgggaccttaagtggtttgctcagcttgtaaagtggagaaaaaaatatatatatatatgaaatactttatgtaatattatatatcatatggtaagtatacgtttatataaattggagctatgcatatatctttgagtggcatcccagaatggtagagaagattcagtgcagtgttaggtgatagtccctaccacagaatgcgagttcagtagatggtaatatccttcatcattgtttgttgtcccctctcgcaccttccagaaatcctttccttgtctccctgaactctggctgagaagcagggagccacagtgcagctgtgaaggggaggaaacaggcttcttctttttttggttttgttttattttatttgagatggagtttcactcttgttgcccaggctggagcgcaatggtgcaatctcagctcacggcaacctccgcctcctgggttcaggcgattcccccctgcttcagcctcctgagtaactgggattacaggcatgcaccaccacaccaggctaattttgtatttttagtagagacggggtttctctgtgttggtcaggctggtctcgaactcccaacctcggatgatcctcccgcctcggcctccctaagtgttgggattacaggcatgacccactgcgcccagccaggaacaagattcttaagcgttgagtatggcaaggcatactggggaagtgatctgcaaaagcatgaaagccccaaagtgtgggtgtttgtatctggtctgactgagggatccagtcccccttcgggacctgcttttggctttggtaaatcctaagacttagaggtttctggaagaaagactaatctgcagtctcttctgggagttgattggaaacaggtatctttggggcttacccagagctgttcacagatgtgagggctgatagtgccttgccttatcccatggccagggcctagcaggagtagcagtaagccctccaagaagccactagaaattgcacagctattctaggattgacatgggccctggctggtggtactatagctcttcatattaactgcatgcaacctttcaataatattaagtgcgtaacatctgccaggcactattctggggacatgatggttaatgacctagacaagatccctgctgtcatggaaacaaatgagggaactatgttggagaatagcaagatgagggtggatgggtgagtgagggctgtcagaggaagtgacactgaagctggcacctaaaggatgagcaagaattagccatgccagtagcctcctagctagagaggccagcaagttcaaagggccaagatggggaggagcttggtgtgttctgggacctgccagaaagtcatattgttggagcttcatgagcaaaggggagaggatccaggattgagccagaccttgctgagccttataagtcctggacaggagaatggattttattcaaacaagaagcccctgaaggtttttaggacagggacatagtttgcacagaagagtccactttgcctctctagtggatgtcatgctatattaaaaactggcagagtgctgggcttcttcagtgatactccagcctttcccttgtttttaactcacttataaataattttaagtcacttttcctctttattttttaggttttctcttcaaatccaattaactatcatcattaattaaagaatatgtgagcagtcatgtctgtagtattgagcaattctcctgttatctgttttttgctttctattatgggttttatctatttatctcccaacacgcccatcatttgctgccagcactggcatgctttctcttttaagcttttctcttttcctccctgtttcagatttgtgatagactctttttgtgtttgtccatttatttcaagtccgttaggggcattttctcttgtctgtgctgatttgctttatagaacttggttcagtacaacaaacctaaaacagctccttgtacatagtaggtactcaggacatgtttgttacatgaatgaataaacctttaggggcaagatctcctgggcttttgtgaagaacatgcagactaatacattatgttcctgcccttaagcagactactgttttagcagggctacttcagaacctaaagccaatgtttgcaatagaagcctaataaaggaagaatgtagaagtgtgcaatgtagaaaggaacttcgggcatataaatctgactccagaacctcagatccagcctctattctggctttttagtaggcgagttcttcaagggagagggaagtgtggttatcatggacaactgaatcggggctttattcacactaggagaaatgacccggaacttggtaataagatgaaagaatgatctttcagagtcgtagtagagcgttgtctaacaagacctaaggctcatctgattctgtagaggatgtgacttcattttagatgttaacttagagaaaactgatatgatgcaaataatttctggcaggtagaaaagataactctaaaggttttgttttattgtcctatagaatattcacatactacataaaaaaataacaaaaaatacatacaaaaaattctaaattacatacaaaaaaacctacattttgtatgtaatttagaatcttattccagtatttttttttctaaaaccgactatatgtatcaatttcttagccaatttactgttttcattaatgaggtatatgtgtctttgccatgctcactatatatttgcatgtggattatacttttaacattttgaaaattatattttgacattcatattcagtaaagtctttagacatgaatgtacatgtcattatccaagttacctaattatatcataccatgtaacttttaaatggacacatcgcagatgtcacaataagggaaattatagtatgatagagaggtaaacattttacttacagaaaacctgaactttaattttaagaggttctcagagggactctgtctttgtagaagttcgatagaaacaatcttagttaattttaggccagcctcagggaatgctctcactgaactgacctggtaacttgcctgtgtctactatactctttcttgtattgtggaaaaaataaaaactgtaaacttgagagacattccacaaatacaaatcttgcttcttttgcttaaaaaaattatgaacataattatagaaaaaagtagattctggttgtttaccataaagaattactactagaccaatagcaaaggaagttacaaagcacagatcacaaaaatctctccaatcacgtcaggaagttcagccctggatggtgtttgtttacctacagtgagggcagtctgtcaccagctgatgccctgttgagagcctcttgatctaaacaggaggttcagtcaatcactattaactgaaacctacattaatatgtattattcctcattaaacactgttaagaaaatgaagattaatacatgctgtattttgaacagatgacacataaagacaaaaactaaggaagcaaaacatagtacctgttggtaaaaacttcccaatcactgcttaaacaaatcctagtactgacctcaatcagggttttaaatacttgactctaaatcctttatcttgggccaggcgtggtggctcatgcctgtaatcccagcactttggaaggcggaggcaggcggatcacttgaggtcagaagttcgaaacctgcctggccaacatggcaaaaccccgtctctactaaaaatacaaaaattagccagggtggtggtgtgtgcctgtagtcccagctactcgggagactgaggccagggaatcacttgaacccaggagaaggcgctgtagtgagccaggatcgtgccactgcattccagcctgggagacagagcaagactctgtttcaaaaacacaaacaaaaaatcctttatctttactttgctcctttcaggatagctctggaatttgaatctgctttccagagctttattctcaactgccagcctcatttttcatactgtagttacttaagggtggaggtagtcgggccggcaagtaactacctgcagtgtacttgagaacctttgaaagcatctgtacttgccaagggtggggcatgtatgcttgagagccctttaaagcgtctttacttgctaagggcgctatgaccattcccattcctgggacttcattcccgctgggacctcattccccagtggagggtaaagcatggcttttgctgacggtttccaggtagccttccaaagtatgttagcataaaggactggagatgctgaccatctggctaactcatgattcagaagccctttggatccacttataaggccattctatttaggcctgctaaggatgtctgccatgctaatgtcaaaagcagggattttaggttatgttagtgatcagtgaggaattttaatatgttgttttgtcaactactgaggctataggcccttttaggtcttcaggagaagtagaccagtaaaataaacactgtgtgtttaagctatgagagctcaggatccctgtggttagcagttatgaggcacttggacacatatttatactaagagttgtagcttttacttatcttgggtaaaagaaatactccaaacagttagaacaaaaaaatatatctgatggtaaaatggataatgtattagtccattttcatagtgctatgaagaaatactccagattgggtaatttataaagaaaaagagatttaatggactcacagttccacatggcagggggggcctcataatcatggcagaaggtgaaggaagagtgtattagtctgttttcatgctgctgataaagatatacctgaaactgggcaatttacaaaaggaagaggtttattggacttacagttttacatggctggggaggcctcacaatcacagtcgaaggtgaaaggcacatctcacatggtggcagacaagagaagagagcttgtgcagggaaactcccctttgtaaaaccatcagatcttgtgagactgatccactatcatgagaacagcgcaggaaagacccgcccccgtaattcaaccacctcccactgggttcttcccacgacatgtgggaattgtgggagttacaattcaagatgacatttgggtggggacacagccaaaccatatcaaggagcaaagtcacgtcttacatggtggcaggcgagagagtgtgtgtaggtgaactaccctttatgaaaccatcagatcttgtgagacttattcacactatcaagagaatagcacaggaaaaacccacctccatgattcaattacctcccactgggtccctcccattacatgtgaggattataggagctaaaattcaagatgagacttgtgtgcggacacagccaaaccatatcattccacccctggcccctccaaatctcacgtcttcacatttcaaaaccaatcctgccttcccaacagtcccccaaggtcttagctcatttcagtgttaacccaaaagtccacagtccaaagtctcatctgagacaaggcaagtcccttccgcttatgagcctgtaaaatcaaaagtaagttagttacttcctacatacaatggggtacaggcattcagtaaatacactcatcccaaatgggagaaattggcccaaacaaaggggctacaggctccatgcaagtttgaaatccagtagggcagtaattaaatcttaaagctctgaaataatctcctttgactccatgtctcacatccaggtcctgctggatgtaagaggtggtctcccacaactttgggcagctctgcctctgtggctttgcagggtatagcccccctcccagctgctttcactgctggagttgagtgtctatggcttttccaggtgcatggttcaagctatcagtggatctaccattctggggtctggagggcgtggccctcttctcacagctctactaggaagtgccccagtgggaactctgtgaggggctccaaccccacattttccttctgcactgtcctagcataggttctccatgagcgctccgcccctgcagcatacctctgcctggacatccaggcattgccatacattctctgaaatctaagtggaggttcccaaacctcaattcttgttttctgtgcacctgcaggaccaacaccatgtggaaactgccaaggcttggggcttacacccattgaggccatgacccaagctctaccttggccctttttagccatggctgggacacagggcaccaagtcctaggttcacacagcaggagtccctggacctggtccatgaaaccattttttcctgctaggcctctgggcctgtgatgggagagactacctcaaagatgcctgacatgccctggagacattttccccattgtcttggcaattaacatttggctccttgttacttatgcaagtttctgcagctgacttgaatttctcccaagaataggggttttcttttctgttgtatcatcagcctgcaaatttttcacacttttatgctctgcttcctcttgaatgctttgctgtttagaaatttcttcctccagatatcctaaatcatctctctcaagttcaaagttccatagatctttagggcaggggcaaatgccaccagtctctttgctaaagcatagcaagagtcacctttgctgcagttcccaacaagttccttatctccatctgagaccacctcagcctggactttattgtctatgtcactatcagcatttttgtcaaagccattcaaaaaatctctagaaagttccaaactttctcacatcttcctgtcttctgaggaagacattttcctatcttcttcttagccctccaaactgttccaacctctgcctgttacccagttccaaagtcgcttccacatttttgggtatctttatagcagcacctcattcccagtaccagtttactgtatcagtccattttcatactgctatgaagaaatacttgagactgggtaattcattaaaaaaaaaaaagggtttagtggattcacagttccacatggctggggaggccttacaatcatggcagaaggtgaaggaggagcaaaggcacatcttacagggtggcaggcaagagagcatgtgaaggggaatggccctttataaaaccatcagatctcttgagacttattcactaccatgagaacagcatgggaaaaacccttccctatgatttcattacctcccaccaggtccctcccatgacatgtgggtattatgggagctacaattcaagatgatatttgggtggggacacagccaaaccatatcagatacagttcccaaatattgccttatccctcacaaaggagtggtgggcttagaaggccacatgtcagcagagtcctgcatctcctctgcataggtttatatcaccttctaatttggaaaattttttaaatctctgttctagctttgtcatatgccctacatgacagtggaactaactaccctatgattttcacctcagccaggcttagtcttcaggttccaggtgttggttgtttaacagcatcacaaaacctagggctcccaacatatgaatacacaaacttacaaataagacaggcatttcagagcagaacatctggtgtttgtctgccccacaggcgtacctcctttaggtgtaattcattggaatcccagtcagccgatttaggagcctaagtgcattagctcatggccagtgcactgtagccacatactgtagtttcttcaggttgagtgatgcttattgatctgttagtttgctccgcagagcccctctctgccccaggtaacttactttctgatggtaatattttgatagaaagtaaataactttgtttcaataaaagaaaaagtagcatatgattattttaaagattaaggtacagattggatatttttggaaaatttgctgctttttaggcagatgaactgttaggtgggtgtgggccatgttctaagcccaactaaatccatctttagaacaattctaaagaaagcagaaaagataaagatatcaagtcataaatgtatacttgtttattgagcatggtttaaaattttaatcagcctacaatcagccctggcatccttgattccccttactttgttgcactttttaaaaaagcactaataattatctaaaacactaaaaaatttatttatgttcattacttactgagtatttgccccttcatcctccaagtgagtggcacaggtcaggcatctttctcttttttgttcaccaatatatctgaaatgtgtgttacagtgcaaataataaatgttcaataaatacttgttagtgaatgttgggaatgactcaccataagttcagcgatattaagattagttaagccatgatccagtgaatatgtccatttttaggaaagcaccctcactaaaaggaataaaattttgttgtaagacttaggcccattactctggccctggtgaactggaccagaccacttgtaagccacacagggacctgccacaaagagagaggagataagacagagcctggatctctaaggtctagagcggagctggtttaagctgttttattccagggccttccttgttcactgctgcatcctcagcatccagaactgggcctgctgtgtagtagatgctcaataaatattttttgaatgaagaaaggcaaagtccttctaagcagtaggaagcctttctgtataggagtagaagaaggaggaacaatccaaagaggaaatgggtccagtgataagagcttacaagaacatgccatgtaggcacaaaaccttaacttcttggcacatcaggtatcagggaacttccaggcagtgcaggacacacaacctcctagccttcatccacactggaaggtatctctcattctcctggcacacctacaggtgggaagtcttgagcactgtcttgaggctgaacccgccactgacagaaatgattcagtttaacagaaaatcagttaatttatttgccagtctatttgttcacttgattaccattgtcatggctgagtgaaattttcatttaagggatgaatgaattgtaaccttttaagcaccatcacttaaaactatccaaccacttttgttggaaaatttactaaaacatacgtatatttccccatcttcttaataaagcattagaagattttcgtattatctcaagatcatttgggaaacattgtgctgttatatagtagtacacttagagtctactccaggtagagttttcattatgccgaagaccatatattgtattttttgaattctcatgcctgtttttcttggttttactgtcttctctctctggtaggttatgtgttcattttctagtgctgcctatgtggctgccccaagagtctccaatctcccaaaacatactgtccctggttatctgtagaaaaatagatggccaagtttattagattcatctaaaatacaaaggaagtttaatgtatggactttgtgatacccacaagcctcctgtttcatctctcccatctctagttcttctcagcagtgctctggaaaattgggctcatcagacatgtggcttctggagaaatgaggttttaataacttgtcgtttttctgttccaaattttgagagtagcagtatatcactgcttaaaatgtgctaatttttgagataacttttcttagcctggttctcattagagcttaagaaggagacaatagcaataggacattgtttgctcagcctctccatttctgtaggaaaagaattgttaggaggaggaagggtagggaaaaaaaagtgcaggggagtgtcatcatctggtagatagtttaaaaaaattcctctggctttggagtaggaaaattgattgtagaggatccaggaggaatcagagaggctgttgaagaggctatggtagctgtccatgtgagggacaatggcttggacaagggtggcagtggtgcagatagaaaagggtggttggactcagcatacattggaagaagagggcacaggaccctgtgtcagatattttggtatattcctcctatcattagagtttagtcatgtgtattcacaccccacatttgtttcttctaagaaatgaagtctatccgttaaggaaatgtcagttaatcctcattgctgctgttatcatggttggatttgctccaaaaggtatgttaccatatatagaattaaaaccagtctctaccctgtggggaagtaatgcagatgttttgagattagagtttagaatctattccaaagatctgccagaacacatgtttaacaatgagcatgagagttttccccattgctattcttactatgttgtttatcaaacaaagataatttgggggcttgtgtagaaactccacaatatttaagaaaataaacacaaatctctgagtcaataactaaatgtttctgatggtatactaagaaatataacttattttattaatggttattaatataaccatgacttttaaattaatattaatattaactgatattaatattaatgtaaccatgacttatattaatggttattaatataattatgacttttaattcttttaattaaaatatttgtggttctttatagttcaccacagctttgaataaaacaaaattgttttcatgttttaaatgcagtggaaggttttatgtttggtgttattcaattggtaaggcaaattgctttgttattagcttgatttacgtgaaaatttagatttaattttagatttggtagattttaatctgataccattttatattggtttatatctgaatgcttcattaagatcctgggtatacacagtttaacctcaagcatatagtcttattatattattttattataagaaacagaagtatggaaacttgaggctgggactgttcagagctaaatcttatgaaatgaaataagttcttgtaatcattttgcagccattatttgttgtgcttttgtggtattttgtctcttttgagctatcctcacaggtttccaggaattcaaggcctaagaaacattctactaagaacttgaaataccaaggcatttaatttttggaagtgtagaatgttttattacttttgaagttttgaggaccagcaaaatagagaagtgtattgtgttacacaatttgctatgttataaatgtttacttttagtggacatgatgtaactagaatggaaaaaaacacagaaatagtaattgttgatataatcttgccttggaggtagcgatgggtgggggaatggggagtgggaacatagcatgagaggagaaaaaaatctgttaccaatttatggtaaaattattacagttaaaaagagttgcatatatgaataataataaaaccttcacccagctttcttgaaagtttacaaacttcctttctttgcttagaactagctcgagaaaggaaaaaaaaaatcttctcttagattctttgcataaaaaactaattcctttatttttctcaccggttctcttcatctttcattttggtccccagagaatactgtttgactattttgaaatcatttctcttctccactttgttgcactttgccctctgggatcgtttccccagctcactcttcttcctttgtcctactgctccctttacccccacctctctttctatagccaagaaagaaacttgttaaccatgactttttcttttaggaaccaattcaaaaatccctttggtacacaggtttacaggcaccctatctcagtctgattccagaaaaaaaagcaccaggaaatacaggaaaatatgtagctattaataaattccacagataggcagaagttgccaaaggaaaatgggagaacaacaaggactgttcattggacttccaggaatagaaattgttgggagtctactcttttcaaaataaactgacatggggctgaccaccttgtcagttactcccatctgatggtggggtgtggcaaacaagggcaaaggtattgtttggttttcaaggtcaggctgctaattgtataattggattaacccagcccgcagagacatggagactaccagtcacttgttagcctgggtcccaaggtagaagcagcacaaaagtatggggaggatgttcagctgaaatggaaggaagaaagtaaagaggatagagaaaaaaatacagaaatgttagccaaaggagttataattaggagaaaaccattatcttattaatctctgtgtgattaattaattataaatgagttttctcttggaaaagagcgaagctacttagtatgacttgtggggagagtgtgtgtgaggagaagaaagtgtactttttctgcccaattatggaaggtcttaaacatcagccatgtttttaggagtttgactaataaatccagaaggcttattatttattttatccaggcatgttttatttactatgagagatcttcttagttcttgcttttgttttgtaagaaaaatgagctaggttagcagtgtccgttttctgtttttagaaaataagatgtctgagatgttagaatcttcacatataatttgtcctaccccacagtcagcaatttcatatctactgctcacagtatgcccaatcagagcacagacaggtgtgtgatggtggcttctcagtaggaatttacatttaagggcgcttgtcttcattggtttgtttgccattcattcattcattcattcattcattcaacaagcacccactgcataccagcactgttgtagggatgtttatcctgggtgagtgtgagaatcgccttactcttcaggtgcctccacagttctctgctgatttctttagtgatgatttgctgacactatgcacagtggtagaggtggctttagcagatattggaagggtgccccagaagaagtgagtgacatttgagccaaaacctaagtgatgatcaaggggaagactggttcaagcagaggggcctgtaaagccagggctgtaaggtgggcatgtgagatagggagaggaagccgctgaggtaggagtctagcgaacagggtgagaaggggtaggagatgagactgggcaggctggcagtgtcttcaactctggctgcactttgcagccattgaggtggctcaggccatatcacagaccaattcaatcagaatctctgtggacccagacatcagcattttaaaaaaattctccaggtgactctaatgtgagtttagatttggtctgattacactgggaagctttggaagagaatgatagactcagcttttcattctttaaaaggttgctttgaggctgtgtgtagtgtgaagggtacacgggggagaaggggaaagggtgtcttcaggaggaccagttaggaggctctagtggtggtttgagtgagagatgatgatggtggcttaaacaaggctggcagtgaggacaactgggagaagtggtcactttcaggaagtgaggaatgagattaagagagaaatcaaggatgactcgttgtttggggaccagaacaattgggtgggtggagtggccatttatagaattagggacgacgaaaggaaggtggtacaggtgggaggaggatctgcagacctgggatgtcatctcattcccattatcctgggctcctagaagacacagctcacacttcctacaactctttaagttcatacctctattatagcactagtaggctgcacattgcctaatatggactctctgccttattttcagcaaaattcactgtgtgaccaaattggtattatgagcactagtttcatttcatgacaaataggaatagagagaaaattctcaataattttcccagctttaattctctgttgctcagcatgctttgagccctgatggatttctttcgatttttcagaagaatcctgcctatgctttaatataaaggaggatgaatacggcagattcagaaaattgtggtgtcaaaggatgagctttgctttcctgccatcttctgtgctttgtttccttccaaccttaaaggaaatactaccctacttcaataaaaaactaaaacaaagattcaactcagcagaaggaagagcccaataagcttaaaataaatttgcaaaggctaataactggaaaccttttttaagctaaataaaagccttgtgtttaaagtgatagtctgccttttctggtctgcatcatgatagcttctaaataaagaaaacgggccgatgttgtgagtaattgcagctgctactctgggggttacatcaggcaagtgatttgtcaataagaatttattgtcttcatttctgggatgaggctgagggcaataaggaattcagaaggctgcttccttgtctttaaggggtttgtagtccattggagagatatgtctggctttcttgaaccagttaacaaacagttacattagatgtaattggaagctaacttatagagatgagggcagtagacattaaaagaaaggagaggtcaggcaggaaaagccatgaggtcagtaaaggcctcatgggcaatagggcttgcctggcaaatatttggctgaggcaagttggaagttgagctggaccttaaatgatatagagacctttatttaccgttatgtgctaatagttaaaatttacttatttgggactgctaacatatgctcaagttaaaaatgccaaaggtctcctttctattcctgcccccagtccctcagtttccctttccagaagcagtgctatgactcctttcctacaaacccttccagatacagtatcaaactttttttttttacatatatagcatttcttatttttttatttgtaaaatttgtccttttccaagtgctaaaacagtaaagaacaggtaagctaaataaaacaaaaacaagtcaacttccctgtggggaggctagaacagtgctggtctcattgactagtggggagcagtacatgaatgaggtttgcttttcctaagatatttgccttctcattgattggagtattggtggctaaaacgtaagcaactctgaaccctctagcacttacagaatggtgataatattgtgttgagtgctatactatgctagaacttcacatctgttttctcacatctctgtaaggtgagcctttccctcccttgacagatgacgaggctggaactcaggctaagttagcctgttgtaggccagacagcaaataggaggtagagctgacttctgacctgaccttttcctaccatattatgctacccctctggatctaaagctcttggttctgtatttctagtatcattgttgctgttttcttttatggctttacatactgagtccttggtatgaacttggggtgacccaagagaaaaaagtgagtggaaactaacttcctctctattaaaaaaaaatctgctcaaaggagaagggcaaattcacagctcagtttcagggggctgcaagtcaagtcaatattttcttctttttttttttcatgtggataaactgcctccctcattttgagttttcgaatctgaaataatgagagtctaatgaataacaaatatatacctctttttcttcttttaattcttattagcattttggattcaagtctagaaattcctcttcatttttttttcttttttgtctaacatttcttttgaataaagagtattacctacttttaaatgcaaaaaatggaaaattgggaagacattgtcttcttgctttttgcagaggcaacatttttattagtgtgcatatgtgtaagtttggccccaggctgtgctcacaatccccaagcccctggcagaaggggactccagggtccccccatctcagggatgacatgtgggtcagtatagtgtcaggatggtgatgatccactggctctgaaaccacagaaatgttcatcagtgtctgctgccgcctacctgtggccttcttgttaaatgagagaaataaacccgatttcttttggttgttctatcattcctgcagcccagaaacaaagagagggtatgactggttcagggaattttattcagtctggtgggcagacagaatgtgaagagccagccagggtcccaagatgatgctggagccattagcacggcttacattttcaaaggtcttgtaaatcacattatggttttaggatgtttttcctgggcagttattttaatcaggggatcagacatgatcaacttttttttttttttttttgcttaagaacgatcactctggctgctctgtgagcagtgaattggaagtgacaagactaggggcagggagacctgtttggaggctatcgcactaaccctggtgagaggtggccatggcagagttgctggagggaagggggagaattctagaaatgtttagggatacaagagaacagggcttgatgtgggagatgagagagaaggaggactttagggtaacttcaacatttcttgtttgtgcagctggttggttggtggcgctttttggttgacaaagggtatacagaggatgatttcttagtcctcttattgatagattttaatacaataaagtcatctcgaagtttcagatacatttcttcatgctctttctaggtttttctttcttttacatgtttcatgggtgggggagggtttaagagtctcaattgctctggaaattgaccttcctgctagggaagagatggtggtatccttatgacagttttcttccaaattgtggaacgctttgtggtatttagtaatcatatttttggttttttttttttgtctacagggagtggaattactttcatagaaatatataaaaattcattttttctctcctaatttttttttgtgatacatttttctgtaaggaggaattataggacttaactttctatgagtgtggtaaagaggataaatacctctgtatcctctttatataaatgaaaggcatctatccagttttgaattatttggggaaaaaaatcccatggaggaatgaactcgagataattaaatttctccaattcagaaactctgaattttttttttttcttattaggaaagtggttgagatatggctgaatggaaatttaaaatcttgagcatggttatacatcagaaacgtaacatgtagtctaggtccattccagagagcaaaaaagactcaatatttttgacattattaatgaatagattgatgcatttgttatgcctgcagagaaacattattttatcacgagttgcctgcagctcagagagtaaagggcttttggaagagttattcagagagaggtcaagggggagttactggttttttgtttttacaaggaagttttagtaaatcatattaatagtaataataataatgatgatggtgtacatttgcatagcacttggcagtttacactgctctttagagtgcgggatccacgcagctctctgtgaagtaagcattttataggtgccaaaacagattcacaaagtgtacctgaggtcatctgtttcctggagctgtaatttttcccaataatcagtaatattccccatgcattacaatggtatccacaatgcagctgtgtggggagaaggtaagcctctttattgagggtgagagggcatgaaccggctcctgggtgcgccctcctaggattgagttagagtttgcaatattaaaagcacaactccagtcacacctgtggatggtaacaagatgctagactgagcacgataggctatttctcatttttttttcctagtaaaatttatttgttctttgttctcatgtcttctgttagcattctttggaaaggcattagttagtgccacaggttttagaaaaaaactaagggaaaaatactaaagctgagaatgttttattaagtttttttttttctgtgaattagtaaaagactgtcatgtatgattttagcagaataccttgatccagattgaggaactccaaccagtaatcctgggaggcataatttaagaaccgctaacagaagcattttgaaagtgattgaaattgacattccttaaaaaggtagtttattgccttctgaggaacatttgtttagctctttaaattattcatatttgaagggaaagcattctacaagaaatcttatttttgagatatagctggtaaatatggaaaactcaaaacgcctgcctgttctacttgtcatcgttcatcctctgacagcttacaccagtcaagttactaagtctctggttatttttgagactctttctccccaagcgttccttagtgaatcttaagattctgggatttagcttagcagacaggctgtgccaccatgcagtgtcttctttggccctccctgccccattgcaatgtcttttactacaccttatttagccaaaaatgtgcagtcctttagtgatgagaatgtaataatggaatacttaaagtaattaaagatactgctttttctgattgaaacaaaagctaatagacttccaattgtcacctgtcacagtgtacttttttggagttgccctttgagctgtgttatctgatttgaacttttcaagcttcctctggccacactgggatttttctctggctatgccctgcagtccctttactgaattggcagtgctcctaatgcttttctctagctttcatttgaccttcagtagaggttaaaattaacttcaaggtgaaactggtcctcgtgattggtcgattgcttctctttcttgagcactgcacccatttcagaagacagatggttttagtattaatggcatcaaccatcctttgctggaagataaagagtcagactttctatttggaatgtaagctccttgagggcactgagcttgtttattcaaccttctattcctagtgcctagaacagtgcccagaacactgtagaagaagatgtgttgattaaaggaatgaaactttcctatagggactctcaagagatagctggcctaacttagaatagaaatgtgtgtgccaaggactcgtggtttcaagaaacagatactcaagtgggtgtggacacatttccaggatgttctccctctcacatgtacccaaccagaccctcgggccttgtcctttctgtctggttctagggaaaaagcccattgcctgtgctttctaaaataataaatctcacattcacaaaggatctggtttctgcatgtttttctgcatgttccaagctccagccatgtgcaagtgatattaacaaatttatttatgatttgttcgtatcctcctccttccagagattggttgaaatattaaactgttcatttctattcttcacttcctttaagccttaattggagccacttcttctattggataaacgccttccctggttggcctcgtttctctcaggtcccttgtttcactttgtgtttcctcagttgccagtaggctgtgctgtgatgctttgcatttatttggttatatcatgtatacatttattctgtgtcctctattagatactcttgtcgttttttaagctaacattcattgaggtttattgtgtgtcaggtcctgtgtttagggctttggatcctaaattatcacattaattttcacagcaactgtttgcagtaggtggcattatccccattttacagatgagaaacctaagttttagaggagagacacacccaaggatgtacacctagtaaatggcagagctggggtttgaatctttatgcatttaatttaaaagcctgaatcatcacatttcacaccctcttagaggaaggcagggttcatgccatctgcttcctccaaccaccaccactcttcagcagtataccacagaatgctgtaagcttcttatgacctgaaaagatgtattttaaatgcaatcaatacaagtcttctgaagaaatacacacaagcaaattcaattcaacaccaccaaaaactccttcaattaagataaaccagtattgacattttggagtatatctttccttgtttcttttgcaaagaattaagtatatacattggaaacactcttaaggcttaatgcattctgctaataaatttctccttcttagaaccaaagttgtgtgctcactaagagccatttgtttttttcttagtactgtttatgccaatcgaacttactgtaattctgtaatctaattagatattacgtaaaccaatgaaatatgagtataaaaatagagttgttgccactaaaattaggttgaatgctttagcaaaatgtgataaaaacaaatctctaaaacaattgctctagaattcagagtaggtggaacaactgaaagatttgaaaataaatgttaaaagtcacaaaggattcaacattcatattgcttcacaagtgtatttaaatttttgtttcatgttaaagaaattgaaactgaaaatagagaagaagatggattatggatatgatttatgcaggaaagattatgtggaattctagccagcaaatactcaagtcctcagtgttaaagttaaaataaaatgttttaggcagcaggtggtttttttttttttatgaatcctcactttcactagcttttgaaattaagcaattaacttctgatcctaaatgtgttagataagaatgcttctactctatatatctcaaaaaagaataacataatttgctaagcagcttttttcatgtaatatatcatgaacatgttttcaagccaataaatatggattaaaacattttctggcaatataacgtacatgcagaaaagtacacagatcctaagtgtacaactcagtttatgatcacaaagtgaacacatccatttactgccctctacttaggtcaagcaacaatattcccagtacccccagaagcctcccatggcctcctcctccccaccagagataatagctactttgaatctaacattataatgtttgttttggaactttacgtaaatgaaatgtctgtagtttttgatttttttacttactttactcaatatttgtttgtgagattcatccatgtttttcacatgtattatttgtttattcattctcattgcagtttattatttcatgtgaaagaagataccataatatttactcattctgttgtttttgttatatactttatttatttttttttttggagacagggtcttactctgttgccaaagctggagtgcagtggcacaatctcagctcactgcaatcccacctcccaggttcaagtgatcctcccccaagttagccgcctgagtagctgggactacaggtatgcgtcaccatgcctggctattatttttgcattttttgtagaggtggggtttctccacgttgcccaggctagtttcgaacttctgggctcaagtgatccactcgccccgccctcccaaaatgctgagattaaaggcatgagccaccactcttggcccaccattctattgttgatggccattggggttgtttccagttgcgggctattatgaaaaatgttgctatgaacattcttgtacatgtcttttggcatacgtgtgcagttttaaagttgttcatttgtttatatgccttaggaatggaattggcaggtgataggatatgtgtatgttcagctttagggaatactgtgaaagtggttgcacaaatctacaatcccatcatcaatttatgtgagttactgttgttccttatctttggcaacacttggtttggtctgtcttaactggttttatccaaactggtaggcttgttatagtctcttgtgattttaatttgcattttcctgttggctaatgagcacattttcatatgtttattgaccatttggatgtcttttgggtgggcatgttgaagtatttgtttagtatttgtctcttgcctacttttccatagaactgtcagacattttctcatttatttgtacttatatattctagatgtaagttcctttgttggttatatgtgtcagcaatgtcttcttccactctgtggcttgcctttattgctctcttagtagggttaatggagcttcccaattttaatgttgtccaacttaccaatctttctctttgttgttagtactttttgaggcttgttcaagaatcttcacttatgccgaaggtcatgaagatatcctcctatgttatctttttttttttttttttgagacggagtctcgctctgtggcccaggtgggagtgcagtggcgcaatctcggctcactgcaagctccgcctcccgggttcacgccattctcctgcctcagcctcccgagtagctgggactacaggcgcccgccatcacgcccggctaattttttttgtatttttagtagagacggggtttcaccgtgttagccaggatggtctcgatctcctgacctcgtgatccgcccgcctcggcctcccaaagtgctgggattacaagcgtgagccaccgcgcccggccccctcctatgttatcttttatcaactttattcttttacctttcacatttagatctacaatccacatggaattaatttttgtgtatgttgaaaagttagggttaagtttcattttatgctacattaatatccagttgctcaaacagcacttaccaaaaagaccatccattccccattgctctgccatacagcctgttccataacataaatcaaatatccatatatgaatgggtccagctgtggactccttattctcttccactggtgtatttcccttgagctaataacacatactttgattactgtagcttagtagactgaggactacatcttcttcttttcaccagttcctggagattcttggttattcttgatccttcacatttccaaatgaaaagattagaacagcttagaacagcttgtcaatttccacaaatacacacagagacacactcagatttgcagagatttttaatgagattgttttaaatctatagatcaattgcttttacaatcaaatctctaagagaattgatgtctttgcaatattgaatcttcctctttgtacatagagtatctttccatttatttgtgttttctataattcattgaaagttttatgttttagttatttatcttcaacataattctttccaatggctatagaatattttttggttaacataaaaatttattaattaatctccttgtgttgtaaacctaggttgtttctgttttgtttcattgttgtaaataatgtgattatgaacattcacaagtatacatattttagtgcctttctgtctccttggaattgactcctgaaactggaatttctggaacatacagcttgcaccttcatattccccagtgagttctatcattttaaactctctcccagagttataataggttccactcttgtgaacctggagaataactcactgtattttccatttgaattttttaattactattgacagtgaactagttttcatctggccatttgtagttcttttgtgaatagccttttcatggcttttgctcagtgtttttatattttcctattacttaataattgctctttctataccacatataaccccttgtcacgtgtatttacaaaatatgtctgtgtgataaatgaattaaccagtatacgtttgttactggagtggaactttacagaagagcacaaaaagaaaaccttgttaagcctgttggaaatgtgattattccctgaatgtttatgtcctttgcacatttaggaatatcatagcaataatgaacttagtagtagggacaatcagcaactaaatgaagtagaagacagataatataattgcatgggaagaacatagaaattagatccagaaaactgggttctagacatgacctcactgctctttacctccatgatcttgattaaaccatatattctctctgagtcttaatatcttcatctgtatagtgggtgcacttatacttatttatcttccaggtctaagatgagatcatatatgaaaagcaatagtgcaaacagtgaaagttataccatagaaattataatgccaacaaatatagtgtaagtgtggcaagttgaatgtatgctttatttaaattatcgtcttttgaggtaacctaatttataaaatattcagcctaatggccatcattctgagtctgtggtttgtgagtttgtactaatttgcatgactccttttaaaaagaaatggtttgttgtttgaaaaaatcaagttgacatcctttgtgactgttcagagtgtgtttgtggtttattggcttctagggcattaggtttctgtctcccatattgacagtctttatgagctcgttagccactgttctggtaaaagccattttgatctgtgatgagggcactacattaaaagagtattgaagttggaaatctatattttggttctttcattagaatgtgccctttacaaaagaggcaatatgaatttgcattgcaaaggattgcttatttctttttagaactcttgaagtcaggtaatttaattatgtctatgccatagccttttatcttcctctgcaaagaaactctctcttctgacacctcatattggaagccggtcttcttatccccagaattaattaacatgcaaatacttgtctagagatatgggaacagtgctttttcaattagcatttaaatatcactcttaatgatgttagattgactcttttaagggaaaattaaaatagtatagtcatctctggattatttcctagagcatattattgatatttctgaagatatgggcttagtaggagcttttatcttctactgttcacagactgattgagtcagatccagggttggactggacagcaaagcctggttctggccttcctttgcctctggtttcctagctaggcctgctgatcgtgccctgcactgcttctcagtagcaagtgtatttatgtaggagcggcacctgcaggaactgtttgcaactgggaagggtacccagaagcaaggagggaagtatagaggagctttggtagcaatcatctcccaaaaaataaagaagatgaactttggagttagagatgcataggttcaaatgttgcctgtgccactttgaagcagtatgatgttgagcaagttacttcccttcactgagactcaatttcctcatctgtaaaatataaatagtaatatttaccagtcaggttgttaagagggttaaacatgacagtatatatgcaatatgtcttacgtaagtcagagtaggctctctgctgtaacaaagaactccaaatctcagtggtttaacttaggttatgatgtggtttgactgtgtccccactcacatctcatcttgaattcccacatgttgtgggagggacccagtgggaggtagttgaatcatgggggcaggcctttcctgtgctgttctggtggtgacgaatgagtctcacgggatctgatgattatataagggggagtttccctgcacaagctctcatctggtctgctgccatgtgaggtgtgcctttcaccttctgccatgattgtgaagcctccccaccacatggaacggtaagtccattaaatgtcttttgtaaacttcccagtcttgggtatgtctgtatcagcagtgtgaaacagactaatacaggttatttcctgctggaagaaagaggagggctttgcttcatgcagacattcagggacccagatatctttcatctagtggccttgtcattttctaaggccttggaaccctcattgaatcatctgtctctggctggcaggagacgggagagagtgaacatggattgtgcagaaggccaggctggaggtagggcacattgcttccactcagattacattggctagaactcatagccatacctactttgtgagttttttttttttttttttttttgagacagggtcttgttctgttgtccaggctctagtgcagtggtgtggttgtccaggctctagtgcaatggtgtgatcaggcttgaccacctgggctcaatcgatcctccttcctcagcctcccaagtagctgggactacaggtgtgcaccactccacctggctaattttttttttttttttgtagagatggggtttcaccttgttgcccaggctggtcttgaactcctgggctcaagtgatccacccacctcagcctcctgaagtgctaggattacaggcatgagccactgtttctggccaccatagctactttcaagtgaacctgggaaatttgtgcttaagagaaaaccaaaatggatttgtttaataaacacatagtccatcactatgtagttcaccacaaacatatagtaatacttgttgaataaatgaaaggaagaaaaatgaaatgaattttcttcttcatagattcctagagtattagagctgatgggggccttggaagtgatagagattttaccccttcttttatagatgaggagcctgagggcttgaggaatttagtggccaatgcaagatcatccagctgtttagtggcaggaccagaacttgaacccactttccccaaatgctgctgtttattctgcatttaattatttaaaatatcattgttttctgccatagggttgcccttgccttttggaatgtgaagatgggttaggaggtgggaggggggttaaggatgttattctgatcatgatagctagacttcagttttctttggggaagaagaggtttggtattttagggtagatataccctcagggctggaggctctacagcttctcagtaatttgtactgagagtgaaaattaatcttcactcactcactcatgtgtttaaatagcttttctttagtcccctcctatgtgtaacaaatcatccaaggtgatatggatgcaatgatgagcaagatgttcacagcctaaggaaggtgtcaaatatttacacaataattactaaatgaaatgaggagcaaggaagcaacaaggtggaagggaccagctgctagggtggggagggagagggcataaggaaagctttatggaggcagggtcttgaagaatggatcacagttttttgggaatttgatctgtcctgaaatacacacacttgtgtttgtgtagttggtgcaaatcaccttggccagttgtggatgtgcattgagaaaaatgaaagaaagaaactgacaaaaacccaaaatgatgatcaatgctcctgtgagcatttggtgctcacatttaccattcatcgataattttgtcaagtttttaccagtaaatgattaataaaataaccttccagatacagctcaaacatcaataagcaatattttatcacatgccagcaagttttagatccaatgtgcccagcaatttttggttaggtacagacccttagaatttgtaggggcaggggtaagatgcatgaaataacagtaaactaagtaccagtatgaagaggaagacacacacccgtgtagaggatgtgcaaacacgtatataggtttgcattaggaggcctggttttcagaaaggtttctgtgagatgtactatttagagctgagttttggagggctgatggacatgcttaggagttggcatctcaagtatagttactaaatagtggtgaaagagcacgggttactctatagtctggtgtagaggatttttggagaagggggatcgaatggaagttttatagttagtaagtggcagagcttggcttagtaccccaggcttgtctgacacctgtccttctcccatagcaccatagtgctttgctgagaatgtgggtaggagtcagaatcctatgatgctttccgtttggaggttagagtcagggttgccaggggtcgattatgaaacaggtgatgttcattttcagcatcattagctcctctttggtgtgtctcttctctccttggcattcattttctcacacccttcccagctgattcacagtagggtttcagaggactctaggacgtatttgtattattttaaaatatacattttaaattctaaagtatccttatagtaacaattcaagttgtacaaaaaggagataaaatgcaaagtgattttctctttctctaaaacctttaatcctcatctttaaaaaagtatcttttcagaaattttatatggacattcaagcacacacaatatatcctcttttatctgagagaacccatttaatatatgcattttctgtaatttgatatctttaattaatatatggaacagtctttcatacaattatatagttctactttattttattttaatcaacagaatagtggtccactgtactgcttttctgtgattcttatcgaacagtatttaaatttattttcttaatgtctgcatttattatgcactgtgttgcagagaacatccttatagcgatctgcaaacttgtaaaggggttatttgtaggggacttgcaatggaatttctaggttgaagagtgtgtgtatttaaaatttttttgaagactgtgtgtatttaaaattttgatagatattggggaattgtcctccagaaaggcagtaccattttcattgtatccgcagggtatgtgaatgcctgtttcctaaggctttttctttttaaagaggacttgaagccagagaagaggagacaaagagcagagtgggtactaaaagtaagtggcggccaagagaaacagaaacacaggttcacacaaaaacttgtgcatagcagcattatttatagcagccaaacagtggaaacagcccactgttcatccagtactgaatggataaacaaaatggggcatatacatacaatggagtattattcagtaataaagactacagtgtggataacctttgaaagcatgctgctaagtgaagtaagccagtcataagataccatgcatacttatgtgaaatatccatgtaggcaaatccatagagacagaaagaagatagtggttgcttagagcgggaggtggggatgatttgggaaatgactcctgatacgtaaagggtttctttctggcatgatgggaatgttctaaaattagattgtggtgatggttgcacaactctgaatatattaaaaaccactgaattgcatactttaaatgggtgaattttacaatatgtgaattttatgtcattaaaactatttaaaaaataagtggtggcagaatgcatggtataggatggaaaggatgaggatatggtcattctcacgggcctgtgggttgggcaggaagacagtgccatagccagcgagccaggcaaggtgggggaaggtgttctgccaggctatgctgagccaggtattcaggtggctgatgacaatcagctctaggggtggatggtggagttttttcccctaacagaatagagacaagaggcagttgatgccatgccctaggcagggtcagaactgaggttagtacactgaatttcttactcgttgttcttgttcagtccttcgaatacacagaagatactgttctcctggaaggcagtaatagtttcctttgctgacctagaaatgcctgctgtgctccagcatttggaaaaggaaggtcagagagaggaagctgagctcagctgctgagtcaaggaaaagagaaggaagacctaggggtcaccaacgaagatgaggccctcatttgtgaataagtgtagtcagttttaaatttagcaattaagctctttctatatagtggaagtgactgttcttttggaatgtgtttgctagtaaatatcataagaatgtttaaaaggaagttatgattttaagtgacctctgagttgtgctgatggataaaatttagctcaacggaatgagggttaatctcacggtatactcggaaagttaaagggaaatcaacacactttttcaccaaagcccgtttttcctggtgcttgcggctgtttgaacttgctctttgcttctcattccccatcatcgtggctccgtggcatacattaaatcaaaccatgacctccatacattaaatcaaaccatgacctccgaatcttcttagttattttcaggtacaaggttttcagcttcagaaaggacagaggtctccatggttccattttgaagatttttgggtggctactgcttgtttaccagcagtttggtatagaagcccaagacagtccatgtgtggttcagtattgacctaatagcagaataaatttggaccaaacagaagtccttttctttgtcactgtgtttgattaactatcctggatatgctttattctctaaaaacttcatttttgaaaataccatggttattaaacaactagtctttgtgcgtgattaggacataaacaggaatctcacccacttttaaacctttccaagaaataacttttccactgattttattttgaattgttaaaaaacttttagcagggagagaaaatttggttgatgattcagagcgcgagggaaaggaagcaagggattctggcacatgcgcacgagttgaatgacaactggtggatatttttatatttattgctattcttagcctaaggcctggagctgagtagggagtaactaagcttagccatacttattagacttagagattttactttgtttatgtcaatgtcaaggcctttgggaaaactttggtatgcttagctgatttcttgaaatacaatctttctctcatgcaatttcctctcattcagtacgtgaagaataaaatgttgacaggttaaactgcaagacaatctaagttgctgtttatttttgtctgttagccaaatcttaactcactattcatagccacacagggtgtttttttttggttggtttttttttttttttggtttcagtttgtttctcctaaatacattttaaagataattagttattgcctgtattagaatttctttttgtgttcttgtgttaggattctggaagtagcaatgaattcacaggagaactcaacaatgtaagagcaagatgtttccaccacttactgagttgagggtataagattttatcctttgccagcccctttagaaattgtgactgtgaactgccatgatttaacttcaaaacacagcctgttctcttgtcagtggagccaaagcgttatgcctgaacaacgattataggttagtatagacaagtgaaaaagagttttattttgctggattctgatactacacatacttaggttcagctaaatatcaaaatcgccacagccaagatgtagtcattgatgaggactttaattctacccaatgtctgatcaatgtttcattccatagaaacatagatgtttcaatccagaaaagcctttctattttttaaaccacagattgaggaggcaatgagatggaaatactaccctgaacttagttctaactatctagaaaaattttttattgaagtagaattgactaaaaccttgggcgggagtaaccatgatagtattgtttggtaacttcaaaagaaagaaaagttggacataaccaaatagtagtggtgattttaggaaaatatatttcaaaggaaaaaaacatagatttttcaatatatagagggatttttcaacatatagagacttgaaaagagtacaaaaaaataaaaagaagaaaggaaatagagaaataaaaagaaagtttctgacagcaaaatcatcttttgagggaatgaggaaaaagaaagaaccttttttttttttttttgagacagagtctcactctgtcacccaggctggagtgcagtggtgcaatctcggcccactgcaacctccacctcctgggttcaagcgattctcctggcttagcctctggagtagctgggactacaggtgcccaccaccatgtctggctaatttttgtattttttggtagagagagtttcaccatgttggccaggctggtctcgaactcctgacctcaggtgatctgcccgccttagtctcccaaagtgctgggattacaggcatgagccaccgcgcctggcccaggaaccattttaagatcaaggaatttttgatgggcttggatattaagagaacatgtatagaagattgaaagacaagcacatgatcagggacaaattcagaagagtggcgtaaaccggtaagaaaatatctgcaaagcacaagttcatactgagctgaagctgaagagaatgttaaagacaacaagaaagctctctttaaagctatgttcataacaagaaaaacaagtaaaggctaagctcgttgcttggggcagatggaataatgttaaaatatgacgaaaaacagacctactcaactatttggcttctctttctctattaaagacaatgatgttcaaactggaatgtgtaacataaacatagttaaggataaactgaagcatgcacgatagataatgataataatagttgtgactacaatttcctgagtttctattcaggactgagtactgtaaaagagaatttagttgctttttaaagtacttactggcaggcgtgcgcggtagatattactgttatcaatcccatttacagatgagaaaaccgaggcacaggaagatttaatgacaaacctgaagttacacagtcggtaaatgatgggctgggattcagatcaaggtctgactaacttcaaagcctggctcttttcactggactccctgattcccatgcctgtcacatctagtgttttcaacaggattgcatttttttggtttaaattatattgtaaggcacataaacaaacacatgccagtagatgttattgaagagccacagtgtgtaattgctgtgaaacaaggaaaatggaatatcaaaatgataaacaacacataaagacgttcttgattaccttttttttttttttgagacagagtctcttccttctgttgcccaggctggagtgcagtggtgtgatcttggctcactgcaacccctgcctcctaggttcaagtgattctcatatctcagcctcagcctcctgcatagctgggattacaggcacatgccaccatgcccagctatttttttttttttttgtatttttagtagagacacggttttgctatattggccaggctggtctcgaactcctgacttcaagtaatccacccgcctcagcctcccaaagtgctgggattacaagtgtgagccaccgtgcccagcctcttggttacttttttttaaaggttctctttgaaccatctagagcaaagccatcaaagagactgctgggatcatgtcagaatgattcagaagccaacctgaggggatcccccagagggcaaagatgagacagtttgagcatcaaaaggattgaaatatataaaaatatataaaagtccatgagtttatgacaaaattctaaagacacaagacaataagacaaaaaaatcccgcatttgtcacttctgagattgttagggcaccaagtcattgttctgaaaatggatttaaaaaggagatctcacatccacccctgctttcctatttactttatagagaattacagctaataaatgcagaagggtgctagaaaagttttaaaaacctacagttttgtagcatctaatgaagtaatggagctaagcaacaaccattaatgaatgataaaatcaggtaaaattggtgctttctaacagagaatcaggctgacaacacttgaacccacggatcagtctccatatcactaaaagtggaacagccgaacgttagttatgctcctccaatgtgatctgatagaaaagaaacagcaccacctgtgaagtattcttacccacatcccctccctcaacgaggctgaaccagaagctcatcaaacatgcacatctaactattaataccaggttataggaaatacgggagacagaggaacatgctaaacaccactacaagggtacagatcagccaatgcctgaatgtaggaagttctacaaaacaaatgacccatttttgttttcagtatataaatgctacgagaaaaaagtagagatggggaactgttaagtactgtaaactagttcaaccattgtggaaatcagtgtggcgattcctcagggatctagaactagaaataccatttgacccagccatcccattactgggtatatacccaaaggattataaatcatgctgctataaagacacatgcacacgtatgtttatagcggcactattcacaatagcaaagacttggaaccaacccaaatatccaacaatgatagactggattaagaaaatgtggcacatatacaccatggaatactatgcagccataaaaatgatgagttcatgtcctttgtagggacatggatgaaactggaaaccagcattctcagcaaactatcgcaaggacaaaaaaccaaacactgcatgttctcactcataggtgggaattgaacaatgagaacacatggacacaggaaggggaacatcacacaccggggactgttgtggggttgggggaggggggagggatagcattaggagatacacttaatgctaaatgaggagttaatgggtgcagcacaccaacatggcacatgtaaacatatgtaacaaacctgcacattgtgcacatgtaccttaaaacttaaagtataattaaaaaaaacaaaaagacttaagggtgggagatggagcctgcagtgagctgagatcacgccactgcactccaacctgggcaacagcgagactccgtctcaggaaaaaaaaaaaaaaaagacttaagggacctgtaaaccaaatgcaggtatgaatcttgtttggaacttgatttgaacaactgactaactaaaaaaatgcctttttttttaaacaggcaaaaataaaacatactctgtttattacatgttactaaggaattactggtaattttattgagttggtggtattgtgagttttaaaagtccttatctatttagaagcacttattaatgaattaatatgaggcctaagactctttaaaaaatactccttcaaaagaaaaaaagtatgtgtatagggaaatacgtgaaatcagaatggtaaaatataataattgttgaagcttggtgataggtttttgggggttctttacactttcctctactttgttatgtatggaaaattcacataataaaaacagtcaagtgttctatttgagaggcagaattttggcagaaggcctgggttataacccaatttgtatagcctggggagagtcactgctactccctccttttttgcctctttcctttcctttttactttccttctatttcttaagaaatcatttgctgggccacattttcccccagggactgtcctggtaccatcagccttccaagttacaggtataggtattattattattattattattattattattattattattattattttacagatgaggaaatcaaagcagagaagggactaagtttctcacccacaaatccaggtctgcctgtgtccaaaatctgagctcttttgttttattttatgctggctcccaggagtagtcctctgattttataatttttaagtttttttatttttaattttgtttatggataaattttaaacaatgagtaaattaagatagatcaagtggagtagcatttgtgttttttgcatgtgagaaagatgcaaggtatggttgttactgtaacaattacaaagatttcatcaaaggcaagcagtgataaaagcaaaatgtgtggcaactttcttcatattcagaaaagagtaaaagcctataaattgtaactttaagccataaaataacatttatttatgcttgttcttcaaaagcttatatttgataatcttttttgttagaagtcgaagcctgagaaaaatggctaatttcatttttcatgtgtttgtaaaatatttttaggactatcacaagaaattccctaaaaatgtcaaagcaaatgaacaagtgaaattctgcacatcccttgtgccactattttgtttacttactgaaaaaatgacattggcttttgtaaaacctgggtgtgctggtgggcatgtgcagatgtgtcgctgtcatctgtcatgtgtcatgctctggatgtcagaaccagacatcagtcagggaagagagtgagtagcaagccacctcgccaaactcttgctgcagggtgcacggggttcacatcctctgcttagatttagtgcgactttccaaaacacctgcagtgcggtacttcatggctggtcccacgtaacaatttatgccctagagatgtctgactagatcttaggaaattatactaatggttctgacgttgtttccttcaagaatcgaggcgctaaatatagtcaagctgaatgacaaaattttactcacactcagggcatgtcagtgagggcatcaaaaatggaaaaataataaatactgctgatatttactaagttttatggtatgacaggcactgcactaagtcttttgaatatctaatcatgtttaactctcaatgtcccattttatagctgaggtggccgcagcacagagaggttaagtgagttgcccaaggttgcacggttaataaatggcagagctgggctctaaacccaggccgtctgacccctgagcctttcctcttctaaccactgtgcagtctccaagcaccagcagaatgaagtgagcacgtgctaatccacagctgtcatggtttggccctctgtgggctttcagagcaccttaaaaccctttgttctgtgtcagagctgtttttcagctttgcagatgtctgaagtcaagcagaagagatggagagtctgataaagcacacgtggcaaatctctggccgagttgatattagaacacagagtcccagagtgatttactgtccagggggaaagccagttggcctggctaccttgcaagacggttaaaggacataagaatagatattcattcaagactgtcagaaagaaagtaggtcagcaatgaaataaaaacaaatgtcaaagaaacaccactttggtataaataaaaagtcgattcttcttaataaagagctgtctgttcttcattaattagaaaagtacagagcctgcttactttgagattccaaaacctcttcaggcacaactcgttattaatttgatcactttcctcaaaagaatgatattttgacaaatacagtttctggcttcagtcacatatagaaacattggaataagtacaatgttgtgttttgcttttttttttaaaataggaactatgtttgataatgcatatactccaaacacctctaaaaataattttcaattggcaagctattttttggtgtattttcctagtctgggagaggaagttttatcatttaatttgataaacttagtacctttgagagaaaggaggagaaaattttaccatcttatgtggttgaaatatgctttagtatttacataattgaaaatgattcaaactgatttcctctgacgaacatccgaaatgaaaataaaaattgtgtctactccaaagggtagtggcttgagtcacccactggtatgtgtgacctatgagtcactcactggtatgcgtcttcccgatcccctggcctatgggttagaagtcaaagatgctccactggggcttcctttgtagcttcttttccccttcagtattcaaccacagctactgctggcagctcctggcagaacaggaatgggagaccaaggagaggatatgtggaagctgagtgatttatttataggggacttttggcaaatgaaagaaaatagatgtgaagtcttagcagttccagcatgttcatcagaaatgcaagctcatgatagtcatttcaaagggaattgtggaagaatggtgttaccctacttcacaggccattaaatcatatatatgtttggttgccagtgagaatctgagtagcagagcagacaagaataaggacgtatgggatcgaggcctgtagcttgtgaccatgaacaagtcacgtgaccctttggccttaaattcaccataaagtcgtgtacttgatctcagtgattgtatcttacttcatcaaaatggtatgattctaaattcctgtgggatatacaggtaagacaggactggtggagcattaggtttggtttttcctttaaaagaaagtgttggggaggcagcagggaatagcaaaggtcacagactcaaaagcattaactgccgggcctatgaagacacgaatgatgtaggtttgatataatggaggtacaaatccatgttttatgcaaaacctcatatttctaaactttggcaattcattcatgtttatcaaatcactgttttaggccccctttggctggccagtgggccctctgctttagacttctggaataaactccacagttgagagatgaaggacagacctggattctaacagacctaaatttgaaccttagctctgccctctaaggaatgtgtaaacgtatacatctgtatttaacttctcaaagcttcaagtttctttatctgtagaaatgagaatgataatacctcttttgtaggatttcctgaagactgcgggtactatgtattaagtatacatagtaggcacatcctcaaagggaattccattaccttttctatggaggtagatcctgtataatttttaaatttttgtcttgatggccagttgctcacagtttttaaaagtgtagtagatgccagcgcttctttatagattctgaaatcccttcaatttacattttagttgttttaaaataaagatttctttaagagacaacattcagagggataagttttctacttgccagtagaggtagaaggcagtaaaaccaaatagatctgtcagttactgtcttgaggtagagcccctaaagcaataaaacccacctttgacaatgaggaaacacgagacatcattttctccttaggacaaaagtctagtgagtaatggcccttctgtgactaatggtaattctgtactttattcccatagaaaatctaattttgaaaacatttgctgcatgccctactatgtactaggcactatgccaggggaataatgtaaagatgaccaaaacataatggaattgttgcctacaagtatgtttcggctatttaaggatttatattgcagtttgtgcaaattgtgtatgagtccactttgagaggttatacatatcttccaataatgttgctattgctcaaaatatctttgaagtctctctttggaatttacttttagagcccttagcacattctgctgaagattttttttttttttttttttttttaccctagtggtatttattcttagaaggtggatttgatgtcagggactggccaagagttgttcatcactaagtcagcctcatgggtggtggttaaactggctagagtaatttttcgttaaaaacgagccaggactgtaaagtagtatgacagggtttttttttttttttttttttttttaatatcacatcaactgattgtagagaaaaagatagttccaaaaaggcattctgcacattttttgccccaaaccagtatcactggaatatatttgtagctccctaacaggctaactttgaaataagtggtgctcacatgtgcatgtgttgtagtacgtctgctgaaccttgtacttaacctcttagcaaactcagtgtctttgttttttcctttgaaatgttgttttttcaagttcagggatagattttctccaagaaaatgaaacaaataagatccactctcaaaggaccttaatggaaagaaatacatgcttataccaagttctttaaaactatccaaactggaaaggattgcctcatagctgactgtgattattctgccatgatttagggacagataatttcctatcagcatgtttaacatgagaattaaagagttctgtagtgtggcctattgacctcatttgttcattccacaaacatcttttggagtccactgtatggcaggcattatcacttaccatggtgaggatggtgaggccatgagcatgcttcacctaaggaagcctgatcttcaagaatgcaaactcactcaacaagaaacttgagagtaattaatagtagtgttggtaattatcctgtcttttccttgtaggattatttggaggttgtgaagtggtaagtctctttattgcatttgaaatatggctcatctcatgaccattggaatgtgtgtacgctctggaggaaacccatctctgccatgtcacctgtattagtctgttcttatgctgctatgaagaaatacccaacactgggtaatttctaaaggaaagagatttaattgactcacagtttctcaggctggggaggcctcgggaattatggtggaaggcacctcttcacaaggtggcaggagagagaatgagtacccagcgaagggagaaacctcttataaaaccatcagatctcgtgagaactcactcactattacgagaacaggatggaggaaaccatcctcatgattcagttatctccaccttgtccctctcatgacacgtggggattatgggagctacaattcaagatgagatttgggtggggacacagccaacccgtatcaacacctgaccacagtgtgtgtggtctctgaggcccagtggtggctctcagagcacctccttagcaaatgtaccactggacccttgttagaatgatgttcttgattttttaaaatttatttttgtctcttgactattcttgattcaggaatgttcttgattttaaagggagggtgtgaggtagttgttgtctagttgtctagatatcctccacctgagaacgctgtctggtgtcatagaaacagcaatggcattgggatcaaaagacaaactttccagccccagctctgcctctctttagcagtctcctgacctatacaaggttcagttttcccaccatttaagggaaaccaataccactgttttattcacagcactcttgtgggaatcacaggagacagggcacgggagagcctttggggaactgtggatgttagtccctgtcgtcatcagcctttccatagtggagcctgggctactctgaaatagaagcacctctccttcctttggacccctggagcactgtgttctacagttcttagctctttttctgtgtgcattatttgtatgtcttatccttggtggtcaaccacttcaaggtgagagactggggtggtggttccttttttttattttttaatctcccctgccccatctttctctttcccacttcctatgttgactgacaaaatcttcgtatttcccagagtaccagagtttttctgtgagaggctaggtcagtgtttctccccaagcagaggctaagaagtacctgatgcagtcatttattttcagaatgtgtgtagcttgcctccagcggattgcctgggaagctggagatgtgcttcaggggaaaggtggtccatccacttttcctgaacaggctgtgcatgcagccttgacatagccaactctgcaggagcatgaaagaactgaagatacagtattcgacttccagtatttctaatcactttagagacaggatgacgattggtttagaagagccaggggatgactaaggagcacatgtaaaacaataatgttcagtatagactttagtttctgatttgaaacattttctaaaaaatcatgtatctttaaaaaattggaagcagctcagtgtttgctggagatgaggcatagagtgtggtggaagggagggatgacaaaggggcaggcagagactttgagggatgaggggtgtgcacatcaccttgctggtggggactgtttcatggttggatacatgtgtgaaagcatatcaaattgcatgctttaaatatgtgcagtttcctgtgtatcaagtatacctcaataaagtagttaaaaatggtatacctttattatgctgaaagaagggaaaatttggaaaggagatgtttttctgtagaagatagcttctagaaaggaaaatcaaacacagtctaagttattctctgttttgttctcctccctccacagatgtcttgttgttttgggtcctcttatctaaaatttcacaatatgtgaaagtagcctgaactctaaaggtagtagttgtggttttgggaaactgtgtgttcgtactgcctctgtaaatggaacacaagcctctcctaccctctggggagcttgtcacttagtacagttttttaggaactcctaagaagtttaagttctggccacaggtcccagagttaaggatgttgtcaactctgctactcatttgaaaaatgtcttgtggaacctatagccgcagaaagagctttgtttctctgggtgaaaacaacatacattatcatttctaataactttaatggatgctgctgctttcttctttttggcccccaagatactcagagataaacttgaaactcaactataggtggggggagggggaagggatagctttaggaaatatacctaatgctaaatgacgagttaatgggtgtagcacaccagcatggcacatgtatacatatgtaactaacctgcacattgtgcacatgtaccctaaaacttaaagtattatgataataataaaaaaaaaagaaactcaactaaagcatggtctgcatacttgtgtgtatattttcgctggtctcaaatttctatttatttatagttttctggcttacagtctatatttgtgtaatatttatatggttttatatggttcttgatggaaatcccctaaaatccttttcgtagcgagtcagagaatgaaatctgtggtttaatccactggcttttctttaggcaagagacagctgtgctagaagaatggaggattataataaatttgaaaaaccagaacagttcttcaggtaagcatgatctgtactcctgaccttaggaattgactctaggtcccagattttgaatttcttatgagcataatcatctacttaaaaaaatcacttaattaacagtgattattgagtatctgcatctcctccaagaaataaaatgccatatacatgacacacacacacacacacacacacacactcttgatagtcctacagatgactaatcactccccaccccccgacttcctgccttttcattcatacattggggttgggatctctgctaccacaggagctgttgcagagaaaaagatttttaaaatactatattatgtaaattagtacaaccattatggaaaacagtatggaatttcttcaaaaaactaaaaatggaactatcgtatgatcaagcaatctcactactgagtatatatccaaagaaattgaaattggtatatcgaagagatagctgcactgccatgttcattgcagcatcattcataatagccaagatagagaatcaacccaagtgtccattaatggatgaagggataaagaaaatgtggtgcatatacacacaatggaatactattcagccttgaaaaaaaggaaggaaaccctgtcatttgagacaacatgggcaaacctggcagatgttacgttaagttaaataagccaataacagaaggacaaatactgtgtgatttcacttgcacgtggaatctaaaagagttaaactcatagaaacagagagtagaatggtggttaccagggctgggggttggggtggagggcaggtggaggtgaagttagtcaaatgtacaaaatctcagagaggagaaataagttttgagatctattgtacagcatggcaactgtagtagttaataataatgtttacttcaaaattgctgagtaaatccaaatgttcacaccacaaaaatataagtacacgaggtgatggatatgttagttagttgagttagctagctaactaaccataggtataagcataggtataagcatataaaaataccacattttatcccctaaatagatacaattattatttatcagtaagaaataataatataacataaatactatattgtttcaaaatagagggaagaaaacatgcaaatagtcctaatggattttttttttttttttttttagtctccaggctggcttccagacaaggctgtatggtggcccagactggttgaattttttcacttaactttttgttgatctgccttaatttccaataactagagattctgataagaactttaagaataggaatacttctgagaatcttaagatgttattagccatatataagtaaccatacattttataaaagcatttttctcttcacaatagctggaagtggaacatcctagagaataactcatttttgaaaaatagaatgtcttaggggagaactggcctgctaagtattacaggggaggactcaggacaaaatcaagttatcagatacctggggcttagaaagcaaggagttagaaggtagaagaggcttacagaaaggaggaaagaagatgctggagaccctctttcatctattatagaacattttctatggctggcctgtattcagagaaggatacctatcttgctgctttctgcaccaaatagttccaagatccaaaattcaagctagtgctcttagtgaatagtttggttatattacgggttaaatgggttttcctataaagctagccaccatttatggtatttagatctaccacttaggaagatttcagtcatattcatgattttcaggttgtcctctctcagaaccctggtgtcataaactgtaatagttgtaggaattgttgtagtggatatagcagtaatattttctatggaaaaatatagaagttaatatatgccaggtactgtttcagttatggacactcatttaaatatatgaagtagatgctattataatccccaattacagacgaggaaactgagagacagaaaagttagataacctcccaaggtcatgtagctactaagtagcaaagccttgatttgaacctgcactctctagatcccatttaggctcttaactgctatactgtcttaactggattgaggttttccataaaattaaagtttcccctgaatccacagaaaatgttaacaatatatagaattttctggatttaatttttttctgtctcaaatctttgtatctaggatcacagataactgaagattgaacaagttgcaaatttcttaatagtcacatatgtatcattatatactcagagtttagccagataacccaccataaattgctaatgaagcttaataatttatagtgaaaaaacaaaaatagaattgcaaaccataagcaactcaagacgtgcacgggggattatgcatccttcccccagtttacagaaattgcaaccatcagcatatgcgttccacatcagtgccaggcattgtgtggcaatcagacttcttatctagaaactctagaaatgtactacttttagtaatcctaaataacttacttaataagctatattacttaagctatattatgcacaaatataaagctagaaaacaaaaggtgaacttggacttcctctatcctttataaaaatggaaggacctgtgctttgctggattggtttgctgttcaggtggaaacccctcgtggtccattcagtgggctgtgggcgatagtttgagaatcctgctttaaaggaagaatacagttcatacattttattaaagacagtctgctaaagtgatggagctggaattttctcagtgagagcactgtataacagggttttctgttttccttttttcataacaaatagtacttctcacttaaaaacaattgttccttacaatgatgtctgggatttgcttcaaaataatcctgtgggtaaagagttgggaatgagttggggaataggtggaagaagtgggatgaggggcagataattgtcaaagcaagtgacatggggcttcatgatactgttttctctacttttctatatctttgaaaataaaaagttaacagcaacaacaaaaaccttccttgactactatcctacctacttcatttctctgctcttgttcacagcagagcttctaaaaggaactctctgtatatctcatttgtacatcctcatcctccattatttaagcaacccattcacttggctgtcctccccaccagccaactgaaattacctttttaagggtccccaccaatcaccatcttgccatatggggtggttaattctctcttatgttacttgactttcagcagcatttgatgcaataggtcactttttgtttcttggagcattttcttttattggctcatgtgcacccacatgttctcatttcttctgcatcttgctggtttccaacagctgacctctagctgttggaaagcctccaatgcttcatccttgggtttctctgtactctttctgagtaatctcattgggtcccattgctttaaataccttctggttgctaacttaacatctgtagccctgacttccagacttgaatctgagaggcatctcaaatttaatgtatccaaatcataactcttaatcccagccttactttcttcctttcttcctcacctcttggtacccccatctcagtaaataacactgttatatatctggctgctagagccccgaaccttaggcatcacccttgattgctctttttccctcatatcccacatccagcctatcactatgacctattgtcatatctccaaatttacctgaattcatctactttcctctcctctcctgctaccatcccagtccgaacctctgacatctctcactggacttccatatcacctcctaatccatctctgcctctgtgtttgcccctggcagtccatggagagaccagccagagtggtctctttaaactgaagtgccactcccccacttaaactcacccattggcatcccatagcacttagaaggaaagccgaactcctttgtgatgtacctgctgcctatgtctgccccaccctgccaggactcactactgctgtcacacagatcccttttctgttcttcaaatataccaagtgggagtcttacctcaaagcctttgcagttctcttctctctccctgctatacagatcaccataaggctggcttcctcttactacctaggtttcgtcttaagtcacctccctagagaggtttgacctgaccaccctatgtaaagtattcatataaccccaggccacactctatctcatagcccattttattttaatttatgtaaagcatttgtgtttatgtattatttttttgcccctacctataaagtccagaagagcagctaccttgtttgtcttgttcagtgctgtatccctggcacctagaacaatgtctggaacatatagaaggttaatgtttattgcatgaataaacaaatgaattactttgtttgtgatttaggatcaaggaacttttccccaaaggcgaatctgtgcagttttatcccacgcttcttccccatccctaagttcctgctcatctggactgtgtgcttgcaaactgtgtaaagacttgttcaacattcttaaataggttaaagaagtactgcactttgggctctttgtcattttcaagtcacattctatcctgggcaccatccggaggggtcttgtccagtttcctagtttctcagaaaggaatatttcatggctgctcgcacgtcctcttcccttacagtatttggactttacaccactcattggcagagccaaggcctaccccatctgagcaaagagcaacagagatctgttggctccattcactcctttgctctaagactcacttgtttcttcttatcttttcccaactatttttagttgtcaaattgctcctttctttccctttcccatctatttttcttttcctgtggaaaacaacccatatatttctagtttagtcagattagctgctaggaaggccctttctcaagcttatttatataacgaaaagctatacccaaatcctaatttcatgtgacaattgagcagcctcttgtaaaatagctagaacaagggcaaggatattaatttggctcttggactgagacacactagggatgtcccagggatttgaacaatttctaatcttctcagaggagggcataaggaaattcctaaccaaggtgaaatcttttgtcacatcctagagtagataagtacttcaagaatcttctagactggggataagttggaactgctaaatattatctacttatctaatgcatgtaataatagctatctatgtctattttatcaagtagctgggaggataagtttggtttttttttcaaggacttttgagctttttcttcaggtaatatatcttaagggaacactttatataaagctaagccattgggaaattttttctgccatagccaacagttttgtaattaacattcctttgcatggtataaatacaaatctgttcttttgtcaggatcattctttatgaactaccatataaaagtcatctgggctgggcacgatggctcacacctgtaaacccagcaatttgggaggccaaggcaggtggatcacttgaggtcaggaattcaagaccagcctgggcaacatggtgaaaccctatctctactaaaaatacaaaaattggcagggcatggtggtgggcacttgtaatcccagctacttgagaggctgaggcaggagaatcacttgaacccaggaggcagagggtgcagtgagccgagatcacgccactgtactccagcagggtgacgagcaaaacggtgtcaaaaaaaaaaaaaaaagccatctggataatacatattctttattagtattaagtatttacttttagatcaatgaaaacatttctatggggctagacttttccttgtcaagattataatttttcttatgagtttttacctgaaacccctattttctaagaccccatggttaatgagtctctttgacattaatcatttcaattttgctggttctgatgaccctgtgctatctattagagctctaaccctttgcaaacctctcttctgcccttgtcagtgtctcacgtgctcacgtgcatcttaggctggatatcacgtggcacatcctggtaccacctctgctgctttcactggccactgttgcatctgtttggtgcagctgcttcctccactgggaccaacccctcctcttccttacaaatattcggaggtggggaaaatggaaatgctatcattagaacatctggcatcagaatttgctttatgaagaaaataatcttgggggaaaacactttgatgagtgcttgcggaagaaaaggaaaccccaaaggcctgggtattgggagagctgctttgtgtaagccaagggcaagcatttactggttgctttgagagtgaggggaacacatgagagaaagaaagagaggggagggtggaagaatggcaggcatcaactaaatggcataaaattgtggggagggtcttgatgcacctgttcctcatggtctccagacttttctgtgaagtacagcatgtagtgtggagtggatttcagggggtgaacttggagatgcgttcattcacatcacagtcagtgcaggtagtgtagagacaacagtcatgggaaagggagcccaggaatgaaggaggccctgagaacatcatccctcaccaaaatgttaagacgggttttgggtttccagaagctatagagttggtggcagtttgagccaattttttcctacatcttgaagggcaataagaatcccacataatgtctgggccacatcttggtggtacctggtataactttgccaaaagaattttaaaaccaccgcaataggtaactcaactgctggtactgtattttatgtgtgcttggtatgtttatatgtctttaattctattacaatttttttattgcacaaagaacattataacaatgcataattatatatcaatagcaatattaaaaataaagacaaaaggacacattcagccaaatgtgccttcagtgtctggcaggcaagtatggcgtagaaagggcaataagaggcagttcctgcctttagggggcttccaggatcgagcctgcagtcccagcaccctattgaatcaactgtttctgtttttccattttagttgtgtcactcaggctttgggtgatttattaagagaaccaataagattttgctcaagattggaaacaatctctttccacatcatttaagcctcagttgaagcttcattttcctccttcagcttcacctgagactccttctggcaaaatcccgctgctcctccttgatcctgtagttttctctgttttaacccttggaacatgatttataattcgtgggatgactttttcttttttcccaggaaatgatacctttcttgaaggcaggaaactgtgttttgtctgtattttgtgaatccccacaaatatttgctggatgaatgttcttggggacactgccctagatatagtagaagcagaagtatttctcggtttttgtgtttttttctggaatgaagggtaaggtgaagggttatagacagaaataagactgattgagtcataattgcacctttgtcagtcactcttgtaagaattttacatatgttacacttcactcagtccttataacaaccctatgagatagcaattatcagctcctccctcctctccattttaatcatgacctctcagaaacagagaggtcaagtgacttactcaaagtcacagctagtaggtggcagttagatctgaactcaaataggctccagagactgggctcttgaccattattcttcctttccaaggttggaagagactgagagacctcagctcctgaacacctggaactgccaagccacagctgttactattactgtactgttactaaagagccaaaccaaaccacatggctggctcctttggcaagaacttcccctccagatgtgcctctacttagcactctgatagtgagcacaggtgagtccgaggaaagcaggccaagaagtgctgatgagtttctctctgaggcccagggatacccagccatgccaacaaccagccctcccatgccagtccacgccctgtagcctggctctcttactgctttaggagccctgggctctcttacacctgtgtggaagagggagggactcccaggaacataattaggagtgggggaagggaggagaagaagggagggaagagggggaggggagaaaggacatgcatttctaccagggtaactttggtttccttatattaatataagggacttgaactgtgttattctttctcaaattgggatttaaggccccaaggaatccaaaaattctatgagaactaggtatttttatgtaaatgattaactaaaacaacgaatgtaaccttattctggatcatcttccaatggagtcctgcctcttgattttactttctgaggttatgtttgtgactgtgatgcatgcaaatctcagtcacctacagtggccacattcagacaatttgaaatgcattttatattgtaacccagcacacacacacatgtaaatagaaatgcaccaggagtttcctaaagtattgctcaccctttctgcatagggagtaccctcttgtcacctctcttctattcccaggtagtcatgacccactatcagattacaaccttcaataaaaagatcatagcatgtaactgtaagcatgatcagtctgccgttttcttttgcagtggaaatgttccattgaaagacattttatagaatacatctttaccaccctaagttgtttaacaaactgaatctttgacttgagatcatgagaacaaaataaagatatgaaataatgactgttttattctgaattgctgaaaaaatacccagatagtttaaagctgtaaatcagaacagggcaaatcagagtctcattgctgtaggggtatagacagaaataagactgatagagtagtaattgcagctatacaattattttcatcaaaacaacctatatcaaagtagccgtgttatttactttgtaagcagatatagtgcatggatctcatctctgaatatgccagcttaaaattcattagcagaaaatgtggtaagtgtaccatgatgacttactttttcattaacttaacatttgggatacactgtattagggttctccagaggaacagacttgatagtagatagatgatatgatattaatagatagattgacacagagagagtaacagataggtagataaatatagatatgaaatttattgtaggtattggctcacataattttcgaggctgagaagttgtgtacaagatgcagaatcaggaaagctggtggtgtaattcagtatgtgtgtgtgtcggggtagggactgggggtgtatagggtggatatagtatacgtcccagtcagtgttggaatgtccaagaagagtgctgttgcccaaatgcaggagaggatggatgttccagctcaagaagagagaaaattcacccttccttgcttttttgttctatttgggccctctacagactggatggtacccacctacattggcaagtgatatggtttgattctgtgtctccatccaaatctcatctcgaattgtaatccccatgtgttagggagggacctggtgggagatgactggatcatggggacggttcccccatgttgttcttgtgataatgagtgagttctcacaagatctgatggtttaaaagtatggcacttactcctgctctctctctctctctctctggccactatggaagatctgccccttgcttcccctttgccttctgccatgattgtaagtttcctgacatgcatactgtgagtcaattaaacctcttttcttcataacttacccagtctcaggtagtatctttatagctgtgtgagaatggactaatacagtgagggtgatctttactcaatctgttgattcaaatgctactctcttatgaaaatacccttacagacacatccgaaaataatgtttcgccagctatctgggcaccccttaagcccagtcaagttgacacacaaaattaaccatcacatacactattaaagtggctgaatcatttattctggattagggtgattttatcattgtggtggtagttaatacacttttctgtttgctatatttcctgtaagctagtcgttgaatctagaggcttgattagattcaggttaaatatttcaggcaagaatatcttttattggtggtgctgtagactttcaaccataccacatcaggaggtacataaagcctgtcagtcccatgtgtaatgatcatagattgattggaggttttgacattttcaccttgatctttccattataaagttccttatcaacctttcacaatggtttaatgtttattgataactgccaaattccagtacttcatgaggtggaagcaaaatggtagtttcctaattcctacattcttctgcatttattagctggtattgatctctgaagaactttccctccttaactatttgattggccttagatgtagttcttaggccctattttattttatttttatctatttttttgagacgcagtctcactgtgttgcccaggctggagtgcagtggtatgatctcagctcactgcaacctccacctcctgggttcaagtgattctccagcgtcagcctcctgagtagctgggattacaagcacccgccactatgcctggctaatttttgtatttttagtagaaatggagtttcactatgttggccaggctggtcttgaactcctgacctcaggtgatccgcctgcctcagcctcccaaagtgctgggattccaggcatgagccacagtgcctggcctttaaaaaatgtttatttaaatagttttgggggtacaggtggtttttggttacatggataagttctttagtggtgatttctgagattttagtgcacccgtcacttgagcagggtacactgtatccagtatgttgtcttttatacctcaccccctcccatccggccacaacaagtccccaaagtccattacatcattcttctgaatcctcatagcttagctcccacttataagtgagaacatacaatatttgttttccattcttgagttacttcacttagaataatggcctccagctccatccaagttgccacaaaagacattatttcattcctttttatggctgagtggtattccatggcatatatacaccgtgttttctttatccattcgttggttgatggccacttaggctggttccctatctttgcacttgtgaattgtgctgctgtaaacatgcatgtgcatgtgtctttttcatatgacttcttttcctctgggtaggaacccagtagtgggattgctggattgaatggtacttctacttttagttctttaaggaatctctatacgttttccatagtggttttactaatttacattcccaccagcagggtaaaagtgtttccttttaaccacatccatgcccacatctattgttttttgacgttataattatgtcttaggctgtattttaaatcagggctctctgagcttgatctcatgtcagccatcatcatatcagtgtgaaaacagactagaaccaggtatcagtgatgcagcagccaggagaatttctgggccaggggccaggccacaagctgcatatcccaatggccaactggtcatggctacttcctttttctcatctagtgcaagctcaagaggtgtgggatgggacaatattccactgttctgcaggtaaatgtatctttgtggggcctctgaatgtcctcttcggtctgctagtctcctgacaaggggggaaaacactatccagaccttttctctgggaggccatttgttttcctgtaatctgtagaagaaaccaaggtacttttgtgggtgcagcatctcagttactgggggagcttctcagtgtgagctctgaatgcttcaggatgtcttccaatagccagcctttcctctgtgtaaaaggtttctctggagtaatggagatagcatgtgtgcaagtaggcaggagctccccttagtgtcagcttgagagcaaggaagggagaggagagctatgcctctgaaacaataccattttgcccccaatgccagttttatttcagagataaaatgccatgcttcagagccatcaatgataattgtttgagattgatgacctttggaagctgacagaatactaacttctgggagaagactagagtagatcaggatgatttcttggtatactctcagctgtttcccaccatgtgtttcctcttctttctgatatacagccaaaatacatttcccagtctgccttgcagttaagggaaactgaggtctcgtcaatggaatatgaatagagaaatgtgtaccacttccaggcctggcccatgaaaacctcccatatgctctctctctttcatcttccttttcccttcaggctggctggaggggaggcagctcctgggagagatttggaagttggcagagctgctattaagctgggttcctgaatgatggcaagaaagaggcccactcctctatcgtattcacctgccaagtattgtttgtgagcaagaaaaaaaatatctactgtagttgaggccatcttaaatacagtttctcttttaaagccattccacgtccaccatttggcattaagcgtctttaaaaaaaactgtgagtgccctgccttgccagtaagctgttagcaagtcttaactcgggagatctgtctctcctggcattctgagaagcagaagtctcaaattacttccagctgaaatggaaaagaaacaaaacaaaacagaaactcatctgtggtaggcagactaatgtccctcccaccgagatgttcatgcctgagtccttagaacctgcaaatatgttacctccatggcaaaggggactttgcaggtgtgattaagggtactgatcttgagattgggagattattctggattatctagatgggcccaacctaatcacaagaaaacattggaaaagggaggaaaagagtggatcagaccgatgcgatgtgatgatttgacccactgttgctgtctttgaagatggtggcaaggccttggagctaaggaatacagtctctagaagctggaataaacaaggcaatgcaatccccttagagcctccaaaagggagcacaggtctcagaactgttaagataataaatttgtactgtttgaagtcattaacatttgtggccatttgtcatggcagtagtagaaaactaatacaccatcccatacaaaacacttaaatgaaaaaaaaaatacatacatctgtagagtaggcacatctgtaggttcttaatgcctgtcatccttatctggaaacttgggtgtttaatgcattttggcaagagtgatgccagtgaggatgttccttggtagcttaaatatatccaggctattgcaatgatgcctgacattgaagggaaaatgcacacatttagtcagtcacatgtatgatttcaaatatctggattttggaattgtataaccaggtatataccagctacatctgaggggaaattttccgttttcatccagatgctctggtaagtgctgacatacccagactatgagagatttggatcaaactaaagaagtccccaagtctcaggagaacaatgaaatgtagtgcggggtgtctgccggagtcatggtgtactcatcagaatgagctgctgaacactgtggtcaggcccttggctagtgacaccattaagattttgtttccttctaaatcaccacccctcctctactgttgaaatgtggctgtttcatctctccattagagtccttccaatttacaccaagcaaaacagttggaaaataaaacttcatggccaggcagtgggtaggagtgagagggaggaggaaaggatgtagacacataattcagaatcaaacattgaatgaaggactcctcgattcagaccccatctcactttgcccatggactcagtgtctgaccttgcattaccctccctgatcttaacttcccagaactctgacagatgattaataatacctgctatacaaagggggtgagaactaataaatggtagttaaggatgatgagtaagccgagtataatagctactgctttcaagatttctcagaatccattagagtttctattgttttaatgactgtgatgagttcagtaagtcatttctgagttaggcaccacttatctttgtgtactgaatattcttaaagccacagttacttccttgctggggttataaagcaattctgaagaccaaatcatgttgcctttgtacatatccattgaggtttctctctcttactctacatggaaatcctgtaatacagatttcagccttacaccgagaaaatatatatttctgagtctttttttcttaatatatatgtgagaaaactctaaagtaagaataaatggaaaatcattagaagaagtatagaaattactttgaaagggtatatacagtctaattcatttatttttattttagaaatttgaatgaattatttcaataaatgtatataaaagattttacattacgttatactcagtttttctttttctttatttttttgagccagtcctccgagcctgtttcctcaactgcccttttctcctacccagtacatcgagctgttcagtgaaaaagaacagtgttttgtgtgtataaataaataaataaataaataaaaataaaaataaacagctaactaacgtaggaaaccctccttctccttccccaacaagttgcctgaagaaatatgtattagcaagactgctggaaatccacatttgttacatgaaattaggacattaaaactgtatcctgctgcttagtgcccagaccttgtaccccatgcagcagcctgcttgtcggccatggaacaatgtgtagcaaatgccttggtgatgacatatctgtcagagggaaagaaggagggcattgattatcataatgcggcatagagctcatttccttctgaaattacccagagatgcttggctgggcaaagtacagcaagtccctgaagggggctgtaatttctcaggcctgttgaaggaaagaagaacaatatgtgtgtgagttgctaagtctttagacgttggcagtggcagcaggctggtaatgagcagattaggtatttcaatatgtttctttgcctcgggaaatttaacaggtacacctgttttctttcagtggctgaaaatgtcagttaccatgagcctggtgtagttggcctttttgaaaaaacaagagaggtggccgggcgcagtggctcatgcctgtaatcccagcactttgggaggccgaggtgggcggatcaaaagatcaggagttcgagaccagcctggccaatatggtgaaacctgtctgtactaaaaatacaaaaaattagctgggcttggtggcgcatgcctgtagtcccagctactcaggaggctgaggcaggagaatcacttgaacccgggaggcagaggttgcagtgagctgagactgtgccactgtactctggcctaggcgacagagcgagactccatctcaaaaaaaaaaaaaaaaaaaaacaaaaaaaagaaaaaaaaggatggactgacacgtggtcagtctttgttcttctggtggcttggacattaacaaagtgttccctacccacttaagcttctcatctgcatctgcacatcagtggtcttcaaactttttttgttatatgccattgaaagaatgttttaaaaactgtgtaccatctcactgtttaaatctgacatctaaatatttccatcattttaaaaataaggagtagaagacattacatgtttcataaggtaaagattgatggtgtgtggaataaatattttgtgacatgatttgatgaactaggttttaatgaccttattgaataacatgttaaattggaaggaaatcagtaaaaagcttatatgtagactttatccagcacatcttgaaagatctgatgacttcagaaaacactgtggttatttaaagataatccacatcacttatatgtactactttgtcctgaactcagaactacccaggactggccaaccctactcttacagacttgcttgcaggacagggagagacagaaagtgctaaggcttcccccaaccagtatttggaatcatttagtgtagcacaccatattaagatttgagatatgagtggtgtgactttcttttgtagagtgggtgaaagaatattgttgatgcccaaaggctctcaggcagtttcagaattagtacatatggaaattgaggatgtagaaactcatttttgtgaaactgtccctgctctagtacctttgggaagtccatttgaagactgctggaatagatcatggactcaataaataccttttcataggagcacagagggatgaacaaggcagactgaaggagagaataggaatgctccccatgtcaggtgtgtggagggtgcaccaaggctcattctggtagaggtagaggagcttctcccaaagtagcaaactcagatcactcatggtctcagtccccttaattctttcaagctgctggatcaagaacgaggcagccagccctccagctgatgaccagagacatttattatctaccatgtgctaggcactgtcctaggtaccagagacatcctggtaatcaagacaaagttccacgtttgtgaagttggggatcagggaggtggagagacagagaaaataaacaaatctatgagaatctatgagaggtagagataaatgctatgatgcagatcacctgagtgatatgactggaatggcacctccagcttggctggtcagaagtggcttctcaaaggaagtagcagctaagctgagacctaaagccatccaaataaaaaccaatgagtacatccatcagtcagcaagtatttatcgggtgcctgctatgtgctaggcactgtttaggtacttggtttacattggaaaacaggcctggggatcttacattctaactgggtgagaaggggtctgacaggcaataagcattataaataagtaaattacctggtatgttagaagatggtaagtgttatgcaaaaaaaaaaaaaaaaaaaagtatagagcaggctaaggaacagaggtagcatgggggtagtgtgtgattttaattagggtgggtggggaggcccccattcagtgggtgtcctgggagtgaagacttgaatgaggtggaggagtgagctgtgtagaaggagctgtgtgaagggagagctcaggctttcgctctagctctccctcacacagcctgttctcatgctgctaataaagacatacctgagactggctaatttataaaggagaggtttaattgacttcacagttccacatggctggggaggcctcacaatcatggcagaaggcgaatgaggaacaaagtcatgttttaattgctggcaggcaaggagagcctgtgcaggggaactcccatttataaaaccattagatctctcgagacttattcactaccatgagaacagtatgggggaaaccgcccccatgattcagtgatctccaccgtggggattattacaattcaaggtgagatttgggtagggacacagcaacaccacatcagttctcattttattatcccatgagaacatccagctcccctttattgcagcactgtgcccacccagtttctcaaggaagccaatgagactagcagacattgtcaggtcacagtattttggagtgctctgcattgcctcttatcagtccagctctttgtggcttcagttgatacatttcagtccccaatcacctctgagtgagccaatgccgttgagtagctgcatgcactgagtactgcattgcttgcccaggtcacctctgaagatcccctgccttcctcagactgaccatgttcctaggaggtcggggaaagtagaccacagtggctcatctcaagcatagaatctttgtgaaggcttctttttattataaacatttttgtgaaatttgacttctttttttcttttttttgagattgagtttcactcttgttgctcaggctggagtgcaatggcgccttcttggctcacttcagcctccttctcccaggttcaagcgattctcctgcctcagccttctgagtagctgggattacaggcacacaccaccacacccagataattttgtatttttaatggaaacagagtttcaccttgttgaccaggctggtctcaaactcctgacctcaggtgatccacctgccttgctctcccaaagtgctgggattacaggtgtgagccactgtgcccagcctgaattttgacttctattcataatatattcatatgtgttttaatataaaatgtttatcatttaaatggattctccaggaaaatacaccaggtttattcttttgctgtgcatataattgtgctcagagagtagttctgcctcagtttgaggaacatcggtgttctggaagaaatcctggattgggggtaaagatatggggttctggccccatctttgccataaattagctgtgtgaccttgggcagatcatttaaacccattggtctccattttctttgatgtgaattgggtggcagtgactgatcagattagatcacaaaatcccttccttctgtcatgctataatgacatagagtcttgaatgccaggaccatgcctccccagtgcctgagtggttgtgcttcctagaccccaaggtccagtgtgtgccagtatggccttaccctctttactgcctcagagtcacagtaaggacttttctttataattgaatgaacacggaatgaatgggcatcttggcatagctggtttacacattattcttgtttcccttttctacatatatgaaaatgtgaactaaatccatagccctcccttggtggataaagacatgggcataatagttccatgaatttagcctctttttgtattcaacagtctcatcccttcccctcaacttgtgttctccttgatagaaatctaaccacttctacaagtggcagctaaagcattagtcttatataaccttctcgctcaacaactgaaaagttgtacaaaccttttaaagaatttaccatcagcaagggctgtgcttctaggcttgtccaaattgcgtgtaaagtacactctctaaattaaccagaccatattaactctgaaaacaagactcactcttcttaagctatgtctccagactgtaccaaattgtactttctcttgaagtaggacattctgtgccctgtttgaaagctggcgtgactaatgtagctggaattgctgatgagagaagacaggaagagaaagaaccgatgtgccttaagaatagggaatttcggctgggcacggtggctcacgcctgtaatcccagcactttgggagaccgaggcgggcggatcacctgaggtcgggagttcgagaccagcctgaccaacatggagaagccccatctctactaaaaatataaaaaaattagctgggcatggtggcgcatgcctgtaatctcagctacttgggaggctgaggcaggagaatcgcttgaaccctggaggcagaggttccggtgagccaagattgtaccattgcactccagcctgggcaacaagagcgcaaatcagtctcaaaaaaaaaaaaaaaaaaaaaaaaaaaaaaaaaaaaaaaagaatagggaatttcactaggccctttgcagaatgcagtatggctgatgtgtgtattatgacatggtaaatattactcctagcctccttgtgaaacgggctccatgtcatgcctcaaggccctactaagtcattgctagggctgagcctcaagcccagccccaacagtaggttcaacctggccttccctcccagcactatcactgcctgtctttcaacctatgctatacattgtgacaatcagttaactgaggtacaagtgtatttggatttatgccagactgagaatgagaaatattcagatcacacctggaaaatgcaatgcaaaactcccttgtcttgagctaaaaatctagaagcatttgcaagtgactaagtcccttagtttataggtatgagcctgtgataagttatctttagttgtttctggcttaaggggatgtcagtgacttttcccttagccccccctcctggaacagccggctgctggtggtctagttttttgaaagaagccctgaattctgaaacctcatgctggggttttgggttagtgtttgcattactgactgtggtttcatggcatgataatgcaaagtttaataagagcaggctgtctttgcctacagctagagttgcattgaggcatgactacttctagtgcctgctctgtgccagattcacagtgccttacagcccctccccagaactggggcagaggaggaagaaaaaagtgactctgtggttcaggggaaggagtaaagtttccaggctgtgtgataggacatttccctgatgcttggctttaggctcaggatggggacgttaatacattcagcagaggctggctacctatactggcaccattgaaggactctgccctggctcagtgctggttttgcttggtgatgcagtgtagtgtagcaggatgatcaccagctttaaagccagatcaacccaaatttgaatctcagcattagtcctcactctgctttgagacgtcgggcaagtgatttaatctcttgaaatctcagtttgttcatctgagtaacaggtggtaaaatacatacattgaaacgctgctaaaagattaagcaatgagaaggcaaaatggtacagcaactttgggagacagtttggcagtttcttatacaactaaacatactcttaccatatgatccagcaatccatctccttggtttttacccaaaggaattgaaaacttatgtccacacaaaaacctgcgcacacaaatgtttgtagcagctttattcataattgccaagactgggaagcaaccaagatgcccttcagtaactgagtggataaactgtggtatgtccatctgtatcttttattcagtgataaaagaaatgagctgtcaagccatgaaaagacatggaggaacattaaatacacgttgataagtgaaagaagccagtccaaaaggcggtatactgtatgacatctggaaaaggcaaaactatagagaaagtaaaaaagatcagtgattgccaggccttcggggaagggagtaagggatgagttgatgaagcataggggacttttagggcagtgaaactcttctatagtatctagaatactatattactctatcaatcatagaatgatactagagaacatactgtagtgatggacacatgtcgttgtgtatttgacaaacccttctttgtgttgtacacgaagaaggaaccctaatgtcagctatggactttagttagtaagtcttctaaaaagcttaaacaaggcaatgtgtataaactaactgactaactggcataaataaatagtggacttcaaaaaaaattcataatcctagcactttgggaggccgaggtgggtggatcaactgaggtcagaagttcaagaccagcctggccaacttggcaaaaccccatctctactaaaaaaatacaaaaaaaaaaaaaaattgtattctaagttccaggaatgtcatttagacatagtttcttttggggctagatgtatcaattttcattaaaggtgatattattatttaaaaatccagctggttgctaaatgagaattagctaccctttataaccagggattgtttcaaagaaatgtagttattttctcccctgtggcctatcttgtgcaaagttagtaatagtttgttgccaaatccaaggaaagcaaactctggctcaggcatgagatttatttttctcaccatgatttacaactggtgtaaaattcaggtctggacttggttagttataatgctatcgcaatataccgcatcttgagttgattttgccatatcctgtattgttatgtaaaatgctaactttaattgagaattgccccagtagaatatccttatttgtcctgcatgaagtttctcctcttttgtatcaattttttgtatggttcaaattagtgcgggaagaaaaggcaggaaatacaaatttaagggatatgtgttatatcataaaagaattgtatcacaaagcattaagacaatgcacagaaaactttgccaatagctgatagagcagaagggattgtataattaaataagaactaacacctattttgtaactggaaattgcattgtcagagtccctttccttttatcactagatgctaagaatctagccatgtaaaaactcccaaaacatccaaattcaaaaaaactggaatctaacgtggtaatgcagttgtcaagaacacgcaatagtctttgggcttttacaaagcactgaaaactaaatgttgcatttgtgcccttatcttccacaacttctttcttggcagcttttcttggctcacttcagacacacagaatttcaagtaatcagggaaagttgggacagaaacttcctctgtctttccatggccttttctttttcctttacggatctgtgatcctatgctttctctcacattcacattatatgtgtcagttggagaaatcttgatgcccagtttcatttgtttcttctgtcccacctgtaactaatttaggttgagttctccggctcatgtatcagagtgtgtatgacaaattatctcaaagcccagagggcctcggtggtccaagtcccagcaacaagggacacctgctgtcatgacatgggcttgacctgggttctgtggacattaaggaaccactgtcctgagaggggggtatggagctaagctaggggagggagcaggatgagcttagagctgccgaggaaacggaaagagtctataggctttaaaaaagaggagagaaagaaagaagaataaaagatgtttctggagactctgagaatagttaagagtccagggccagccagaatcaccctttcccccagctaccgagagtgccacagagcagaaattgacttggaagatattgctcctagaccaaaagtccaaattaaggggtataggcagttaagggcaagtgagggcagtagagatggttgtccgagtccagtggccatgagaggtttctcagctgcctgccaattctcttctgggacaatgccagccataaagtacaagccatgctttggtgtgggctgtagacatattgttttcccataactactgtcattcaaacaggatctagtttcttggcatgagcaaattgttcccgctgaatacacacactatgtccgctatggggcaaggcaaagcgaatcctccaaggaactggatggatttttcattctgagataagcagtttttttgtgggggcgggggaggtggagaggagccagcttcactctctgttcatgcgagttttgaatgaaatgagtaaagttcatgttccccccagagtacacaaggttcaagtgggattacccagtgggaatccagcccgattgtaatttaacttgttcgagggatctaaatatttaatctgccttcatcacgaatcctagaatcctatgtaagcagcaaaggccgagggtctgaaagtaaacactgcagttagaatcagaagtgttgcaactagcacaactgctgctgtgacgtcctacaaactttggagagtgccagaggaagctagcctgagagcacagaactggcagtcacgaggcctgcattctccagcttcgcctgccaccaactctctgagcctccaggcctcctttgtcaagtaaggacacaagcaaagcatctcagaagacaagtcattttcataactggaaatgagacagagccaacaaggatgcgtgaaaccagccacataaattgtgaaacctatgtgatcatgtatatgtacaatgttttcttaaaaaaaattaccattcctagatctaatatcaattttttgtatgattttgccccacattttgctcaaattatgcagtgtttgaaagagattctctgcagaggttggaatcacccccttgggtgctggtagcaatctgtgaaggtagctttttagatgtcacaatgattgggggtggggtgctggtgacattggatgggcaggtgcagaactgctaaacaatgctctgggcaatcccacaaagcgaccacctggcccatatctggcatgactttcatgtcccgccggacattcaaggaatccgactatgttttctatataaacatatagtatttttcacatctgaaaatatacactgaattttccaggactgtgtataaatagaggtaagattgtactttattttgctcagaactttaccaagagttattaataatctccaaaaaatcaaattatagcaaacactaatgatgtttgagtcactaagcaacacacctatatctgtctgcattgtgatatcacattcgtggttattctacaggtacaagaatctgagcctcccttgtcctttagtgcaatcaagcagagtatccacatactgaaatacacaacattttctgtaagctattttcttttcatttctcctttgtattacagttttcatgttatattaatttaaaaacatgggcaggttatatgatctatggattttataccagattagtagagtactataaaatgtttgttataaaaagtgtgttttatttgattgggttgaaaacttctgggccaggtaatcctaaagtctcttagcttttaaattttgtgagcctgtgagattatttagccaaatgccttcatttttactggtgagtaaactgaagcccattcagtctttcatgcattgtattgcattcagaaattgctgtgatcattgggaggggagaatgaaactaccaagcaaaagaatatgattttagtttattctctcctttcttttccaggattacaaaggcccaggaatagctagttagcttgccctggtgtcactgctcactcctgtgaagaataaggataaaccatgaggatagtagtggtaatggtgaaacagaaagaacacagaaagctgattctagagtagggctatctaatagaaatatcatgcaagccaccaattggagccacatatgtggtttacatttggaagtagctacattttaaaaagtaaaaagaatatgtaacattaatttgaatgatatattttatttaacccagtatattcaaagtattattatttcaacatgaaaggaatagattattattttttaaaggcttaattttatttatttatttacttatttacttattttttgagatggagtcttgctctgtcgcccaggctggagtgcagtggtgcgatctcagctcactgcagcctccgcctctgtggttcaagcaattctcctgcctcagcctcccaagtagctgggattacaggcgtgtgccgtgatgcctggctaatttttttttttttttggatttttggtagaggcagggtttcaccatgttcgtcaggctggtctcaaactcctgacctcaagtcatctgcctgcctcagcctcccaaagtgctggaattacaggcgtgagccaccataccctgccagaaaacaattattaatgagatattttatgcttcttttatactaagccttcaaaatctggtgtgcacttcacatttagagcacacttcaattcagacacagatcatttcaagtgctcagtagccacacatgtctagtggctgccatattgggtagtgcggctctagtgcaatggctttcagcagttcttctgtttctacccagttcacctgtctaggcaggagacttcccatccctgtagaatgacaatggatggggaacgggggtgcagcaggtggagtttaccatcacctactccctgcactcgtctgtgcactagagtcataggcttaaaaaatgtgagacggtttctgctaagacttacttgcaaggtcatgcgacgacgtagcagggttcaagccttggaagagaggactagtgatctgaaatcagaggtctgcctttggagaagtggttgcttgccaggaattagagggcttagtcctgtagaactttactgaataattttacaaatatagtatttttaaagtaatacctttttttttctcattgtatcttaatctcatttggctcattcatggtgcacaaatataaaaggtattagaccagatgattgtttaagtctctcctagtcgctgtcactgtctcctaatttggaaggaggtccatcggagactcagatctggtccttcaagagactgtgacttccagccaggtctctccccaagtggctctgaggtttttgaagtgtgttttcaatgcccaagagctgtctatgttcagctgtgtgtgtgcttgtgttgtggagtcgggttcgggacagggaacgtggagcttaaccaggcaaagtgctttacgtctatgaccctgttgaatcagtggaacaaccatttgaggtcgatgctgtcgttattctcattttccacaaaaggaaacagaggcaacagaggttaagcaactcctccaaggtcacagtggctgtcgccatttcattctttatggttggcgggctgaattttctttcttggtggaaacctgcctgccccttcttagtcatccttcttttcctcttcttcatgacatatttttcccttttcttcccctactcctcaaccacaaacacgcatcagatgaggagcacctcatcataaagcaggttggggccttcgaatccactctcggtggcccttagatttctcaactggttttccatttgatggctcacattccttcttcaggaagctcaggctgggaatgcatgacactctcctcgcacttggtcattctacagccagtcagggatcctgttggcctgccttctcttggggacccagaatatgggagctgttgctactactgttgcaaccttaacctgtcataagaagaaaagctgctttccaagaccagaggaaggctgctggccgtgcagcggtgccttgtggatgggcagggctctgccagggttccccccgccaggtctggtcctcagcttcgcaaaccaagggattcccagacccagagcagatcaggctcggaaaagagataggagaaacagattcatgaaccgatgtataaatcagaacacctgtttgttaatgggttaagataaaaattcctcctacaaggacacgaacatgcatgcttgcaggtcagcatatttttctctctgtggaaaaccttgtgtgaagagccagactattatctgaaggttatttaatgcacttggaaacagagctaggagacttagattattgctgaaaatctaagtatttatatttgaagaagatgggatacaaaaaggtacctagtgaaaaggcagcctctccttcacacctccccactccccactccctagccccttcccaggggcaacccttaggaccaatgtcttctgtaagttcagttgcctgaggcctccatttccttggcagggatggagctgctgtgcaggccaggtgacctgtgtcttctggttaggctcccttcctagacgggttttgtcttgacatactagcgggtgggaggtggggaggaacaaaaaccgtgggagtgatagaggccagttggcagaggaggcatgcaggggtttatgagttagaaatatctgcagagggggcaaggggtggggcgaggagtgacccagtgacaacagaaaggagtgtccccagacccctggcagggagcagacagtggctgttctctgacacttatcagcccctaaggaacaggacaggaaggaaaaccacagggtgagagaactggggagactctgtccctgagaaatcctcccaaagagacagagcatgatccaaaacctcgtgagaggcggcctggccccacagcattcgtgccatagcataggtcagtcctgtcatagagtgcaaccaggtaaggtgccttccagcttcaatgctgtgatctagagaccgcactggcgaagatcagcagcaagaaagaacaattagccaattcattatgttgacatttctagctacaaggccagtattttacaaaataaggccttttcccttaattaaggttgtgacagataaaagtatattcccagctgactcatgtcacccatgtgggcaggcctattatccctacttggcccgccctgtccgcctatgagggcttgctctgtgtgcgtactcttggcagctttataaaggattcagaaggaataaacacagggcctggttcctgcccttcatccagaagagaagactcattcatacacatggtccaagccagcaaactttagttgctcaagagcaggaaaataaggctaatgaaggaggggaacatctagaaaccagctcaagcaaggagcaggggtatttaatgtggaagagtgagaactaaaagtagccttgaataccatttctgacgtttgaagaggcagcaaagcttaatgtgtggtggttaaaggcatgactcagaagccagattacttggttcaaattctgattaaacatctctggcctgttcacacaaggcaagttacttcatctctctgtgcctcagtttcctcatttaagaaagtgaatataaagaaaatctaaaaaaagaaagtgaatatgatagctatccttcagggcaattgtgagaggtaagcaggctaacacatggtaaatactcagaacaatgcctgttagggcaaacactatagaagtacttgttacttggtgtgcgtaagagggcagggagctgactgtgggttgcaccacataaccgaaggagaatcagtgaaaaatcttcttcagtatatagactaactgtttcttttcatattagagttagccaacagaagacttcaaaaataacgagcaaagaatactccagatttcgaagggattgattctctaactcagacccatgtgggttctgcaaatctagtcattgacttgacgtttttcactctcatatcactcaggcatctcatgcttcacatgttcaaaagtcatctctgcttcccatgtctacctgctcctccttcagtcttttccataccagccacccagtcattcaaggtagaaactggaccatcagccccctttgatgcttccctctgtcttgcccctgtatttaatcagtcacaaacagatgtccattctacctcctcaatatctttggagcctgtcttttttttcctccacagccactgcctccatctgagttcaagaatcatcatcatccctcccctgtaggaactttctagcttgccatcttggtttacccctgccccatggctagaaaacctgcagggcaccttgatatagaaaaagcatgctccccaaggtcaggagatagagaccatcctggctaacacggtgaaaccccatctctactaaaaaagaaaaaatacaaaaaattagctgggcacggtggttggcacctgtagtcccagctacttgggaggctgaggcaggagaatggcgtgaactcagaaggcggagcttgcagtgagccgagatcataccactgcactccaggctgggcaacagagcgagactctgtctcaaaaaaaaaaaaaagaaaaaaaagcatgctcccctctgagaagacgcatcactgggccaggactttatgcagcccaggggccagatttccccatcgcttgccacttagctggtgctcatgtgtttgccacactggcttgaccaagtatagtggttcttcttttcagttcattcttcccacagcagtcgggatggatttgtgaaaatgtaaattggatcatgccccatttctctcagatatcacccccatgcccagtccctcttggtttcccgttgcccctgagctccagatcaaatcccagctctgtcctgtcacctgcagtcccacgctgtgtcatttctggctgcattatcaaatagccattcatcaggaaggagattttgctgtaaaaacatgctctagagtagatcataggatgttagctcttaaagagagcttagagacactgcctgatgcagaggccaaagactgtgcccctgagggctgtagccagcttgcagacacattttgcatggctcacagcatttaaaaatcgttttaattagttgacactattaaaacagagattttacctaaaatatagacccatggctgctcctcaaagattagcagatgtgaagacattggacccttctttcagggcgacagttggttgcttctgagctgccactgtcccctgagatggggcatgcctgccccagttctccccagcccgcatagctctgtgttctatactcatttatattccctaccaggcccctgtagacattggcattttcagctcctaagctcgttcaacctcttcattttacaggtttggaaggtgagaccagagagctggcacatcggtctctaggtcatgtactggatcatgaaacatctgatggcttctgactcccagtcccctagtccctctgttgaaccatagctacctctcagtggaaaactaaaaagaaacacaccatgtaacttgattaattatccttcctgctgtgactgctagccaacgtgccttttagttgttttgcttatatctgttgccacatgaaaattggaacatatggtctggagggccaagatggtattctaagaatatctcataccctgcatgaaactagaccaaagaagaaaggtagagaaacagagaggattgacaatgacagggaaaagaaaatctggacagcttttgagaggggcacagcctcttccttgtggtgttgcaggacggtagggagtcagttgggtttccactctttaagggatgtgaacatcaagatgtagacagcaggccaggtgtggtggctcatgcctgtaatcccagcactttgcgaggccaaggcaggtggatcatttgaggccaagagttcgagaccagccttgccaacatggtgaaaccccatctctactaaaaatacaaaaattagccaggtgtggtggtgggcgcctgcaatcccagctatttgggaggttgaggcacgagaattgcttgagcctgggaggcagaggctgcagtgagccgagattgcgccactgcactccagcctgggtgacagaggaagactcagtctcaaaaaaaaaaaagatgtagacagcaatgagtcagtggcacaaaaagaattgaaaggccttttcttctttaggcttgatgccccatcctaccctgccactcccttagaattactgtggacagccagagcactgcaaaaaagggaaatttgtcatttgccttggggaacaatggctttcaccaatcaagaggcaaaatcaaccacagtctcagagcctggagtaagatggaaaaatcttcctgttgtctttagaggaggaggttacatcatttcttacagaaatgagccttgacaacccccacatcccgatactgcatcctctttgtaccacagtgaattgttgccatgaagctgagacaaggcttggtatgggcaactccaggcatgggcaactccagacctcatcctagtggtgatcctgggctccttcttcataagcaatagagaagcagactgtttgggaggaggaaaaagtagtgatgggacaagttcccaaaaagaggccatgggagggagttcagtgttacatgcagtcaccttttgggttttgtctctattggattattctgttttttgtttctcattggagtctagaaatgtttaatgatacttgatggtacttcctttatccatgtaaaagtatatctaagaacttctgcatatattaacactctgtaatgattaagccaatgtaattagagtattgtatcagcaagagaaatatttttctctagacatagataaatcaaattttttctttcaaatctctgtgcaattgctccaaaatggaaatcagttttatgatttcatggattgtcatctccttacaacagcagactaatgaacatgatgatttatgcaaacaaaatatactcatttaagaatatgctcgcattggccgggcacggtggctcatgcctgtaatcccagcactttgggaggccaaggcaggaggatcaccaggtcaggagttcgagactagcctggtcaacatggtgaaaccatgtctctactgaaaatacaaaattagcctggcgtggtggcaggtgcctgtaatcctagctactcaggaggctgaaacaggagaatcgcttgaacccaggaggtggaagttgcagtgagccaagattgtgccagtgcattgcagcctaggaaacaagagcgaaactctgtctcaaaaacaaaaaaaaaaaaaaagaagaggaagaagaatatgctagcattgttgatttggtttatagactcccaaaggcctgttcctctgaccctcttaatgaatacaccaaaagagtgattaatggattaataagttagctccatcccctttcacttcctacccttagactaaaacaattttttcaaattacttctactaatgttgtactttcattaattggttggatcaacagggtagaaagctgttttctttttcttttaagaattctctgccactaagttcttccagccaaagaatgttcattcactataatacctcttcagttcaggcatttatttacttgaagtgtgaatccattgctgttctcatcgtgtctaactttgtctttttagaagtaaggtatttttccttgcctgtggttcacgcagaagtggagataatgattgtgttgagaattcagggagagcctgcaagtaggtaatagaggtgggaagtggagtgagtaatagtcagaagagaaagaagcaaggctgttggaatggagaagtctaaagagactgtactagaaggaactcgaatcattaaaacctagctgcacaggccgggaaattgtcaaatatcagagagtctacagttgaagcagcttgggaacaactctctgcagtaaaaatgctgagttgtggagaacacagtgacccaaactgacaaaataatgaaatacatggcgtttccccagtgaatggaaagctgctttttaccgtgttccaaaacactggctccgtttggtgtgtgttttgtttttatttgtaataccctactttgatgtttcctggaaactctcctttgagtctgtgagttttggtgtaagctcagtggcaatgttaccctcacctctaggctgctgtaggacacaccccggtctcattttcagtgtctcagcatactttccaatgcttccagtaatggattgtgcaaaacacaaagccaaaagcagatgggacatatgtagataagctgtttcatttttcatccctataatttcctaggtttgatagcacttcaattttctaaccataaaagctgcttctgtgctctttggaaaacacacacacactcatacacacacatacacacacacacacacacactaccaggaagcaggctaaaagaatattacatggggtttttgtgttgttttgcttatttctttccttttaaaagaagtaccttgctgctggaaaagaagtcaaaaaattgctttgaagagtatatttactagagttcagtttacttagggaactgtcgtgttaacaccgaagaatgcattagaatgcatcattctatgatacattatccgagctgaagctgaaacctagccttctgccgagtggtattcctgaagccagtcactcttagaagtgataatgtttatttaccagaactttaaatgctgattgtggtgtctgtgtctcctgcccagggggaatggcccttctgtccatggaatgtgatagcccagcaggaggtaaaagctgcccctggacagagtgaagcatgcagagggaggcggagtgaattacagctgtctctttggaccacccgtctttttgccaattaaatgtttacattatctttttgctcagatagttttcacaagtatatattcattaatacatggggcttgttccaaatcgatcatgaaaataagtttttgctgttggtattttttgttaaagtacatctaaccccaaaactatttgatgagggcagtttccctcaggctgtaaaatgaattaagggagcactcttctctgtagtcattttcttcccgcgttggttctaggctcaatcatttagatgtctctggtatctgcatagtctgggaattatacttgaactagcccgaaattactgcccagtaatcctctttctcactcaagagatttgtcaacattcatctaaccagagacttagcaagacatagagaatcatctagaagagcactgactctggagccagaaagacctggagccagacaggctctgtcacttactagtctgagtgatttggggcaagttattcagcttctccaaatattagtgaccccttgggagaagatgatggtgatacctatcttgtggcgatggctttaagagtaaaagtgtttcctttgttttcctttctccttgttttaaaatgataggaggagggagcacacttatttcaaaactctctgaactggaaggggctgtgttggaaactgtttctaagcttggaatggagcatgtgtcatatttgtcatacagcggagagggaaatgacttctcttatttctcttctctgttatccacccaatagctaggagataaaacatagggctggctaagcctaggagaagcacagcagtattaggctatgagaacctattttgcttaacctctttccggcaaaaggtggagccactgacaccaaaaaagggcaagcaggatgtccagtacctctctccctaacttttcagaccctttgatgccacagaggaagacaggcatatcggcaacatggcctcctccttccatctccctgatggttttgtcttccccattaatacaagcacagttccttttaaatgaacaaaaagtgagacaaatacatccctagaatctgacaagtatttttggaattctgtgcttttattttctcttctacctataaagtacatgaatggcagggctgaactgtcttcaggaaaatctgaaagcccggaacttattaacatgcttgacacctgcctctatgagggacttctgaagccagagatattctttgtaactgaggtccatctgttgcacagatttttaattcagatattcttccttctcaagccaaggctgagagagcagccaattttgtggaaagatttctttaataagaaatgaataaaactatcaatgctaaataaaatagaccgctgtgaaacttgggttaaatcccacagggaagagtatgtgagattaactgcattatataacaaaaccgcctttaatagctggcacgattctttttgttgttccaagggagaagcagccaagactagaaccaaagcacatgatattattttaaagtgctgcagcctctggaatttttcctcggagagatgtcaggatcccaagtcttcctgtgatttatagttgttttaaacgtttaatactttttacattttcaaagctatatcctctgcttccagcagcctaggggtgtgtttctgttgctttgaaagatgatttccaaatgggaagttttaaaactgtgcaaaaaggaggtcttacagtaccgggtgtttgagtgatttttaaatggatgaaagggagaaggctgtaaggcagggcccacggagtctttttctcagctccttatgataacccaacagagaagtggctggagagaactttcagagtatcaccatcttcacacagcaaacatcgctgaaccagacactcccagacctcagcgagctcactgtcaggtatggctggcaagcaagtgttaggttgagccatgtgaaactgccattgttgtagaccagaaatggtagaatattggcaatttcaaatgactcaacctaataattagatgaaaactatccacagtgatcaagactgtgatggccatcctgcagtattctgggagagtctagggaacaggacctaacccagtgaagtggggccagggacaagaaggggacaaaataaacccaaaaaaacccccagctttattgaggtataattgacatacagtaaactgcacaagttcttagtatgtaatttgatgtttccacacacttatacacccatgaaaccattgccacagtcagaatgatgaacctatccaacactcctaaaagttttctcatgtccctctataattccttcttcccatcacccccatctccaggcaaacacggatctgccttctgtcattatgtgttggtttcatttcctagaatttcacataaatggagttctacagcattctcttttgtctggcaacttgcactccgcataattatttttagatttgtccatgttgaagtgcatattaatactttgtccctttttaatgtaggacagtatttcattttgcagatatgccatagtttgtttatgcattcacttgtcgacagacatttgtttcgtcggctattacaaataaagctgccgggaacattcatttacaagtctttgcatggacatgggctttcttttctctttattaaacacctagaagtgaaatggctagactatatggtagatgtatgtttaacgtgttaagtgactaccaaatcattttccaaagtgtttgtcccattttatgattctatcagcagtgtatgagagttccgtttcttccatatctatgccaacattgtcttcagtcttctttattttaaccaattttattgtggtaagaacacttaacatgagatctacacaatacagtattgttaagtataggtacaatgttacagatccctagaaattactcatcttgcataaatgaaagcatacctgttgaacagcaactcctcatttcccccttcccccagtagtggttccctcctggcaaccactattctccgtttctatgagtttgactatattagatacctcaaataagtggaatcatgtagtatttgtctttctgtgactggcaagcattctaatttgagtagagtggtattgcattgtgattttaatttacatttctctagtgagtgatgttgagtgtctttttaagtatttatttgccatccatgtatcttcttagctgaagtgtctgtccaaatctttgcccatttaaaaaattgggttatttttgttaagctttgagaattatttgtatatatatatgtatacaagtcctttacaagatatgatttgcaaatattttttcctagtcagtggtttgtcttttaattttctaaacagtgtctttcaaatagcagaagttttaaattttgatgacatccagcttatcaatttattcttttatggatcatgcttttagtatggtgccattttaaagaagtctttgcctaagctaagcaaataattcatctatgttttcttccagacgttccatagttttaggttttccatttgggtctatgatccatgttgaattaatttttgtgtatgatatggggtatgccttaaattcttgtgtatgtctgcatgtgtgtatgcacatgtgtgcttgtgcgtatggagagtcagttgttttagcatcacttgttgaagaaactatcctttctccattgaactgcctttgcacctttgtcaaaaggtttccacatgggtgtaaatctatttctgaactttctcctgttttattgatctatttgtctaccttttcactaatacccactgtcaatttctatagctttaggatgtcttaaaatcagggagtgtaattattccagctgcattctttttcaaaattattttggctcttctaaggtcttcacatttctttataaattttagaatcagcttgtcaatttctatttttaaaaatatgtttggattttgattggaagtcattttgatcgggagtgattgagctttccagggggatgtgttcatgggaggaaacacatttttatatgtgaacaactggcattttaagacccatacagcatttaaaaaattttccacagccttgctccgaagtttattgaaaacccatctgtgaaaaatagtgttatttgatgccaaaggatacaaggaaaaataaaatgttctaattctggtccttatttcctatgatttcaccttttttttttttttcaatgtcattccagagagaggaaagacagttatctcaggcagtcttttacccctgggaaaagaccacagacacatgggagggtttgtgctgccttgagtgaaaagagtctgttttgttatgctctccttcccccagctggctggaggctcatccaccaagctttagactattatgctgtgtaggattttctaccattatctggtacaggaggcagaaatcaaacccctataaggcttgcaagttcctggacccgggagatcagctcagtgactgggctttctcatgcgtggtaggagagtggatgctgggggtagccaggatgaggatggctctggtgagctgacaagcaaagctacaaatctggaattttgtgaaacctctcaatttttaaatgctctttctgtagttttttgaactggacaggccaaatgaaacacatctacgggccaaattcagtccattgctaccactgtgcagcctctgatggatgggctcttttatttgcttttagggtcagctctttcatcagctccctaaagttttggttttttgttgttgttgttgttgtttgagatggagcctcgctgtgtcacccaggctggagtgcaatggcatgatcttggctcactgcaatgtctgcctcccaggttcaagcaattctcatgcctcaggctcctgagtagctgggattacaggtgcccgccaccacacctggctgattttttgtattttagtagagaggggttttcaccatgttggcagggtggtcctgaactcctgacctcaggcaatccgcccacctcggcctcccaaagtgctaggattacaggcatcagccaccacgcccggcggttatttcaacagttgcttatggagcactcctgatgtgccaggaaatgctgggtgcacaggaaattgaccagtggtggggagagcctgccacgggttctagaggctcctgcttcaatgtggagctcaggcgtggcagagagaggcatcccagtgccaccacctactctcacctgaatctgccccttcctcgaatcttcgctgtcacttatttcaggccctccaagaagaggatggctgatttacgcttggaaggctcccagaaagcttcttcgaagagatgacatgtgagctaattattgaatgtagagtaagaattagccagctgaatctgctctagaacagtgttggtcaaaccttgctacctgttagtggaacatgaaatcaatttaaaataaaagaaggtagcaggtagtgaaggtaagtattttttgttttgttaaactttttttcagtctctctcacacacacatgcacctgcttcttttaaaggaaacttttaaaagaaaattttggttaaacatatataaaaacagaatctggaaaactgtttgattttgagaatgttaacaaggagattaaaagaatatttattaaggataagcctatgttatttctgcagtcctttataaatatgccccttcacctgcttatttgcaacactaagtaggtactgaactaagtaggtactgaatacttgctaggataatcatctgcaaatcactctattactgactgagctccacagtaatcatgagactaagcaagtgactttaattctcttgactttatctccttcattgaaataagtgagttggtctagaaaaggtcgtgttgaagcctaagtttcacagagatgctttagacaatctccaaacaatttacagaaatagctaaatttgcccatttctgtatcgttagcacctaaaatgtacttggcaatatagcaggcctcaattaatatttgctaaatcaatatgtctgtcttcagggtgccattgtattttatgtgagattgggcatatttgaattcactaataaaattcttcactgaattctcactttaggcacaaaatttgaaacattgccaggcacattaacctgtgcctggagtcccagctaatcaggaggctgaggcaggagggtcacctgagtctaggacttctgggctgtagtgcactatgcagatgggtgtctgcactaagttcggcatcaatatggtgacctcctgggagcagggtccaccaggttgcctaaggaggagtggaccaccccaggccagaaaaggagcaggtcaaaactcctgtgctgatcagtagtgggattgtacctgtgaacagccactgcactctggcctgggcaacatagcaagaccatgtctctgaagaatgaaattttttaataattttttttatttgaaatattgcaaatcctagaaaattaaaaacatatcaagaatcacacaatttcaaagccaaatgggattcccatctgtgaatctgcatggcagcacctcctgtgcttcgtcaggttagttttgcattatgtgcagctgcacggggaatgcagctgctacccaaaatgcaactgctccacaagtgttttaaattactctcttaaacgatacttcttgggatctgcttcctaccagacattgtgctaggggctagctgtgaacaagaaagatacagctctcatcttcctttaactcttagttcactgcggtatatgccacatgctttcatgctgagttaatacctgcttgcaggttagcgtctttgggtagaccctgtgatcaggctttgcctgcatctgtctgtatcacatgcagtcaggtcactgatttggaagtggtctgtttgattgatgtggattctgtgagacagtcatcttccttgttcctgattccaaacttgtgtgttaatggaaccaagtttgctgtcaagtttttggttggttttgggttttttgctagggtgatagtgtatttgcagtcagtgaaaacatctgaacctttccttctgaacagcattatagccaggttgaaaacattgtatacatttatgattgatttttttaacttgatgatatcacatttatcccatgacaaatcttgttaggatcattccatcaatctaatgaagttattttgattcttaatatgtcaatcaccatatcactgccccttacagctttgggaagacagcaaatttaaaagcctgccttctctctctcttcctaggatgctaataagagaactgaaagtttcatttataagattgttgttgagtcacagctttgaaggattttgcttggtaaatttgcgtgacatccatacttttttcatttctttggtcttactgccaagccactcaacacagctgaactccatgaaagaaatatgcttttgatgcctgaagtcagctgccttcttagcgttactgataatcttacccttcttctaggcaggtttggcattaataaggaaaacataagtccatcagaattgttattttatagtttataatatgcaattgaagcttcttaatctttctctatactctttattacttagtaaacagcagcaaagataatatcaaggaaccataggccaccttgttttcttcagctttaatatctgtttacatatttatatatttgatattgaagatgaaactaaagttataagtatttttaaacaattttgaaaattttggagaacaatcatcagtaggaaataattacgtgattaaggagttcattttccctatttagaaaagggggaagactgaagaatgcaaaatattatgttcacatatacgacttctatataaaggaatcttaaatgtcttttgctaataacctgtgaagaagcagtgttgtcattaatgttgaacttacaatagttatctgagcattttggtaaacagacaaggcacttggaattttgtctctcaacatctgtactctgcttttaacttcaaaaggtagttttgaagtacatgtaatttttgccatctgccactgaatttgtgatttagaaatattagaagcagggccacattatgactttcttgggctgcaggctcttttgcctttgtggcaaaacttctcatgactttattgtgttacacaaatgctaagtgttcattataaggaatccaagggatgtagaaaagtaaaaagaaacaaatcataaattctatcatttaaaaataagcctcattaatattaaagaaacgttgtgttagataccaccctaagcatgtttgcagatgggaagatagatggatggagagatagatatgctttcaaagaagagtgatcatatgatacaggctaagtttttatttatatttatttttttgaggtagggtctccctgtgtcactcaggctggagtgcagtggcactctcacagctcactgcagcctccacctctcaggcccaagcaatccttccaccctggcctcccaagtagctgagaccacaggcatgcactaccatgcctggctaattttttatttttatttttgtacagattgaggggtgtccctatgttgcccaggctagtcttgaactcctgaactcaagcgaccctccccccttggccttccaaagtgtataggcatgagccactgcctcagctatacacactaatttttaaatgtaaaaaccattacacttaattttacctgattttaactggagaaaactaagtgagaattaaggaattactgaactttgaacaaacattttttcacataaaaatgttattttttccccctctatggttaagtaaagagataagaacttgctggttttcattttgtgtttttttttccaattatgtttttgtggtaggcactgttgctgttcacccagttttcttcctcttctgggatataggagaatcatatttgctcagtctcttcaagttagatgtgaccttgtggcttgctttagtcacacaacatgagcagaaacgaccattatggatgaatgcatttaattaccgggtctccagtctcaccctttcttctatcaccttggtgagcctgggtgctcatgttaatgtggtgggcgcataagatcaacacagcacagagtgcagagccggcacgtgaaaggcacagcccttacccccatgggcctgcagtgcagggagtatgagcatgaaatgaactcttgatcggttaggtcactgagacttgggacttgtttttaaccatagattacttaggttatcctgatgctatcattttcatactagacagtatggacttcctttctgccatgataaataaggtcattaagaactttcactctttttccttccttccttccctttagattttagttagttacattgctgttttcacatagtcaagtatataatatttacattctattctataatctagctttgattttgattagttatgttattttcatatagttgaagtatataatgttatgttcagttgtttaaaattagtttggtttttttcttttttgagacggagtttcgcttttgttacccaggctggactgcagtggcacaatcttagctcaccacaacctctacctcccaggttcaagtgattctcctgcttcagcctcccaagtagctgggactacaggcctgcgccaccacatccggctaattttgtattttcagtagagacggggtttctccatgttggtcaggctagtctcaagctgcccacctcaggtgatccacctgcctcggcctcccaaagtgctgggattacaggcgtgagccaccatgcccagcctaaaattagttttatatttaaatgaattcagtgcccagtactaatctttttcctatggctttcctggtactgatattgaggaacagatcaaggggcttagtggagactgcctggcagaggggaggggtattttatcatttgcattgtttagaattgcctgcacatggtgatgtgaaaaacagacagacttttaatggttttgttactaatttaaaattctctataaacactgcatcctttattgcctgcatctgaagcaaaccattttcactggcccccccattggtatgcactgctgatagctttattttatgcattgcactgactagattgtcaagacttttcaaggagggctcctgaacgatgaattttttagttttttttcatgttcaagaatatctgatgattaccttacctttatacttcaatatcatccctaggagtaatatttatgcactatactttattccccttagaattttggaggaattgtttctttatcttttgcatttaaaatacttttgaaaacaatgactgactttcccctcattgtaggcaacttggcttgttctgcttgaagaattatttcttggaactggaaatttaattattgaaccagggtacatgtttcagttaattgtttcatattcattttttgtaaaaacgaagtatgctcttttgacttagagctctgttgcttgctcattttagggatattttcttgtattggatctttaaacactttggcctgggttctctacttcaggaatactcattaatctttctgatggattatattttttctcctctatgtctatcatttttctctgtaagttttgccttttatcttgatgacctgaaggcttcctaggatataaataattttgagccatgttaattctattccttggtgtttctcacttattagtttattccttggagattgtagatttttggttttggcccattttcttccacataatgctctatttttaattcatgtgttactctgatatgttactcacttgccatgctgtttcattccatcttgcatatgtttgggtgactgtggcctttggggctctgatccactggggtgatttctccttgacacccttctgacccctgtgtattaccccttgaggaccaggtatttcctgtcctgttcacttttcttcaggctataggcacatgtaagcaaaagagcagggcaggaaagtgagctcaccaagttgtttacgcgtaggccaccctataatgcctgtgctgtgcaatctctcctgagaacatgcagaatgtcttctcattctgccagggacagttagttctcgttgtccacattttttatctcctgtcgcttcatgtagcagttaccatctccactctgctgaaattagaggagaaaaaaatgtaagaaacccacttaattttttcctctttagatttggggatagtagagtgaatctcttagagttgagtttgggtgaataattgatagagcttcaggaaggtaggaattggaaagtggctctgccatcttttttgatgggcttcatttttattttattaccttttcttcattcccttaggtgttaggggatggagactctggggtcaggcctcactctgccatatttacccagaagccttcttggggcttgcctgtctttctcttttcaaatgaaacatggatgtgggaaaggggagttcattgtagcccagtttggcataaaaagaggtaacagcccacatctaaccttgacaatattttaccattatggagtttcctctctttttaattttctgttcaccctcagattatgcaatgtaatttctctggttttaaatacaaagtaaattaaaagtagaagcacttggtaatactgtagctatagagaataaagctaagtgagtatgttatcattgtaatgaatcattccttttcattcattcactcatccagcaaatatgtagtgagtgcctactatgtgcaaggcactaccctgggtgcctggagtacatcactgagcaggatggacaaagctcccctgcctgcgagacacttacattccagcaggcatgagtgtgtagggttgggggcaggcagcgacagtaaatacagcacatctataaaatatatcacacgttacaaggtgatttatggacaaagggaatgacagtggaatgggagttgcagtttggaatagggcagtcagggcagctgccctgagaagttatatttggtgaaggggtcagtgaaagagtgtcccagggaaagggaacagctcgtgcaaggctctctggttcgcagctggctgctgtgttcaaggaaccggatgaatgacaaattggtggagctgtgtctggtccatgtgagagaaatgaatggcccagcaaactgtaacattaattgtttttactgttttgaaaatttactgtaccagatattcatttcacgtttttgtttgtttgtttgtttgtttgtttttgtttttttttttagagggagtctcgctgtgtcgcgcagactggagtgcagtggtgcgatctgcacactgcaacctccacctcctgagatcaagcaattctcctgcctcaacctcacgggtagctgggattacagacgtgcatcaccacgcccagctaatttttgtatttttaatagagacaggttttcaccatgttggccaggttggtctcaaactcccgacctcaggtgatccacccgcctcggcctcccaaagtgctgggattacaggcatgagccaccgggcggtttccatgtgtgatctttaaaaggcagaaacaaataagcaaaaatcattactaaaggcccacgagggttgtttctatcttagaaaatgtgtaaagaaaagtgatacaacaataaatggtttgatttaatgagaagtcaaaaatcataagatctgttgaaaataacaaaatcacttctaaaaaagataatatgttttattgaaataaagccttagaagtcatctggttttaccttttacaaagaagaaagcagtctaagagaggccaaatgacttatcccaagctatacggctaggtagtagcagattcaaatttatactacccaggcttcctaattcttagcccagagctgtgtccaccctaccacccaccttttaattcagtgcgagctcaattattgctaacagttttattgttgaccttccatggactcgatagtcaaatcaagtcttccattacaataaatgggatttatttgtattttgcaacataaccttgttctttggagtgggtttcacttaatcatcctggaaatcggttttagaaagactaaacatgatttctccatctctctgtgaggaccaaattgttctctgtgattatctatcagaacaagcagaacaaggggttctaattagttttccttttgaggtttttttttttttttttttctttttccaggcagtcagtctctcagccaaagggatttttctgcagagcctttgtactcagggaccagggttaattcatgagtcctgggaggtggctgatcaggttagtttttccagcctggaacagccccgccctacccctgacctcctccactccaccactctactcactccactcactccactcacattagctacagagaaactggatgttgtcagccccaggggtaccgtgagacagctgggttcagagtgactcttgaccttccctctctcactctctccctccctccttccttcccttcctcccttgcttctctctttctctctcttttttttttttttcctttgcgctcatcagtttatggtctacttcactaattggtctgtgaaaagcttcttccttttccattcatatactcactcttgttccccctccctctcatagataaggataactattctgactgatatgtattcctttatttgtgtgtgtttttgtaagtggtgttttggacatacattcttttttgttttttgagacagagtctggctctttcacccaagctgaagttcgatcagtgacacaatcagggttcactgcagccttgacctccctggctcaggtgatcttcccacctcagcctccccaccgagcacctgggactacaggtgtgcaccaccacacctggctaattttttgtattaatttttttttttgtagagatggagttttgccacatttcccaggctagccttgaactcctgagctcaaacgatccacccgcctcgacctcccaaagtgttgggattacaggcgtgatccatgggtgcccggcctggacatatattcttaatttgcatttgtatagacctgattcttttccttacattttttgctctccactgcatttagtccatcccctctaactctgccagtattccctatgtgctgttttgtatttctatatctcttcccccagcaatgagcttttagattgcttccaactcctttcttccgacagtattacctcatataaacaacctcatagtgacccctcatggatctgtgtaggaattttcctgagatggagatatctatacctatatctatatctcccaaaagagggtttctggattataagatatacgtgtatttgctagcacaaataacgaagctttacacaaacaacctaatacatgtcccttacaggtcttttttagaacttttcttgggtacgtctaacagaacaagattggaaagtacattcaattttacccacactgccaacttgctggccagtacgactgtccgatctttatttccattggcggtgaacaacgttctctacatcacgtcccagcctaagcttggtattgtctagatttctatacatataaagtgctttatcattgttgtttacatttgtttcttaaatttctgcatttgagcatctctttatgtgctcgcttttgtgtttcctctaattcgaatcacctgttcatacctttgttctgtttcctgtggaggttcttacctttgctgttggttttcagaaacaccttacccagcctagatagtgtttcccttattggtcttagacattagccttggtcttagacatcagcttggatcacgtctccttcattgagcagaaatccgtaattttgatataaaaaatttacctttgggagattaattttaaaaaccacttctgaccacaggccataaagatactcctgccttattttccatgaactttatagttttaccttttacctttgggactttatctccatgggatccaccactgttcatggtgtgatgctctaggccagttttcttttcctctgtaattagctagttctcctcagtttggggaaagcctcttctttccccattatggaattttaattgtcacaataggaattggcatctttatattataacaatgtcatcccatctagcacaacagggactctccttttagtcagatcttgctttatgtcttttaataaaggcttaaaattttccccatgaaggtcttatacagtctttattaacttcatagatcctttatccttctcattgcttattgtatttttattatgttttgtatttgattattgtaagagtgttgaaatgctgctttgtagttttttgctttaagttgatcttgtatctggcaattttgctcagtcctcttactctaatagattatctgctaatcctgatatttttctatgtattaggtcatattgtctgaaaataatgttagttttatctcttccctagaaatgcttattatttataactaactaatttcttttttttttttcttctttttttgagatggagtttcactcttgttgcccaggctggagtgcaatggctcaatctcggctcaccacaacctctgcttcctgggtccaagcgattctccagcctcagcctcccgagtagctgggattacaggcatgtgccaccacgcctggctaattttgtaattttagtggagacgggggtttctccatgttggtcaggctggtctcgaactcccgacctaaggtgatctgcctgcctcggcctcccaaaactaatttcttttctttatagcactggtcaggacgtccaatactgtattccacagtattggatcttatacagtccagacaagtgtgcatccttgtctttttaaagagaatacatttaaagtttcttcaccaaatcaaatgcttttacaatcttaaccaaattaagaaagtttcccatattttgaatttttaaagaaatatttttttcaaattatagttatgtgtcaaactttatcaaatttttttctgcatctattaagataataatgactttcctctttggtggattgatatattgagttaagtggtagattttatgatgttgaaatttattgcaaacgtaggatacattctacttgttcatgatatgttactttcaattttttgattcaattacttaatattttatttataatttttgcttctaaaatcgtaactgaaacaagcctataatttttcctcttcttgtattcttaccctgtttggaataaaaactgtagtatcctcataaaatcagctagatagcttttgtccttttttgattttctggaacaacttacatatgataggaaattaagtgtttcatgagctttttctttttccccctttaacttgtccaaggtccacaggatccatgaacatttgatggagcttacctgtaaagccatctgggcctagggctctttgtcaagggagggctttgtttgctatttcagtgtatttcatactttggtctgttcaagtttctgttttttcctgcaccaatatccaacacttctgagtgtttagaggtcattgttcagcaaactttcactcctcctaccccgtgggaagatttaattccctttcctgttggtgttgggcttggccacatatcttgctttgatcaatggagcattagtggacttgacatgggcagaggacttaaatgtcctcacagcaggatttagccctgtcttctaaaaagcggctgtgctggaacgggacagtctcttcgctcagcttttttttctagtcccgcacacctgcagcatatgacacttacatcagtaacagtggttcactgcagccgtgagctggggtgactggtatattaccagaccctccggaggaatgtatatagtttttaaaagtgctaccccatgaccaacccagtcaccgtcgtaaataaaaaaaaatacctgcttacaacatctcctctcatatcacaaaataactgaagttgagaaaggaatttcatagttaaaaaacttttttgactcttccagcagctatttgtgtgtctgctgcacctcttcttagccgttggtcttcagcttctcaactgtgcttttgaaccctggagagttcccattctcagattacctgtaaggtgatcacatcattgaatgcaaggtgaaaacaggaggttgaccagacaggaccctgggcctgtggactgtccttcactcacagaacccacatccaaccagttattccagtgaaagcaataaggaataggtaggaagtactgctgcacagagattcgttagaagacatggctttttttctggaacagatgaagtcaaacagacagctagtggagatggtgagtcgggaacttgacttggagggcttttttgctttaagatgatcatcagctcctggaaaggtgtacgttgagttcccttttgtgctaggcaaagggctaaagactgaggggaaggaggtcacagaagtagaagagctggtctctgcccataaggagcttcggagtcagcaatgtcatatacaaaacctggaaaaattatgtgagaaactttcacaaaatgcaatagggattagagaggagatttttagttttgaggccaaaacagtgattgataggcatggctgagggaggaggaggtagctggagaaggagggagaatgctatgttgttttcattcacgtagtgaccacagaaatgagggatggaggggcgagagaataagttaagtcagggcgggggtgggggagagtagggggaggtgtttccattttcctttaagtggatccttggcttcattgcagtaaatggggttgtcagtatatattgccccttttgaaaccgacgagtttcactgagaatgggattaaaagattgcatgaaaaatttaggatctgtataagggagaacattttatacagccctgtatgagggccgtctaaaaggagttaaattcccatttgggattttttaaaccaggatgaacattctataccacaatgtctggtggttttaaccagagatagtactgcctcaccccagggtatgtgaacatgtgtgtttgtggtaaggtaggggtatcactagcaattagaaggtgcaagccagggatgctgatgaccccgtcatgtactggagaagctctgtacagcacattgcctgcctagaatgctaagggcacacttgtggagaaataatgcacttcctaagcttcagtcatttggggtccccttgtttaatttttgcggtatctaggtaccatttctaccactaatttaatgctttttttcttttttgtctttttattcttttttttttttttttgagacagtcttgctctgttgtccaggttggagtgcagtggcgtgatctcgctcactgcaacctccgcctcccagagtcaaacaattctcctgccttagcctcccaagtagctgggaatacaggtgcccgccaccaagcccagctaatttttgtatttttagcagagatgaagtttcagcatgtatgccaggctggtctcgaactcctgagctccagtcatctgcctgcctcagcctcccaaagggctgggattacaggcgtgagccaccgtgcccagcctaatttaatgcttttctttaaatttatttttatttatgtatttatttatttatttatttgagagggagtctctctctgttgcccaggctggagtgcagtgatgcgatctcagctcactgcaacctctgcctcccgagttcaagtggtcctcctgccacagcctcccaagtagctggaattacaggcgtacaccaccatacctggctaatttttttgtatgttagtagagacgaggtttcaccatcttggccaggctggtctggaactcctgacctcaagtgattcacccaccttgtcttcccaaagtgctgggattacagacatgagccaccgcacctggccctttaaatttatttttaactgacttttaagtttttagttgtcattctatatctgcattttaatttacttattgtgatccttgcaatcatgagtttgaaatgctattgatatttttctaatcatattaaaatagatgactattgcaatacagaatgttcatcttgcactccgctagtggcatgcatgctagctttgagaagtagtagccagatggtcgcagtggattaatttatggcttgacctgattttatgtagtatatccttgagagttgacatccttgggactctcatttttaagtaaccttgtgttcagcagaattcacgaactgaacgggtctcatgaggatactgtccctgatagaggtcagacagcacaaacagctgtgattgcctctctatatgtgcaaagatgtccatttggaaaggcttgatctgcttggtggggtggtgcttatgtgccaattacctttgctccggcctgtgtccacagactgctggccatctcccagttatgtggccctatttacaagggctaagtgaccctgaaagtgtggaagaatcagagcaaactctgtccttacttccaaataattggctcgaagcatatgttgcattcatgttggccaagaatgagagagaaggatgacagagtatagcagaaacacagacactcccttcccaacacccaaccaacagaacgaaaatgcagttagaaacaaaatcaaacccagccccacaggctcttgcagcaagcaaacaaacaaaaaacaattacagctttatttcaaccactttgaaaagtggcaggcaaggaagggtgcaccccaccgtagcccctcagaagcagtactggaaaaggaaggcgagaggaccagttcctgagggttcctcctaatacagatcaatatgggaagcagctggttgaggaggtgagtggatagacttggtaaaagttaaaaaaacaaaaaacaaaaaacaaaacccttggcagagttaggaaggcacctggggaggccatctcctagtctctgtgttgagttacaggaaagagaccataggagtgagtctgccctggtttggcagagtgggccctggtctaagacatttaactcccctccaaaagaggacagagtatagagcccccaaggacaggcctcatgactcctgcctctcctccatggcagaagtgttcatggaaagcagcagccaacctaaagttgtagctcagaggtagaacgacacctggttccctataaagtgaggagagtgtcaaaagatacatcagcttgctctgggagagcaaagagcagttctggacagagatgttcacgttataagtatgaacaagatggcagtgagtgtcatgactgttctgtgaaatgctgcagcagaggaatgcaagagaggagcacagcttgttggctgagcacagtggttcacacctgtaatcccaaaactttgggaggctgggtcacgaggatcagttgaggccaggagtttgagaccagcctgggcaacacagcaagaccctgtctctattaaatatatatatatatatttttaataaagaaaagaaaggaacacagcttgcaaaaataaacatacaaccaatctggtctataagaaaacccagtcctagaaaactcaacctcacaagtattttatgctatagaaagactcagcatcaattgagtagaaacaaaaactcaagatgtcatcatgataaaacaacaatgggattcttttaatttttatttttaattgtggtaaaatgtacataacatagaatttgccattgtaaccatttttaaatgtacaattcagttgtgttaagtaccttcacattgttttataaccaatctccaaaagtcttcatctttcaaaactggaactctgtacccattaaacaataattccccatttctccctcccccaccccctggcaaccagcattctgctttctgtatctgaattcgacaactccaagtacctcatatgaatagaatcagaaagtatttgtccttttgtgactggcttattttacttagtgtaatgtcctcaagattcatccatgttggatcatgtgtcagaatttccatcctttttaaggctgaataatattctattgtatgtctctgacattttgcgtatccattcatccagtggatactcagtttgcttccacctttggctattgtgaataacgctgctatgaacataggtgtacgaatttctctttgagtccctgcattcaattcttttgagtatatacccagaagtgggattgctggatcatatgctaattctatttttaaatttttgaggaactgccatactgttttccacagcacctgcaccattttccattcccaccaatagtgcacaagggttccaatttctccacacccttgccaacatttgggacttactgttttttgttttgttttgttttgttttgatagtagctctcctaatgagtgtgaagtggaatggattttttaaaagatagagccaagaaaagaaataaagaacaaaaacacaatacaacgttaaaaccagaacacacacacacacacacacacacacacacacacacacacacacgatggacatagctgaaaatcaaagagtgagataatcccaaggaggggattaaagcaataaggacaatataacagccatggaggagaggcacagccatccagcatatggagcaagaaaagaatgcaaccatgtgacccaggaagattttcccaaaaggaagaaacaactgaatctttggttagaaggttatgccagccaggcacagtggctcacgcctgtagtcccagcactctgggaggctgaggcaggcggatcacaaggtcaggagatcgagaccatcctggctaacacagtgaaaccccatctctactaaaaatacaaaaaaaaattagccaggcatggtagtaggcacctgtagtcccagctgctccggagactgaggcagaagaatggcatgaacccaggaggcagagcttgcagtgagctgagatcacgccactgcactccagcctggatgacagagcgagactccgtctcagaaaaaaagaaggttatgccacatatctgaaagtgcagatgtagaatggataacatataccctggtctaaagtttcagtatttagacctcagacaggaaaagcaagttacacaaaatactggatgactaagttggtatcagaattctccacatcagcaacccctaccataaagtacgaacaaggtctacaaacttttaagggaaataacattatttaaataatataatttaaaattatgaatataattttatattatactgttaagaatataaaaagataaaaataatataaaattgttctctaaatattaagttattattccagtgaaggcaataagcaggatgccttgacctgaaagaagtcaagagactatggcagtcatgagcattgcttgaaaaaaaaaaaaaaaaaaaaaaacctccctgtgatgaaattgacccaaatgactcaaatcagaagaacagacccaggagtagaaaagccacagatgaagaacagtaacaacagcaacaacaacaaaacactggtgagcattcaaccattacaatgccaccttaggactaaacaatggggcaagggggcatggatgattgttaaagaaatgtataactattaggcatctggcaaaataaaaattatgtaagtgaaaaaaaatcaagtgtgaggaagtggagaggaaatgtaaagtaattatagagtatttctataaaaacatgcagttaacccttgagttttcgtaacttttttctgtgcattaaattgtgtgtgtgtatgttttcaagtatgttaacttgtaaccgctggtcagaatgtcattttgtttcacttctgctttttcttctgttacatccaaacaaaattacatagctcttactggaaagaaaaggtcatatgttatcattttaaatgaacccattaccctctatctagccttctaccagtgtatgtgcatacagagatatccagaatgatggtcaccaactgtaaacacaatagcgggatattggatgatttcttttcttctttgcgctgttttctgttgctttattttttttttaatgagcctatgtttttatacaagccgtaaaatcattgctgttaatctcaactattgatcagtagtgtcatcagtattctaattgcgtcatagtcattgttttttaaattgtagtgttgacaaacaccagaaagagcccttgacaatatttttgcaactcatctctaaggtgctggccgctgcccagaggccaaagacatgggctgtggaaaacatcagctcttgtaataaggtgcctttgccttcttattgaatcataaatcaaaacacaatagtggactgatgagcatgaagtagactgacctgaatccctgtgatgctgatggatgggagtatagtgtactgtgctgtcaaacaaatgtctgaacctagcaaatgactttggatgtttggagtccgtctcaatctctgcacttggctgctgtgagtgcctttcacttcctccattgcgattctcctgcctctgggcctttgcacatgcaattctctcttctcgagatgcgccacgccctgttcctccttcatcacccagctcctcctcctagtgttcagggcttagctttagcctccttcccctggaaggccttccctaatgaagttaggagctcctctgtataaccaaaggcactgctcactggttttgctgggcacatttataaccattcactcaatgtcatgcttcttagcagactggcctcaggcaaataagaatctagttcaggaagtgtaaggtcagatttcctcgttgccccgtctcatacttcctgttcctcttctgggctctgccagaacggtaactccactcttgtggcctctgctatgaacaaaccccgctctcttcccttcctgctaccctatggcctcttaggtttattttgttctcagcagccctcttggctctggcttctgttagcagctacacgttttctcggtaatatttcaagttcaacctcatcggcgagggtagctgtttggtttagcctttgtcctctagcacgtgcctttcctgcagggaggggcattcccagccttggaacaggccccatcactaaggccacagacagtgccagagggagctggggtctgtgcagccattcttgaattcccccagaatgccttgcctggccttgagtaaaagggatagaagtgaaaaaagcctgttacaaagcagcatgtacgaggtaacccttcatgtgtgttttatatatcaaagaaaatagactagttattatcaatgagtttttctggtgggatttctagttatttttattttgttgctttcaaagtttctgtaacaggcagggtgctgtggctcacgcctgtaatcctagcactttgggaggccaaggcaggtggatcacctgaggtcaggagttcaagaccagcctggccaacatggtgaaaccctgtctctgctaaaaatacaaaaattagctgggcatggtggcagttgcctgtaatcccagctacttgggaggctgaaacaggagaatcacttcaacccaggaggtggagtttgtagtgagccaacatcatgccattgctctccagcctgggtgacagagtgaaacaccgtctcaaaaaaaaaaaaaaaaaaagtttctgtaaaaacattttcacagatacttaacagcattgaagccctgaatcatggcgttgtacagagcagcccccaggaagaagacaagagccaattggctctgccatttggaagcattgccttcttctccccacgattctcatttctgcccccaaatgatgtgtttgttgccttgctcatttcaccggggtgtctttttcctcctcaggtgacagattgactgggatcccctcgcacatcctcaacagctccccatcagaccggcagattaaccagctggcccagaggctgggccctgagtgggagcccatggtgctgtctctgggactgtcccagacggatatctaccgctgtaaggccaaccacccccacaacgtgcagtcgcaggtggtggaggccttcatccgttggcggcagcgcttcgggaagcaggccaccttccagagcctgcacaacgggctgcgggctgtggaggtggacccctcgctgctcctgcacatgttggagtgatggtgcctccagcaaccgctggggagtgtgtccctgagtcatgtgggctgaatcctgactttcactcagagcaggtggttttttgtgtaggtttgttttttatttttgatgatcttcagatggaaggagaaaacagggtttccactagacattacttgaaaggccagattactcagcagatctcccatgttggctcaacaattctttgtttttaattgcttgaagattgcattgttgtaattgttcagtttttaaatgtgtaatggcattttaatagactagtaaatcacagtggttcaaaatatatatccatatatatatatatccatatatatatctcatgtcatcacattacaggcaggtgtctcatatgtaaaacatttacctgaatgttgtctgaggactgaactgtggactttactattcataatgataaaataataaaatgcgaattactatatataatgtgcctcactcatgagaa

SEQ ID NO: 321 - DNA, 158953 bp, Homo sapiens
  source 1..158953: mol_type = genomic DNA
gcgaggaggaaacggtgccggagcgcgcagggcttgctgccgccaccgccgctgcacaggctgccggagcgagcctgccgcgcgccgccctccccgctctccttcctgggcgagctgcggggatggggcggccgcgggagcccgagcgcgcgcaggaaccgccgccgccgccgcccgcgtctccgttgccgcgcgcctgagccgccgtcgccgccgcgcgccctgcccgggggcggcccccccagccccatggaggtctcccggaggaaggcgccgccgcgccccccgcgccccgcagcgccactgcccctgctcgcctatctgctggcactggcggctcccggccggggcgcggacgagcccgtgtggcggtcggagcaagccatcggagccatcgcggcgagccaggaggacggcgtgtttgtggcgagcggcagctgcctggaccagctggactacagcctggagcacagcctctcgcgcctgtaccgggaccaagcgggcaactgcacagagccggtctcgctggcgccccccgcgcggccccggcccgggagcagcttcagcaagctgctgctgccctaccgcgagggggcggccggcctcggggggctgctgctcaccggctggaccttcgaccggggcgcctgcgaggtgcggcccctgggcaacctgagccgcaactccctgcgcaacggcaccgaggtggtgtcgtgccacccgcagggctcgacggccggcgtggtgtaccgcgcgggccggaacaaccgctggtacctggcggtggccgccacctacgtgctgcctgagccggagacggcgagccgctgcaaccccgcggcatccgaccacgacacggccatcgcgctcaaggacacggaggggcgcagcctggccacgcaggagctggggcgcctcaagctgtgcgagggcgcgggcagcctgcacttcgtggacgcctttctctggaacggcagcatctacttcccctactacccctacaactacacgagcggcgctgccaccggctggcccagcatggcgcgcatcgcgcagagcaccgaggtgctgttccagggccaggcatccctcgactgcggccacggccaccccgacggccgccgcctgctcctctcctccagcctagtggaggccctggacgtctgggcgggagtgttcagcgcggccgctggagagggccaggagcggcgctcccccaccaccacggcgctctgcctcttcagaatgagtgagatccaggcgcgcgccaagagggtcagctgggacttcaagacggccgagagccactgcgtaagtcctgcccccggggcgccgcggagagcgctgctgccggggagccgccgccgccgccgaggcagaacgagctgggggcgagcggcggggcgggggtacagccgggtgacatttaccaggtctcaggttcacaccgcgggcggccgtccgaaggctcctctcggacggtccccgagacctggagcacggcctgaggtccccaaagggagagtgtaaaaaggggggcggggagggttggagttagactcaaaactctagtggctgcatcccattgccatccttccctgtccaaacggggacgcttgtttggggctgagtctcctcgcgcagcccctctttcccattcgcttctccagacttctctgtgccccttccgtgtagtcccagcaggcgtgtgggtctgaccctcttggtcaacagttagcaacacagtgccctcggcagagaagccattgaacctaaagggctccctgccacaccccagcctttgtggccccctgtctccgccccccaccggcaacgcaagtgctgtggtctgaagagttgctagcccgctcagcgtggagaaatgccagcctgcaacagaggcttgcgctggaaccgaacccctggcgtgagccggtgcgagggggcggtgccgtggctctgctcagggtgcgctgtggtcgccagccgccgggagaggctgggcgggaggtggccttgtggtaaaagcctcatcctagaggggagtgcaagggaaagtgttgggggtgctacaggcagtttctgggctccagattgcgagactagatggcgggactcagagtcaccaccctggggctgaaccaggcaagcgatacaggtttcccctgggctcccagggcagccacagcttttatcttgagattggcatttctttgactggaaaataaagaggcagttcaagagggtccagttgatggggattatggagccattgtgcacttctccggaggccgtttcccttccaaggcggctggcacatcaactccacatatggctcctgagaggggagcctgctgggagcctcctttataactggacaaaaatcaaagcgcagaaattaacggctacaggtgttgccattgttttggtacaaaatgaatcagagaggaaggggagaagtcactgcttggaaaatgtgttgatacaggggcacgttggctcccaggtatattaatatgtgtatagaaagacagcttcccccacccccttctttctctgcaaagcacatcttaccaaatattagccctatgagccagggagaaaaaaaccaggaggtcttttgcaaggcttcttagaacggtcacttgctgctgcttctttgcctgtcaagctgtgtgctgggacacacacattaaggccttcattttgttactggtataatttttaaaaatatgtaaaaacacatatttgcctcctaaatgacttgctgttgccgtacacatataatgtaatatttgattcctgtctttattagatctttataatctaacggtttaagtttggtaaaattatcgtttcctacttctctgttgaaagacttgaaagtacccccgaaatattactttgtgtcaagctttagacacacttagtctctggggttaatgacaagccagctcagaggcccacagcaggtaatgagggtgaaagtccaagctttgccatctgacagctgtgtcgatgtgtggagccaaaacatttctcttgactgcgtctctctacctattgggtcctggaagactcagttcccttccaaacccagccagcatcttgaatgcactcaaaatccacgttttggctcaatcaggtgttcctgcttgtgccgggatggggaggggcagtggcagaggaagtcgcggagcttctgcgagagagctgccccttggaaatcaagcaaaggataaacacatgctgccaaaaatctggaactggaaaaataaataattaaaatgggtccctccacagcatttcttgctgctatttatcaagaactcccagtgtgctcagagctgtgtgttctgaaagacagggtctgtaccccctgagcttgtcagccaagttaaataatatactctggttcaaacaatagcatgtcatggctgcacaggtgggagcttggagctttgcatttttttttcatttaagtaaattccttgctgctagtatgcattgaaaagccttaatggaattgaatttcaagaggagtttgaatgaaaaagggtggtagttttgatgaaaaagctgacaattttctaacctattaaataggtagagaagatactcaattcaacaaatatttgtttgatgcctgctagtgtaagcaatgctctgtgctgggtgccactgattttgccactgaaaggacgatagcagattgcaaccttgtgtaatggggtcatgggatcagtgtgcccctggctgtcactcagaagaatgatgtcatttgattgcatttgttctgcattttattttcaggtcttgaatgtgtttttgaaaaggcatgctgaattataggtgcctaaaacaggagcaggacttgaaacactctagagggaacctcaatagattccaacagcaattcctttagagcagacacagtaattttaacagtaatccacaggctgcaaggcacaagcggctggatttgcttgccttctttctccctctcctcctagctggctcttattttccgtcttcaatcagccataggtagaaaagtgacaggactgactgggttgtattttcccactttctggttctcttatctcttgtcactgatcctcctctccttcagcttctgctaagcagtgatttacgagatgcttgtgtaatgagtgtgtactcagctgtttacacactggaccattactttttctgccttgccaccaactttgaatccactttcataactgtagcaggttaactgcagctctcaaatgtgctaaggcaaccgatttctgtagaccctctctctaataatcttctgtgatatttgtacagcacttccacatgtattatttcttttgagccccgcatcaagtctgaggttgattctatggggatgatttcattttccagatgaggaggctaaagatccgttaagcagcttgctcaagatagttaagtgccaaagccctccaccttaaatccaggtcttccaatgtctacatctctactcttcccaccaccccagggtttctcgaactttcccttgaaggtcccctaattaaattggcagcaaacaacctcccctaggatgtggggttgaggctagagggtaacctcagaaggcagtacatgcctctaatcttggcttgtgttttagaacttcatgtggtctctttcctttttttcattcttttttataacacacctgtgcttggattagtataaaaatgaatgtttttaattatgcacaagttaatcaatttgacttcctacctttctgaactctcactacccctggcacaccaacgtgatacacagaaagtgtttgtgttcgagtttgtggagtctgattgctccagacttgtttggccaccattgttgggttctggggtcactcgtggtttaaacatggcagccacccctcggtagacattgagggtagtacgttttcctgcagtattggtccacaggactctagatcattctagtttgttctctagttcattctaccctttgtagggggacataccgccttcttccacgcctacataattctaaagcctgacataatttaactgtcatgcagacaaccacagaatgctcacatgctgcccaacagagagcaacccaaggaacatgtgtggagaagtgacatcccagttccacttggcgatgcagcctattgacctcaaaatccgcagtcttcttgtgatgtttatttctcttccagcttctgttatgattttgtcaagccattttgcagtctatagactagatggtgattttaccctcatatacacatattatatgcaaaaatggattcaaaaaggacaattgccatgacagcacccacttagaaagaggggaaagcaatcatagctactatctactgaatagttattatggccaggttttgtgtgaagcaatttacatgccttattttctgttgattctcattcaccatatggggcaaggactgtagttatcatgatgattagagatgagaaaattaaggcccagagagcttctgttaggttccatagctggaaaatagcagaggatttagaacctgggtggtccagctctacgacctgagcttttagccaccttacaagtctatattaaggagccctaccctattactattaataatcatgatggtgatgatagtaaagacatccaaagcacacggcattttctatgggtcaagtagtgcttattctatacacattaactcatgaatccagagaatattgctgtcaaggaaatgggattccccacttataaataaagaaaccaaagcacgaagggttaaataattactacatgcaataatgtgtacatgtccactgccatggacagtctgtcagcatggacattaggtcctgatgtcaaccctaacctgtatggagcaagctaagcccttgcaactgctatgctaagaccagctttttgtggacacaggcataggatagcagagaatccttagttatgagctgagtttctaggtttgcattggtgaccacctgaagttctgactctggcaggattgtagtttcttaactgtgaacttctagacagtgttggtgttctgatctatacatcatctcaaagggtgttctctgttgaaccccccatacctagcatagtacccagtatgtagttgggacttcagaaatatttgttgaatgaataaatgaaggatcgtagagaatcatgttggaaatgttttctctactcagcagcaacactttctgggagtctggtcacctcatactcccttaatcattgtctttttcttaatgcctgatgtgtcagggccccttccttccttagttttaggttacatggtgtcctttactccttcacctcttcccaggtacttccattcattggaataccaggcttctggtgttgccaatctgagagttacttttgaccatggaaacctagcatggttggaacttctatggtgtaatttttgattgcctttcaactatgagaggaaagggctttatgctgtaggcagtggtccttaaagtgtggactgtggcccagcagcatgaatatcacctgggaacttgctagaaatgcacattcttggaccctacaccagacttactaaatcagaagctctggaggttggggtgggactggcaatctgtattttagcaagctctcaacgtgatttgaagtcatgcttaggtttaagaaccactattgtaagataaaacaattttccttgtgttccaactgaggcacctaggataggaacttgtcgcattttttttccccttgcattttacttagggccataaaaagtaaccaacacattttaccacctgatattccttattccctcctcactgatcaaaggcagtacctagaaagccctttaaagacttgccatttttgggcttagagtctgagtctcaaaaacctgtaagccatagtttaattagctccttcactcttgcatataacagtttatttgtatttcactcccagatgtggggggatgtctagagtcgtctattgtgctgtacgccagaaccaattccgcacaccagacattctctccaagggtccattctttacaacatcagtcctgttaccaatttctatcctagtcatgtacagttggttgcatggaataaagatctacttgagtaaggtcagataaagggatgagggatattgtggacagaaacacatggaattacatggtaatctaggaataaaagcaatgctgtgttatggttatgtgcacagtcactggaaccaggtcaattgggaccaaagctaccagttaccagttgtgggactgtagacaaattattcaacctttctgtgcctcagtttcttatctataaatagtgatcctcttggtttcataggattattgtctggattcacgagttaataagtatagaatgaatactactaactacttaactcatagtaaatgttatgtctgtgtttactatcatcaccatcattactactaatagtgttaggacgggctccttgatatgcagttggaaggtggttccacattcaaggcagcttaaaggagctcagtcagcatcagcaaatgatggatgctccttccttagtctccctgttaacatgacttagcctggctgctttgcaccatcctcctaccaaataacctcctctgcttcctcaaacatctactccctcccacctgagtatgcctcaggcctgccttgatccccactgtctatctttttttttttttttcttgaaacagggtctcattctgttgcccaggctagagtgcagtggcacaatctcggctcactgcaactacctcctcctggattcaagcgattctcctgcctcagcctcctgagtagctgggaccacaggcgggtgctatcacgcccagctaattggaataaaatcatttcttaaacaatatggttcctggaggagagacactggaaactttctttcttttttttttttttttttaaacagagtctcaccctgtcacctagactggagtgcagtggcatgatcatagcttattgcggcctcaaactcttgggttcaagtgatcctcccacctcagcttcccaagtagctgggactacaggcacacaccaccatgccaggctgattttttttatttttatttttggtaaagatgaggtcttgctatgttgcccatgctggtctcaatctcctgagctaaagcagtccttccgaagtgctaagattataggcataagccagcacacttgcctcccactgtacatcttaacagcctgtcaccttcggctttggctactaactggcaatgactttctgtattatttagtccaagttgccaggagagagatagagttgagtccagttcatctttcccaccagatgatgagcccgagttcagtgtagggatttgtaacccttggggcaggtgctggcccctggtccgactagaagaggatcaaacatgcaattgtccccagcaggtgctgcaggtggattcccttagaacaggatggcggaagagccacaccaagaccaacatcttgattacagtagcatacagtagtgtcaaatctgcctcccttaaagttttttgatgaccactcccttccccaaacatgcattggcacacagatgatgaagactgggaaaccccaaagtcgacttgggaacagtgtgtggccagcatgggtctaacctgttcatcaaagtggggccatggaatggtaggttttcttattatgttttttatgaaatgtgcttatcatttttcttagttttaattttctatcttgatgaaatgctaatttttacatgatcacaaaaacaaatagaactgtgacattcatttttcagtttcagtagctgattttcatgttggttggattgtctgttcaatagctacacatagtgctttccttagagaagttactagggggatgtggccctatttccatcccaccaccctggtcaatgctgttatgcaggggtcagcaaactctttctgtaaagggccagatcatcaatattttcggctttgcaggctgcatacagtctctatcacaactgctcaattctgctgctgtagtgtgaacacagccatggacaatacataaatgagcaggtagggctgtgttccattaaaatgttatggacaccgaaatgtgaattccctgtaattttcacttgtcatgagttattctttttttgattcttttcaaccattttaaaatgcaaaagctattcttagctcatgggccgtttgaaaaacaggcaacaagccagatttggcccacaggtggtggtttgttgactcctgctattatagaaagaatgagagtaaaacaaacctttcccatacagtctgatgctcatggcaagagagacgtgaccaaaagctgccgtggaagtcccaaaaagaggcactactctcagcctgggaggatctgggaggcttcagagaggtaatgcttgagctgcatcttgaagctgagtggagaaggcagagaagggagttctagagagaaggcacagcttgtgcacaagcaggaagttgagtaagcctgggagccacaagcagctcaccaggctgcggaatgtccagaaacgagtgtgcaggtccagatggtgaagggcttaatgagacgggcaaaggtggttggattttatcctgatggttggtcctctagactttccaaaccttgcctttaaaataaattatcaatcggaagctccctatgagaaaaaggttagaaaattatcattaggcagggagcagatggcgcatgcccataatcccagcaccttgggtggccaagacgggtggatcacttgagcccaggagttttaagactagcctgggcaacgtagcaagaccccatctctacaaaaataaaaataaaaatcttagccaggtgtagtggcacatatttgtagtccaactgcttgggagtctgagacagggagatcgcttgagcccgggagttaaaatccagcctgaacaacgtaacacgaccctgtctcttgagaaaaattatcattgacttggttctttttgtaagaccaattaccaagcgctgggaacatgggaggaagcaggggttgggagtttccggagccctacaacttgccacaccccatccgggcctgtccctgaggcatctccaaggaacttctagagcagggtgtgaaaaccatggctaaggttgatggagtaaaacagcgggattataaacagacacaatctgaatgtgttctagaaagattactcagaagataaagtggctgcaataaggttggaggcaaagcaccttattagaaggactatcatttgttcgaatactttcttgagctcctattatgtgccaagcaatgtgtggagacatttatatcatggtaaatagggtagacaataaacatttggcaaattaatagttacttttacattaagatgatagctaaaatttacagctcacctactgtatatcattattctaagcactttaccaatattaactcatctaatcctcactgcaactttacaaaatgggctgtattattactaccattttaaagatgaagaaacggaggcacttcactaaacaggtaatgtagcagaggcatttgggggttgcaggtgttggggtaagttctctttaaggaggccgaattgacaccaggaagataagaaaggccggttgcaggtttcccttgcagatctgggaagagcagtgctggcagactggagggcatgtgcaagaactcaaagatggaacatcctggtcttggtggttgtggagagcaaaatgctagtgtggttgaggctagggaggtagaggagagagtatgaggggaggaggctggagaaggaagcagcaggcccagcctgcaggcctccttggcaatgggaaggagattagattttcttctccgagcacaggagagcctttgaagggaagtgaaatgattggatttgaattcctaaataacggctgccctgtggggaatggatgagagattggccacagcggaagaaggaaaacctgcaggaggctcttgcagtagtccagacaagaaataatgtcaccttggccacgagcagtggtgacaaatatggagagaaacagatggattttgtttattgcaatcattcaactgagggacgttgaagagctgaactgaggttgcagcaatgaggatggagaggaggggtgaagtgaaataggtttttaagacgtggaggaccaattagaggatgagtttaatttttgttgatttttagatgccttgggacatacaggaagacaggaagagttgctaagtagggagttggcaatgaagttaggagttggggatccactctataaaccttagagtgtgccaggccctgtgtcaggccccacacatccctgtttgggctatatgtgcactgaggggagtagccaggtctggctcatctttctttcccaggcatctatcaggttggctaacacatggtgagtgagccctcagtaagtgtttctagaactggaaaaaaggtactcttcatctggtggagaagatagtgattatagcatggtgagatgagtgcgtccaagaggagttgacactggggctctgttttgaggaaaagtaaaagctgggcagcaacagggaagtgtatttccttttgactcccttcccaattagccaggattccttgtcatcccctgtctccccgcaacctgactgaggaagcgtgttacctaacacaccagctgttcctgatcatcgccccttggtcttctcctgaggctcctttctctatcattgaccccttttaaaaattggattccgagtgcaaagccttgcttctctgaggcaatagaggggggaatagcctagagcagctggtggctgtaggtgtaacctagtgtcagcccccgcacttagcaatatgtttcttcataaccctgcagagctcttgtgctgtagacctctaatgcagcctgtagaccccctgacagaataatgttttttaatgcatgaaatgaaaacattggattgcaaaatagatgtaatatattaatatatcgatctatcaaaatgttttttcaattaaaggtatagtaatgtatcttaacacattcaatagcaagatatagaggcagtaactaccataatttcaaagtagagatgagcataaatgatactttgagatatctgcaacaactatcaaataatatgaaaatatctgatttcttttggtgacaaagtcacaggttcagtaaatactgctgtggcctgaatccatgattaaaggaaatgctaagttccagttagagctccctggaataaagatttttttttttcatccagtttcatggattccctgaattctgttcatgaactgtggatatcagtggagccccactctaaccattcatttcagttaccaagtgtttcagaaaccaatgacatgaaatgcaaagtttagcattttatttcaaaactcatttgactggtttattttgacaatagggagtttgttcccatctgtattttacagatcaagtacttggtcaacagcaagtgctccataaataataggtggatgagtggatgggtgggtggatgagtggatgggtgggtagagaaagctcagaaaggataaatgactgtctaaacacttacagctcataagtaatagagtttgaacttgaaaccacatattttttactctaaatcacttgttctttctattcttccatgctaccatcagctacttttatttgaaaggacacaatgatagggcatgttcttaaaaatatgcatttgaatcatgggaaaggacaatcctattattatttgctttggtcagagcacacctaaagtactgtgtttacttcttagaagcacattttaagtacactgaatctgttgactgttcatggactgagatggcgagagacttagaaattgtctcttacaagctatcaatgagctatggatgtgaaattcagagaaggccagtttacatggtaatgggaggtctggggtggttttctattgctccccaaggcagaaccaaggcccagtatttacaagggacgaatcttggctcaattaaagaactcagtaatgattaggcctacttatcaatgtatcataattgcctgatgagatattgactgaaagtattcaaacattgacccatgtatttatttatccctttgataagcatttattgacaacctactccatgccagatgctgaggtggatgctgcattcgaagtgtagaatacaatactattggagatagtcagtcttataaagatggagtctactgggagacagtaagtttttaaaaacaatagttataataagtattttgaaggaaataaatggagtgctgtgattcagaataaaaactgaggtaggaacgggaagagctatggtcatgtgtccacgagtaggtgacattcaacttgaaacctgacagattgaaaagagccagcctacaagggagtgaaggggggtggggctagaagaagtagcaagtgcaaaggccctgaggcagaaagatggtaatgtgtccagagtctgaaagaaagtgactggacttggggagcagaagcagagtgcaggaggagaagaatggcaaggaatgggtgtgaagacgtcatcagggatcagctcagggagagtctggggaggcatatggattcaattctcagcattgtgatgggaagccattggagaattttagtcaagggagtaacaggacctgtttcatgttttaaaagatcactttggctactggacagagaataaattgaaagttaaaagggagacaccaagagactcttgcactagatcgggaggggaatgaatgggcacttgggctgaatagagcctgtagagatagagaaggtgaatttgagattattgggaaattcgactgagatttttaatgtattggatgtggggagtgacagaaagagaagagttgagggtgattagtggtgctgttgaccatgatgggtagcaggaccagagggaagaaaagtctagataaccatttgtcagcacctctgaaaccatgtcacagatttcagtggttcttaacaggggataatgacatttacttaggggatgttgagaaatgttggggagagactttcacagtagtcaacataatagagggcactgctttgtggacaggagtcaggaatgctagaagtcccgcatcacacaggacagctcccataatgaggagccatcccatgtagaatgccagttgtttcctcctggacaagcactggtggactgagtctctttcaattctgagaacctagggccaggtgcggtggctcacacctgtaatgccagcactttgggaagctaaggtgggcggatcatgaggtcaggagttcaagaccagcctagccaacatagtgaaaccccatctctactaaaaatacaataattagccaggcatggtggcaggcacctgtagctactccggaggctgaggcaggagaatcgcttgaacccgggagtcagaggttgccgtgagccgagatcgtgccactacactccagcctgggcgacacagtgagactctgtctcaaaataataataataaaaaaaagaatctaggaaaatgcagtttcacgctatctgccattcatatacttttgtaaattatttgagtcaggtcgtctttttataagtaattgactgaaattagccatagggaggagaaggaggttgtgggggtggggaagggacataaagcgggaagaaggaaggatgaatcttggagagtgggactttgctggtgggttggcctgggtggctgggaacactggggcccgtcgagggaggggagagggtagaaggaggtgaaatacaagcttcaccaccttgcatgcttcccacggctgtgctgcacaccagtgatgttttctggtctagaggctgcccagctgtgtccctaagcacactttgaacctctccttttggtcatttgagtccccagtgtaaattcttccttcagacgatcagagagctgccataacttagtcagatcccggtcaacactgtatacactagaatggagaaaagcaacccgagccttcctagctaataaaatcactgtccgacttgggcaaatagttgtcctttccatctccttagctgaataaaagtaatctaattattttcaaacacatgatttcatctggacctcacaacaacactgagaggcagggcatgtggtattattaggtccattttacagatacagtcactgaggttcaggagacttaacttgctggaatcaagcagtctataaggcacagagcaggggccagaacttgggtgcagggctccttcaggggtttcctaatggcaagtgggccccttgggaagtaacagaaaatgatgaaactgcttcaaaacaaagggatcccaaagggaacagaatataaaattaactgcccaagaaaggcattttgtcatgtacaagaaattgataggtacccagttggtatttcctcccacctggtaaggtaaaatcaacatacaggaatccttttagcaccttgggggtaaaacacttgactcttgcttggtgctcaacattggaggccccagttttgtgcccattccctcccgatgatgccgcaaaagctggagcatggctgtgagcaccctgcctcgatgagccgggccatctttcacatggtaggggcagggccaagctgtggctcagctctagagggtgcctttcacaccctggaatgcatgactggcaccccctgcagttgtgcagggcacaatgggagagtatttattgtccatgaaaaatcatatgaagcagctgcaaagaagtctaattgttttcctcatgatatgcccatgactccctgcacacacacacacacacacacacacacacacacacacacacacacgtacacacacaaacacacacacacctcaggagctttggtcccagtttgctatatcaggcccaaagctctttctctctttcagcccaaacatcgcttgagccaaggtagctttctcctccaactgagaaaagtttccctcttagagccggcaaacgtgtaggcgtgacgttatgcttagacacggcaggaaggagaagcagagtgacaactctgagggaaccaagaaagcccaaaggggagacaaggtttagagcgaaatcaagatcggattttgtcatgaaaggcagaactggcaaaagcatcattacaaggcattaaccttgttacacacagacgaacaagcagaggctgggattcagaaataaattacacataataaactagacagaataggctgagagcaacattagcgattatgccctaaggggagagaagggcaagatagaaaataggcccgaaaaaaagagagaaagaataatctctggacacagggggctgactgcactgtttcccccttcttctgcctggctccctgggtattaacctcacttttgtgaggacgtttctccggagcctgtctttcttttgttttcatttgctgcaataagcataagaaagccattcaaagggttccttttcccattcacagggacctgtccatttctgtgtgtttccagcacaaaagaatccatttccattcagccagagcagcccctagagttttcatgaggtccaagcctcctctcctgttttcttccaggctcgctgttgtaataggctgcaaaatcctgactgtggccagggtcctccaggctggtgagaggaacaagcatttgtccacgtcctggtccctgcagctggggaagaactgcagtttagtgtccgctccaacaagttgtgattgtcatttcttaaacagtgacttccttttggttccaagtagcagaaaacgcaaccaacagtggcttaaaccatgacaactattgttaacttagtaaaatgtttaaaagttgaaggtctgcggctcagtggtgtctccaggaacatagaatctcttttctttcccctgcaccaatcttagcatgttgctttgtatccttcatcttgaatctcatggaaacagaacggttgccacgagtctatgcatgatgagatcacacaactgtattccagaggaggaagtgagggaagagggcaaacgggttctcctcaagaggcttctgttatcaatgaggaaacttattcccagaaatccttccagtggacttctcacatctccctgcccaggactgggccacatgaccaccctcagctctaagggttaggaaagccagtgtctggcaatagggaatggagctgccatttggcttggcccaacgatagcttccaccaggcttgggttcattgctgtctgaacaaaattagggttcttcttggcaaagagaaaataactgccatgggtgtggcagtaacttgtgtttttaaatgaagtaatgatagcaagcatgggttatgtgttgctatgtgccaaacctgttctaagctttactgaggcttacgcacaaactcacccagtcctcataaaaagtctgtggcataaaaagtctgtgctcttatcatcatttccatcatatggaggagaaaactgagtcacagagagattaaatcacatttacaaaattacttagctagaaagtgacagagccaggagtcaaacttaggtggtctggctggctctctatgctatactgccttcattaggtaagatgataaaatacttcaggtagcacacagtaagtattagtacatgttagctggtattattattattattattattattattattattattattattactatcatcatctcttttttgtaaccaccctgccaatcagacacatcagccttattagatactagaaagctaacccctaacagcattaaattaattgcccaggtcacacagtgagtgagaaccaagctcaaatgtaaacgagtgctgggtgttctctcaagtttgagaatgttgatttaatggctgcaccacttacccatgctacttttttttttttaaggtaaggtctcactttgttgtccaggctggagtgcagtggctcaatcatagctcactgtaacctggaactcctggactcaagtgatccacctgtctcagcctcctaaataggtgggacaacaggtgtgtgccacacatctggctgattttttatctctgtagagatgggggtcttgctatgttgcccaggctggtctccaactcttggcctcaagcgatcctctcgcctcagttacctatactactgatcccggacttactttgaaaaaaaaactacaattgttgaggacagccagaaatcagagaaggacaccgggaaaggtgagatggtaatttgggacggatttttccttgttccgttttagcttttgagctgcctctgttttcttggatccagtcttttgcaaacaggatctctcatcccacctcaggaaaggctacccatggttcttggtgaattagaacaggtacagtattaagcacctactgtataccagacctggctgtacactgtcccacctggtccttgtggataatctacagtccacatccattactttttctgtgttgtgagatgaagggaatggagtcctctagccagagatagtggtattagaacattctggatacccaggcagagacgatgccctattctccgcgttagcctctctgcagtgttcaaatatttaataaaaataacaggcatggtcagctgatcttacgtttgaacaattctggatttattttaaagcaagatgtgtggcatggttttacttatttttttaatcctaaaggtcatccgacttttctttttctgctcatagtcatgaggcttccttatctaaacagtgatctattgttccaaccttagacccacagagaatttttttccttaacttcaattttcacaggacagctcctcatcttcccatattgcatgaaaagtatctttcaacaagggaaaaagaaactctaatgagctttccctaaatcttcttaaaccgagttcactatagaatattttatgcaaaaacattgccttctcttaggttatgacatcttttccttgaaaagtgatcagggcattggacaaatcctggctagcttatcttgtccttgcagcgcaacctcaacaaagaaatatagatggcactttaaaggcttcagaaatcaatttagtcccataatccatttagtttagatgttaatgaaacttggtgggtttaaaaataatgaatatttaataagacataaattgaaagacataaacactgttggcgataatataatgaagttaataagtcttagcctccccctccccaaatagggcgattttaggagttgctgtgttgcttactgaagtttgctggctgcaacttcaatgtgcctttaaaaaccttagtacagttgggaactgagctctggcagataaagtgtgctatcacactgtgttcagtagctgcagacggcaacggctcttcctagctccatatcttccagagatttgtgtaacaaactcagtttcctgtcgttgaaggcaggatgcagcacgaagcacttcattccttttaaacaaaaaagaaaaagacattttggtcgacactctctctgctctgggtttaaagaggggctttatttaatgatcaggaccaagcgtgtgattacatgtgctcagagcctcagacaatttaaatgccttcaggttgggagttagactttttgttttcccctttaaaagcatcagcaccagggccagcccttcaacttggttcctccttagctctgtggctcgatcctacccatcgtccacaactgtatctttaccttttcaccccctcaactagctaccctgtctttaggcttcctgtggtcccttttggtaaatctagaatccctcctttctgccatcacacccaacaggatcgtccgtgtcacatcttgggaaatgtttgtgtttaacctcacagaagccaacgcctagctaaaatgaattggcggcaggattttgaaaacagccaagtataagatagtctgcctcccaattcagcggtgggctgtctcttggcactaaagtggaattcagcttcttatatcagctgaggggtgttagatagatggccagctcgctttggcactcaatacctgttcatacatagtaaacaggggttttctttggttgggcaggtatggtgattttgcaaggtaatgaaaggttgctcccggggaatctagtctaagagaatatatgtggggcccagaagtgagatcctgcctaggagggcatgagtgacatttcatcagtataatgagaactattgttgttaaaaattattattatttttttgtgcgtttgtgtgcatgttcagaaagaaggggatcaacctgaaagagtccaaccaatcgcatcatctaccttgatccattccgacctgacatccgtttatggcaccgtggtaatgaacaggactgttttattcttggggactggagatggccagttacttaaggttggttttctgtgccttcttcaaatgtctattttaatggtgatattttgtactttaaaaaaacatttttttaatgcttctgggttatacatgagaccaaaccaagaacttcatgaactccttaaagacccccagaaatggcctggaagaaaatctggaattctgtatgtaagaatgccccgtagccatgtaatgaagtatcagctaccttgctgcccaggagtgcaccaagatgtttttccttccttactcataagccagctgggtgaggtaaatggaggtctggtccctaccccaaccctgactcaccttcccaagacatgtaaccttttagttctagctcctttatcatggaaatgtacaaagcacctgatttctcacaacttgaaagagatgagagattatagggcttgaaaagaagaaaaaacaggtgttctttccctccagcccacttaccacccacagagggggtttgttttttgccctttgtacccacacacaccacagagaggttagagatctaaaatcctttgagactcctcttgacttttatctcagaggactatttcttctccactgtgtggacacaccccggtcaagtgcaggtttttattcacttaggagaggggaagaggggaggaggagaaaataaaatcagagataccaaatgacttgtctgaagttatctagcgttcatcttatcaatgtcatcagcaagcatttattgaagaccttctgtggtctccaacaacattcctggtcaggaactgcaccatttctatgactaaagactgagattccttggcttctctgcagccatccatttactctcagctcagatttttaatcgagtaatggtagatctgtttccctcaactgatctcccacagataactcgctgtgtgactttaggtgaattgcttaacctctctgagccttcatttccttaccagtaaaatacagttctactagacaacccagaaaaacgctttcctcttctgaaagtctctaattctgtcttctgcacacgtattccccaccatccccatccccaagccaaacctatttacttgctcctgtttgatcctgtttccaaatatgatcctgtttccacacttgctcacactgtacctccagcctgaaatgcttttttcttttttctcttatttacggcaccttatgtgtctatgctgtggctcagctcaaaccccacctcctctttgatgacatctaggcctggagtgaccttgctctcctctcatttcctgaaatactcatgatctatgtcattcttgtggctcattccaaatgtcttgcctggagacctcaccttttcactggtgtctgtcttgccttcccaacttgattttaagcctcatgagaagggggccatgaattcccacagcctaatacagtgctgagtgcctggtaggcatttgatttaatctgttttctttggaggaaacccagtaacatatgggagggagtttgtttgtatacacattcttttaaaatatacattgatcatctttcctgttgtgttagctttatttcctggggaagggtaaatacccatccatcattctacacaagtcactgggtgacgtctgtagctccaccaacctggtcaggcttattggacccatttgcctggcgggagtttccatcaagcctttctgggcctcctcaccaattatctcttcagatttgggatgtttttgatgagtgttttgacaagaacactgtttccccaaagccgagccaaccaaaccgctacatggtgaattggaggtgaaggaacactcgtctataaatagttccccatgggatggcctggttttgcctgtcctgtgtgttcacccagcagcctgcatgccgctggccagcttttagcgatgttgtggcaaccagggagtggaccaagctgcagcttcatgctgctgaggaggccgcagccgaccgaagtctcgctctcctcaggatctgtatggggtacccattcagaagccacctgtgtggcctcgttgtttttttcaaggtttgaataacaaaggcagctttttgttgtttgttttgtgactgctaacatttacacagtgcttcctagatgccaagggactctatatcttctaccgaattcagtcctctccatgacacaatggggcaggcctactattcccattttacagatgagggaatcgaggcccagagaaatgggatgattgttgttcaaggtcacacaggggcagagcagggatttgaacctggaatgacttcagagactgcactaagatcccctatgctgcactgactttgcaacctctgccgcacacattggtactactctctgaggattccgggggcacatgggagacatgcagatagggttccatgccgtggctggggacacatgctcctggggtgagtcagccttcctagaggctcaggaaagagtcccagcttgagaataaggcggaccatctgactgaggaaatacctcactggcgtggtaacttcttgggaattaacacccaccccccaagcccccaataagagagaagttctctcactcaggagaagggtgtgagggatgaacttgagctgacttgccccaccaggctccctagggcagctcagtaatgcccaagcctctcccctgtatcctgtgtacagattcttggatgtagcccctgaatttacccagaatcctgaagacccaggatcgtgtggatgatttggaaactaccgataatcctcaaatccctttattcagaagctttcagcttctcccttgccaaggcttgtcaccagaactgttagaaaggatgaacactgatagacacaagcttggctccttaagccacagcgtgggggaactaatgagcggcaaaaaacaaaactcaacccaacgcagacagtaggaggaggagaagaaagagggcttggatcagccacagcctgactcatcagtttctgagtgatcatgagttgacggcattttgacatgtgccaggcactgttgtgtataccttgttgaatgagagtcaggaaacagcaattggggcccaactgctgttttttaccaccaccagtaaaaacctgacttcttaaatctctgcaaatcctgtgagttttaatataatttggtgcaattttaagcctcatgttatttaaataatttttccttattgtaaaggtaatatatgctcatgtaaaaagttgcagagtcgtcgggggtgagaggacaacaaagaaaaaattacccctaatcatgtcatgcagaagcaactgctgtcagcattttggattctctatttatgtagttgaggtcaggttttgcatccttttcttcagttagtgagggaaaatgcttacattaaaatgttattgcaaaccctttgtaaaaagtatttttaaataactatatcatattctattatttgggtacattattttgaacttaagctaagatactggatcacttttaaagtatctttaaagacatgcattttccaaggaagacggcattacctccaaaggtaagatttcactgataatctgtgaagaaactaaaggctacagtatgccagtacctttactgtcctccttctcttgcctatagacctaagtccctttataagattttggggaaatagaaggaatttagagctcaaagggtcctttgagagcatctaatctgctcttttattttatcggtgtaccgtcccatggtcgtgaggtgagttatgtctagtcacccccgcagttatttccccatcctgcttcttttcggaacatgattgcatgccgggtttttttcagtcgtcagcatctccactgagatcagctgaaaagtatggtcacactgaactcagctttggggaattcacactgcacgtgttgcacaatgtatgcatttctgtaaacacacaccgagtctttctccagattatagtacagcctatcatgtggtttggattcctttgagctgactctgttgcccatagaaaattgtccttatttcaaaggcagaattgcatattttgagcttttccaggtggtaaagtaagtaataacagaatatgcatgaaatttgaaatttgtaactttatgcatgcccattaaccttcgtgtaagcataaaagataagaaggcaatgggcaaggaagaataatcgctaacatttctgagctcttcctgtgtgctgggcattagaaccagcatctgcacgggttaactggtttaatccttaccagtcaatactctcaccatccccactttataaatgaaaaaacctgaggcctcgagaggttaggtatctttttcaaggtgctctgaaccaaaataatctgtcccagagcccgagcttctatcccccaactaaactgcattaactcttacagagcttagtagagtttgagagctggtttttgttatatttctttctaatactggggtataagggttgataccaagatgcagatgtttgaggtttcataagaaggggccgagaaccctgtggtttagtttgttcctatttggggatggcttcctggcaacccagctgagtgcagagcccgctcctctctgagctgcgcgtagtccacgggggtctctgaatctcctttggggccccagctttaccccagtgggctcctttgtaggaaaggtaggaattctgtattcaagttgctgttttgaatggtgtcagcagtaaagactagtgtctccccgacctcccagggactgcagtagggttcaggatacaggaagctatatcacatagctctatcctgtccccatatccagtcttgaggtatttcctatgtgcttgggctcagactggttacctatgtggccctctactcccacttaatggctttcttttgtttatttttttttcttttttgagccaaggtctggctctgttgcccaggctggagtgcagtggtgcagtctcggctcactacaacctctgtctcccaggcttaagcgatcctcccacctcagcctcttgagtagctgggactacagacctgtgcccccacacctggctaatttttttgtatggacagggttttgccatgttgcccaggctggtctcaaactcctaggctcaagagatcctcccacctcggccttccaaagagctgggattacaggcatgagccactgcacacggcgccactcagggatttcgtttattcaaatcacagcaaaattaaaccggttccaaaaagttctgtctgaattcaaacagaagcaaaaactctgtactgcctaaagagtctgccttgactctggttattgaagtttttgaatgaatgtcagagaaaaaaatcttttgtaaaggcaagctgtactatatacccagaagatgttcaaataaggaataggagaacttggggaacctagaacaggacctgggaccggaagtggtggtggtggtggggatgactgagctaacagaccaaaaagttaaaacaggaggaagtgtcaaaacttggaagtgggttcattggttggctgtttaggatgtcatgtgaagcctgcttcaagttctccccacctcattaattgcaatttatgagtttgcagggactccccagtttgaaacttttagtcccatataatccacaaatctagaacctgtggttcagactgtatgcttctcttactacctacactgcaataagtagattggaaacaaaagagaaatttgccttgatctttatatttcatctttgttactcctaactactgaggcacattaaatacttaccttgctttctcctgtgtgtgcatgtgtgtgtgtgtgcacgcatgcacaggcatgcacgtgtgtgtatatgtatgcaggcatgcacgtgcatatgtgtgtgtgagcttgtgtgtgtgtatgtgtggtttaagtctccttcccagcatttctcagaaactgcttatggaaaaaaataataataaatgaaagggttggcttgtttgcccttcaactggttagccccacagagtgaggcataggaaattaaatttggcataaaatattatagctttttgaacacccgtggcttttccatctcatggtaatcgtaaagaaaaaaaaatagttttttgtttaatttttctcccccctcattttcctcaccatgatatccttcctgtgggtgatcttgaacctgtcttacaattgtatggtgttgaaatctccactcagttaatttcagcagtgtagttgggagttttatatgcaacaaaaatcccaaggctcgttaatagtctaccatgaggcttcaggaagacatcaacagaaacaatatgttgacacgaactgaaattctccatcagagaaaatttgttttctacacaggcttcagctggaaaaagctgaagagccctataaaatcttgaatgctaatagcgtcgtttttcatttaataaatatctactgggcaccttgtatgtgccaggcactgttctgggtgctgaatatacaaaggtgaacaaaacagacaatgcccttgctctgctggtgggaagaaaaagacagaaaacaagtaaatggattaatcagcgataaagacacttcagatagtgctatgaagaaaatacagtgatgggtagagagtgacagaggtgttcagcggagaagtgatcagggaaggcttctcagaggaggtgatgttggagacttgaaagataaaggagtatacaagcatacacatggagaaggttcagattgacttcagattagatctatattaaggtcgtatcctggaagataaaaatccacatcgtgcccaaggattgtgtgtgtgaattggatgagatttctcttatgcaaaattcaacccgttttgggtttttgtgactcattgttacttcctgcattgcttcactgatcatgttctttttccgaggctgcccacctaaactgagctgaggaaggaacgtttcccttgctccagtcttgctggcttttgtctgtgtgttgatattctcctgaagtttgcaattagaaagtccaagtgttccattagtgcctgtgggctggggctcgggctaggtgagagatgatatgaacactgacctgtcctttagtcatctgagagagatgagactccaggggccacggaagcagaaatccctcacccctctgtgtagcacatttgggacctttgtggtgaaaactaaaacttcctcttgtcctgtcctcaggattatggagagcattgtttgcataatctagcaaaaagaaaaacaatttgactcactcaccctcaaggatttttaaatttaaatgttatatatttatttttaaggtaatacaatgatattgtttaaaactcaaaagaaccaagaaaatattccgtgaaaggcacctggtcttgacttccaaggcaaccaatgatagtagtttcatgggtatctttccagagatagtttatatctgtctacaggcaaaagagtgaagatattcttcctcccttttgttgaaacataaaacacagtaaacatatatgttatatatgtaaaaatacctgtatatgtaaatatgtctatatttatagatatatgtacatatttcatataactttaaatataacacaaagagctttctaattatttttatagctaaatagtatttccttgtttgtactatagtttacttaaccagttccctattgctggagatttaagttgttttaatcttttctttataacatacaatgctacaatgaatatatgtcatttcatatatatgtgtgtgtgtgtgtgtgtgtgtgtatatatatatgtgtatatatatatgtgtgtgtgtatatatgtgtgtgtgtgtatatatatgtgtgtgtgtgtatatatatatgtatatatatatatacgtatatatatgtatatatatatacgtatatatatatgtgtgtgtatatatatacatatatatatatatatatatatgtatatatatatgaggggctgcagggtccaagggtatgtcctttgtaattttgatagatgatgccaaattaccttctagagaggtctggcttccaccactgaggaaacatactaatttaaacccagcatctatggctatcaggacaagcttcagtgcaagccacgctaagtagctttttcaggaaactgattggtaaatcctgggccacagaactttttgataacttgtaaaaaaagaaagaaagaaaaacaaagaaagaaagagagagagagggagaaagaaagaaagagagagaaagaaaaagaaagagagagaggtaaggaaggaaaggaaaggagaaaggaagggagaggagaggagaggagaaaggaaaggaaaagcttccttgccacaattcagagttctagagagaatattgatgcttcatttccaaggtaccaagtaaataaatcaatgttgcacccaactagatcttgctgaccatctgtatcaatgatgctccaagagtaaataaaataagcccccaataaaaactgcagtgcagctcctaatttacgtaaaatggatgagtggtggtgtaaagtatgtttttactttgttattttaaagcaaaccccacagacatgatgtcgtttcacctcaacatatttcgttatgcatctctcaaaacctacagttgttttcttaaataatagtaaccataatgccatgatcacagctaataaaattatcagtcattctttaggatcacttactatccagtctgtgtaactaagtattcccaattgattcaaaaaggtattttaaatggttttgttcaaattggtatctgcacaaagtcctcaaaccaaatttggttgttctattatctagagcagtctcctcccttacttttattccctgccactgacttaactgaaaaaaccaggtattttgccctatagaatgtctcttatcatgtgtttggctttttgcttccttgtggtgtcatttagcttgttcctctactcctgcttcctagtgctaaatggaagttagtgctaaagacttgactagattcagtttcaactttattggcaagaatacattatgggtggtgctgcccaatgatgcttttgccatgatgaattcctgaagagataccagggcagcagcttctcttctcttgacccttccttgataatatttctatcagtgtttgtttaaaaaaaacaaaaactggcttcctgtttctctttccctatacaactgctttccagaaccagatcaactgaatctgagctgattaatacagctaatgaattagagacggcaaatcctggcaagcccataccttggtcagtgcctgtcccttggctccacttacaggattctgtagagcagtgttggccaagagaactttctgtagtgatagaaatgttctacatctgtactctccagtatggtagccagtcaccttaggtagctagtgaacacttgaaatgttgctagtgtttttaattaaatgtaaatttttaattaaatttaaatagccattatgtggctagcggctgtcatatttgatagtgcagctataaagtcgttttaaaatgacttgagacacacacctttcccacctcccttaggacctaactgcttctgttttaaaaagagcttttaagaagtcatatttcatatgtttggttagtgagattgacttttacaaagctgctgctgaatttgatgagcagtccaagggcttcaagtgagccactatttgcaccaaatccacctgggcttggcccaagcagatgatggaaggaagtcactgatcgcagggcaaagctagactcgggcccaggtcctggaaaggagaagtgaatgcgggaagttgctctgtgcaaaattgataagaagcctttggctaaacagcaaatccctaactgccatcaggatatgtgggaacaggcatattattgattagtagatgtgtgaagtagactttgtccaaaaagaatctcaggtgccaaatttttcttttgaaaccatgcgcccaatgtggctgatgtctacagtggtagagatatgaatacagataatctatctggatgtgttcaaactgacaaaatgttgaacaccttcacttttcaaagtagtgggtacaaattgtgttaggtacaaagaagattaaaggttaggtacaaaggtgattaagacatggtcccaggccaggcacggtggctcacgcctgtaatcccaccactttgggaggcagaggcgagcggatcacctcaggtcaggagttcaagaccagcctggccaacatggtgaaaccccgtctctactaaaaatacaaaaattagctgggtgtggtggcgcatgtctgtagtcccagctattcaggaggctgaggcaagagaatggcttgaacctgggaagcagaggttgcagtgagccaagatcgcaccactgcactccagtctgggcgactgagtaagactccatctcaaaaaaaaaaaaaaaaaaaaatgacatggtccctgcgcaaaaggagcttgcaatctagtaacagattattatctattgactattgattatgtgctaagcatctttcatagttcttatttgatccttacaaaactgtaataaggaaggcactattagccccattttagagatgaggaaattgaggcctagggagattaagttaccagttcaaagtagtgcagctacttaaaggatggaggcaggatgcaaactcaagcttaagccaccattatacttctctagcactataggattcgagtctcccgatggctcttcatacccacacttcaaaccctgccttcttaccatctcctcttgctccttgacccaaagccctgccatggcctcctctctctcatctacagtaaaaggcaggctgtttacacaggcccacaagacccttgattatcattcccctgttatcttactatcttactgttcactcctctacctctctccactgaagccaccctggcctcctcccattttagtttctttgcactgacagggctgcttttaagaacatgtttcattcaagtatgaaaataactcatctcctgcaagtctaaataaatatcaccttttcagtgacacctaccctgaacatatattctcttaacccctgaccccactatattttataatttacttttttcttattaatagtctgctgttactcaccccaccatacacacacaggaatgtaagttctatgaggtcaggagctctcccttccccattttgttcactgccatttttcaaacacccagaacagtgctgggtacataatgggtgttgggtagatgtttgttgactgaagatggatgaagctcaggtgtgtccaatttcaaaaccactgagtactgagtcacacttgcgtatattttatatgtgaacacaaacctacttgtctgtatctgccaagttaatctgggtcacttctaactgtatgatgatcagagtatcctgtgcaaatacatgtgggagctacttcctttaatttccagtctctcttgagacagcactaatgaagctgtcacttgtggcttcctatagggccagacatggtcagaaattgtggtcagccagcttccacatatgaggatactaccccagccctgaagagcggctttttttgtttgttcatttttggtaactttgcctttacaaaagaagaaatattatgcttgttattaccagccttgttgaggactgagatgtgggaggatgattaaggagcatggtaccttaggcagtatttgtagtgagtgaaaaaggatgtagctttatgattaagctacaatttttgccaccctgctattcaaagtgttgaatagaggccggaagtggtggctcacacctgttaccccagcactttgggaggctgaggcgggtggatcacgaggtcaggagatcaaaaccatcctggccaacgtagtgaaaccccatctctactaaaaaaaattagctgggtgtggtgcatctatagtcccagctacttgggaggctgaggcagtggaattgcttgaacctgggaggcggaggttgcagtgagccaagatcatgccaatgcattccagcctggcgacagagcgagattccgtctcaaaaaaaaaaaaaagtattaaatagaaatcatgtttctctttttgaaaaaaaaaaataggttattcttggtgagaatttgacttcaaattgtccagaggttatctatgaaattaaagaagagacacctgttttctacaaactcgttcctgatcctgtgaagaatatctacatttatctaacagctgggaaagaggtaggtagaaatactagttattgcttctgatttatgaataaaaatggtttaattgatgtcattatctagtagcaaagcttttactttgaactacagagtttaagcagtgccccaggctttgaggagacccgcagtggttcacaggcacggaattaaaaaccttactgactgtcagtaagtaagcaagaaatattatctatttagacaattttattattggctatatttccagtgccaagtttttcagaggagggtgtgcttggaaatgggcgcataatcagcaaggtaactgaatttacacatttattgtgtgggcactgaacggttagatgcatttatgaatatacccaatgggactggctttggaatttggggttaatatcaggccacagtctcatacacattcatgaaccaggaaatatatggtactccccctccccctcttcatttatcttgctgttttggcttttcttttgcttctgcttactgaaataaaagtaatatatttttatattttcttcatctttaccaagtgctgtcaccaagggaaggggaaaagaaactaattgttaatgagtctctactatgcattagtcactattctttgcatgatctctgtctaggtgcatagaattgtgtacatatacatacacacaagtgtagaaaacagtgttaatgaaatgtgttactgaccgggcatagtggctcatgcctgtcaccccagcactttgggaggctgaggcaggaggatcacttgaggccaggagtttaaggctgcagtgagccatgatcaaaccactgtaccctagcctgggtgatggagcaagaccctgtctcaaaaaaaaaaaaaaaaaaaaaaaaaaggctgggcatggtggctcacacctataatcctagcactctgggaagccaaggcagggatcacctgagttcagacgttcaagaccagcctgggcaacatgatgaaaccccatctccactaaaaatacaaacaattagctgggcgtggtggtgcatgcctgtaatcccagctacttgggaggctgaagaacaagaatcgcttgaaaccaggaggtggagtttgcagtgagctgacatcacaccactgcaccccagcctgggcaacagagtgagactctgtctcaaaaaagaaaaaaaaaagaaagaagaagaaaaagaaatgtgttattaatttaataaaaataaatgtgttattaatttattttatgtgaagaatctaagacttggagaggttaaataacttgttcaagaatatctgtatctatctatctatctatctatctatctatctatctatctatctatcatctatctatctatctataggttagcctttgcagggctgtgacaaaaactcaaccctgattctaaagcctctgataaatgatattaaatccaaaatttgtgaaaactggacattccctggctcagtggttttgacctatgaccgtttgaacatggaaagtgcaaagaagataattgagacttacataattatataatggatgtaacagatactctcagcccaaccctggttttccattcttttcctttcagtcattctaaggaaaatagcaatgacagcaatctacatgtgctttttgagtcacagataagatgtgcaagcaatttgtagtttctggtattcttataaagacgatactgttctttgcacattgaaaagtcagttatatcaaaatgaccacactgagatggccacatcttcccacagagcttgtaaaccagtccttcaccatatagaatctcctatgccaatttgcttcaccatgcagacactttgtattatgtttcttccctggggatcccatctttgaaagacttttgtctacccaacaaactgcacatattaagtaacagttcccattcccagggtttatttatcaagggcgtctcaaaactgccggtcagagtactgactgtgttcccacatggagctgataaaattccaacccaaagcaaagaaacttgatatcttccttaatccatgcgtgtttttccattcagctgtctgaaatattgcaaatagctcataagcccccattacttccttcatggatagtaatggaaccccagaactcaggaccccaggctgggaaccattatgaaaagccaccagtagttgatgggttcccactttctagaaagcaaaaagttctagcctctgatcattcaaagcctgaagtcctgggaagagtttttgactgggcatcaaagctggttagccctgcattcttcactgaggattactgctagagatcctactgtttgaactctggctgagcaaatataacgcctaaagagacaaagtccaaggaaggctcttggggagataagaacagccaaactaataagctatgggatatccataaaatggtatgatacggggccgctaaaaataatcatatggagatgtaggcattgatatggaatagtcactacggtctgttattaaattagagggcaggtctaatgtagtatttttagtgtcctctctctctctctcttttttttttttatggagtcttgctctgtcacccagcctggagtgcagtggcgcaatctcagctcactgcaacctccgcctccacaggttcaagcagttctcctgtctcagcctccctagtagctgggactacagtcacacgctaccatgcccggctaatttttgtatttttttttttttaatagagacggggtttcaccatactggtcaggctggtctcaaactcctgacctcaggtgatccacccacctcagcctcccaaagtgctgggattataggcgtgagccacctcgcctggccctctctcatttttttttgaaacagagtctcactgtcgcccaggctggagtgcagtggtgtgatcttggctcactgcaacctccacctcctgagttcaagagattctcctgcctcagcctcctgactagctgggattacagacgcccaccactatgcccagctaaattttgtatttttagtagagacagagttggccagactggtctccaactccaggcctgaagtgatctgtccacctcagcctcccaaagtgctgggattacaggtgtgagccaccacggccagccagtgtcctccctcttatacagagttatatttgtgtgtttaaatagactgagtaatagttctcagagaatgttctggagacccatattccacagaatgctctgagcaaaagtggtcccagaaccagctgttacttactatacccctcctggaatactgtgaggctcagcatagtcaaaggctccgagaagccctgtgctaaggaaacccgttttgctttttcagtctgaggttttatgtttgctggatcatggagcccttttcttgcataatagcagtaaccaatacttattgaacatttagtacctgtcagacaatagttcataataaccccatgaagtcgtgatccattttacagatgaggaaacaaggttagagagattgcatgacacttattaaaatccatcagtgttacagaggcatttgtgaactacaaggaaatacctctattctggttaattccggctcaggatcacgggctgccagctgcatctgtcagcagtgttggggactatgaaatggaagggcgtggttatcctccatgaagtcaacttggaactgaaggatccagctcaggatagtccttgttttcctcacaaaatagagaaaaatagagaggtcccttctagaactccttatttctctaacctgctaaagaagttatttatactatctagcatgtacaacttcctggcataatgagttccacaagttcccttactacctgctgtgtggttttgcctgcagaaagtgctctgtgtgatgctcagttactccctgcctctcaccgccctacttgcaggctctgactggctgcctagatgtctgggtctgcccagctggggtgccctctttgtgggctgctgtttcctgacaatggcaagaggcagctctagggatggggaaatgatttgactactccccctgtttcttttattttcaactccactggaggggtgtgagcaaaacaagccaggagctgaggtgacggcgctgcccctggcaggggtgtgggagggcctcgtccctggtcctcctcgtttccacattgagtgccaaactcctgctgacactcctggggcagagcctttgttattccctaatactcatttccaaaatgccattggccacatatggactgtctctgtatgaaaaccaggcaacctgattccatgatccgtatggaaatcatcattagcagatcggaaacccaactgggtgtcagactcacctgagagagagctcttaaaatacagattcctggccagacacagtggtgcacgcctgcaacctcagcacttttgggaggagtgctttgagcccagaagttcaaaaccagcctgggcaacgtagtgagaccctgtgtctttaagaaaaaaatcttttaaatgaaaaaatacaacttcctaggctctgcccccagacttagcgagagtctctgcggcagaggcctgggaatacgcactgtcaaaagctccccaggtgattgtgatacaatgacttcatgtcctagatcttgagacccactgcccagtgccagtatggaggtgttgagttcaagttgataaataggctctttttggcccttcattagataaggtgttgtagttttcctgctgttgcttataattccatctgaaccattgtcctctttccttttaggtgaggagaattcgtgttgcaaactgcaataaacataaatcctgttcggagtgtttaacagccacagaccctcactgcggttggtgccattcgctacaaaggtatctcctgaattctttctcaccaactcgcatttttgaaaaagtgtcatgcggcagaacacttgttgccctactttaacgatccattccagtgacctgagggaactgatctcttcctcgactaaaatcttgttgtgcaatcctaatgaattctcgaaggtgtttccagcggcgtccgtgctatgcaatcactggacccgggagctccccagtctcggggcgggaggggcaggtgtgcagccttcaggagaacgggagagagcaggcaggtttggcttttactttctccagagttcgccaagactcaagagagaggcaaaagggccccccctccgagaagataaaagaatagagatgtctgaaaatttttcagctgaatccccatcatgtatgtcatgtattctgttcgctccgcagaagcctcgttattgatggcgccgtctcctaatgcgccgcgcagctgtgggcctgatgtacaatctcagtctccgggcagaatctgcccagcctggtctggaatgacgatgctcacgacccatctaggctcaggggcgactcggagcggcttccccgccatggcagtttcctagcgtcgctgggcccggcctggttggattcgccgtcgccatggcaacccagtactggggctcttgctggagaagcaaaggaggagagagccttcgctgcagctcaggcaggaaagagagagagagagagagaaaaaaaaacccataacagtgtctgtcagtttggtgctttcagtttttaaaggtgaaaaggataagaaagagcagagcaggtggagagatgctgaaggctgaaccaggggacagtttgggtttagaaaagagcaggaggaagagaattggtgactgaagggggagacagccaagagaaatgaagggagagggggaaatgcaatacaagcaagaggtttaggaaacaaatcaaaaatacggggatggaattaattaagagttcacgggggaaggcgcaatccgagctgcagcaagaggaataattgcccctgccatttgctacgcttccttaccgggctgtttccgtcagagtcactggcagacaaacgaagcaagggccagaaaaatgctcatgaataattcactgatcacgaacgggatttgtttgttgcacactcagtgagcagtcttgccataatcttttagatccattcatttatgtagcatccctgtctgtatttgtagagctgtgtacaggagtcaattcgataatggtggcgatgatggtggtgattaaatagccacatggagctagcggctaacgtattaacaagctcagctctggagcttttgggagatctccaagctggtgatatgaatttgggagttggtagtattttagatggtacttagagaagccttaagaccagacgaaggagtgagtgttgattgaggagagaagtttgagaactgggccttgaggggctgtggtgtttaggggttggggagaaggaggggaaacagaacaagaaataaggagggagcagtcagaaggggaagaggaaaaactggagagggtggtctcctggaagccaaggaaagaaaggaggaggaagtgatccactgggtcagattcagctgagaggtcaagcaggagaagaaaagaatggatcctttgcacttagcaggtgacaatgggtgactgctgggaatgccatggttaggagtggcgctaaatccacaagagacaatgggaaaataagaccttaagaagggacagcttagagaagctttactgagaaaggcagctgaaaaaaatgaagcagacactgaaagcgaaagtagagtccaaagaattttgtctttttgtcctttttttttttttttttgagatggactctggctttgtctcccaggctggggtgcagtggcatgatcttggctcactgcaacctccacctcccaggttcaagccgattctcctgccgcagcctcccgagtagctgggattaccggtacgtgccaccatgcccgactaatttttgtatttttagtagagatggggtttcaccatgttggccaggttggtctcgaactcctgacctcaggtgatccgcctgcctcagcctcccaaattgccaggattacagccgtgagccaccacgcccagccagttttgtctttttaagatgcatgaaataacagtgcatgtctgcactgttgggaaaattccagaagagaaggagaaatggatgatacaggagagagaagggttgtggagtgttcagtctttcagcaggtggaagaaaatatgacttggtgtgccagtagggaggccagcctcagacaggagcactggcccctcaccctcagtggtaggagggaaggtagggactctgggcccaagcatggggaggtggcagaggcctgtgtggtgtcttctcctattgctcacattattttcagtggcctacggccattgagaatgaggtgagggaggaagcactggaggtttgaggagaaaagagagagaaggagtggactggaagactaggagggagaatagaatagggaaatatcgagcggttgccaggaagcattagggcccacttgaggttgatggtcctgtgtttgaagtgagagctgtaagcatggttttgtctttctcaagctgcgttcagctttggtggtatagctgtagactcagaaaaagttagctttagccagtttgggggctttgccggaaaatacatcaagaaaggagagagtggccagggagctgagggagcatgtaaggaatggatgatgatatcgatatggatgttgattcatataatgatggcacttgggctctaaggagggaaataaggacctgataggggtagggatgtgaaaaggtggcagggtctgtgttggaagttcaagttgagtttaaagattgttaggggcaggcgcggtgactcacacctatattcccagctttttgggaggccaaagtgggtggatcacttgagcccaagagtttgagaccagcctgggcaacatggcaaagaccccatctctacaaaaaatatgaacattagctgagtgtggtggtatgtgcttctggtcccagctactcgggaggttaaggtgggaggcttgcttgagtcccagaggtagaagttgcagtgagctgagatcacacctctactttccagcttggatgacaaagtgagaccctgtctcaaaaaaaaaaaaaattgttggaactagagaattggaaaggggaattattggactgtgggggcttgatattgaggtcatggagggatggagttattggcaatgacagggtctgccatatgattgtcaagatcattggcagagaggtgtcaaggaactgaggtggttaccagagtactaaatggctccatcatctgtgtggaaatcgcagtcaccaagagagtgaggagctacatattcaaggaacgaagggaagtggccagggctggggtggtctgtaatgatcacaatgaggagggacctggggtggtttgagctgacagcatgggctttgaagctggggaggaagtgttggaaagagagaagaaggatcttccagaagaggctgcaagacacaaataggacagctagatgagggagaggaagcagccaggccttgagaggggcctggggaagctgtggcctcgaaggagagctggtttcagtaatattgagaaggggaaaggaacaatcagagaagaggttgaagacatgggggcttctgttgataactggctgtgagttatagtcttttgtttgttttgagacagggtctcatcctgtcacccaggctggagtgcagtggtgcaattacagctcactaaagcctagacctccccaggctcaggtgatccttccactgcagtctcccaagtagtggggaccacaggtgtgcaccaccatgcccaggttttttttgtattttgtagagacggggtttcaccatgttgcccaggctggtcttgaactcctgggctcaagcaatcctccttcctgggcctcccaaagtgttagaattagagacgtgggccaccacacctggccaaaagcctgcttctgctcttgctccctcacccctatcccagtgcgctccaagaagagtgattcatttaaaatccaaatcagattatgtcactccccagcttaataccctcccctggctttccatcttagaactcagtctgactcccttgctgccagggcctgcataccaggctttccgtgatctggcctttcaccacttctctgacctctcatgccattctctcctttgtttacttaaccccagacatcctgatttaagactatgctaagcatgttcctgccccagggcctttgcatgtgctgtttcctcagtctagtacattcttccccacatctttctatggcagactctttcttgacggtctggtcctagagcacacatctctctgcacctgcctacccagtcttcagtagcctccccttactcacagtgacattactgttttattttcttcatggcccatcactattaggaatgaccttacttctctacctctctttattgaaatgtgctcagaaaaacataagttaaatgaatgagataggctgagtgattggtcgactctgccaatagcaggttaagacttgtgccttaaatcttataagacattctgaagtcatggagcgatggcccttcacagccatgtcagaaaccacttggtttcagacagcctgggttctggcctacaatgaaatgaaactaagtctcatatctgtgactcatatgaagctcccagtaccattcaaaattaggaattctaaagggggatgttttcttataatggtagagcatcccactgtgtttattttaaatgtcatggatttatttagaaaaataatttattttctctgttgagaaggttgagttttcttgcatacatgtctagaaagtggaatggtggggagaggcaagaaaactatcttcacttccttttgatcagatgttaagaataggcatccagactgggcatggtggctcacgcctgtaatcccagcactttgggaggctgaggtaggtggatcacctgagatcaagagttcaacaccagcctggccaacatggtgaaaccctgtctctactaaaaatacaaaaattagccaggtgtggtggtgcatgcctgtaatcccagcaacacgggaggctgaggcagtagaatcacttgaacccaggagacggaggttgcagtgagccaagatccagcctgggtgacagagtgaaactccatctcaaaaaaaaaaagggaataggcatctagtataagtagataaaaagcaattagataaacaatgagctctaaaaagtctagtattttattgttggaacctcagatccaacctgtgctgaatttgtctgtgtgggtggaaagtgaatttttgcaggctgaatatcttgggtttggaagcagtttctcagtttctcccatattgcaaagcatagcacatgtgttcagttatggatttccacaaaactggcaatcccgaaccaatgaatgggtgaggttccaaaagttcatttgcaagtttgtttggcatgcagaatgcattttcccatagaaacaatgtcataaattaaggattgattcccaagccagcccataaaatccaaaattatttaatttcaacaaatatttattgaacacctagtgagagcctaatctggggcatgagatagctaggtagtattgagagaaatcggatgccattcttggctttaaggaactcgcatgctagctgggaaggcagacttatcaatggccaacattcattcattcaatcctacatccaatcacaaatattttttaagcacaacaatgtgctaagtcctatgctcagtgctcaggatacagttctttcttgtctctatagagcttgcaatctaatgggggatataatgtgtatcagttaggtttctgatctagtaatgctgtataacaaacaacccccaaatccttagtggtctaaaagagcaaacatttatttacatttgtttttcatgctcatgggtcagcctgtcagctatgggaagaagggtggggtcaatgtcaagctgaaggttgagttcaggtctgtttcccatgtttctcattctgtacatgctcttcttaaggcacatagaagtagcatgagagaccaagctaaactagacaacatgttctaagccctggctgacatcatgctgactaatattccattgataaagcaagctgcatggccaagcccaatatccatggagtagggaaatatattccacctactctagtggaagattctgcaaagtgacctggcaaaaatgtagtgtgggtgtgtcattctagtacaggatggattgaagaattgggagcaataatccactcttatcaataagtaaaggagataaatgaatagagtgtcataagagctagcatgggggaagtttagggtttcatgggggcacataaaattatctaacccaaacttaacaggtcaaggaaggcttcctggaggaagggatatctaatctgaacctgaagggtagggggatatcagctaggtaaagatgaggcaggggaagctggtgtagggaccaggctgtacaaaggccaggagagcttggcctgaagctcagtgtggacgagcttcacattaaagaatttgaattttgttggaaggaccttggggagccattgcagggctttaattaaaagtgcgaccagatcaggtgagtgttttagaacgagaactctggggtgcaaggtggaccggaggggactgagaagagctggcagatcagttagcaggtggctgtaaaccagtaagagaccagggactgaattagaatgatagtagtggtgagggaaggaagtgggtggattagagagctatttagaagatagaattgacagggcttagtgattaattagattcccctttgagtctgacacactaaaaatagggccataaaatgaaaaataaaatctcaaggtggccactgtttttctggaagatgtatcctttctcctttgatctcagtcttcatgaagaaaacaaacaagtgatacccacatgtacacttgattcttcctgtgtcccaggcactgggctaggcaccaggttagaccccaaaagatgggcacctgagtcaaatgtgggagggcttctgagagacaccagcgctgagtctcagagtgtgcagtggggtgagttattgcattgaagctggtgttgagattacagcggaaggagtgcaggcatctggctggggtgaccagatggacagaggtgtcggttactgagtagggagtgtagaaggagtggcctgtttgggctgcatgggaaacgcggggggtggacttccacactggcaacatgggcaggacagcctatgaggacagaggaaaggtcctgtgtttgtctgtttttgcactgctataatgaaatacctgagactgggtaatttataaagaaaagaggttagttggctcatggttctgctggctgtacaggaagcacgatactggcatctgctcagcttctggggaggcctcaggaaacttacaatcatggcagaaggtgaagggaaagcagggcacgtcttacatggctggaacaggaggaaaggggggttggggaggtgccacacacttttaaacaaccagatctcaagagaactcaccatcacgaaaacagcactgaggaaatggtgctaaaccattcatgaaggacccacccccatgatccaatcacctttcaccaggccccacctccaacactgaggattacaattgaacatgagatttgggtggagacacagatccaaacgatatcaggtcccaaatgcattttgctttggatagaatctgggctttgtgtgacctgccagtttcttatctctgccacttctcctcttctataaagtggcatttataattggccaggtattgcaaaaaagtgctgggattacaggcacataatcctgggattacaggcactttgggaggccgagttgggtgaatcacttgagcccaggagttcaagaccagcctgggcaacatggtgaaaccctgtctctacaaaaaatacaaaaattagctgggtgtggtggcgcatgcctgtggtcccagctactctggaggctgaggtggaaggatcatttgaacataggaggttgaggcttcagtgagccgtgattgtaccactgcactccagccttggtgacagaacgagaccttgtctcaataataatagtaatagtacctgcctcagaggtttgctgagagaattaaattccataacgtacatcattgtaggcccagtgcctggctcctggtaggcaacgaagttgtgtcaactgtcatttggtggaagcccaaggaggcagtcattacttgtccctgaggttgggaaaggcttcaacgaggaggtggccttaaaattggccttgaagcctgggtagaccttcaccaggggaagagtggtcgggaggcatttcaggcagaagaatcagcgcagtgagaggtctgtggagagactggcagatggagttctatgcactggctgtagaaggaaggaagtgggtggagatgctgggtgggctctcagggtggaccttactagcgggtgctgggaactcatgacagggttttaagcagaggccttccagcgccatatttgtgttttaaaaagattatcccactggcagtgtggaagatgaaccacgttaatccaagtctctcccggcctcccaccccacccttcctgggtcactttcctctggtgtgttttgtaaagagagagtttatgtcacatctcgtcctgagtcagttacttggtggctattctccgaattcatgtacctccccactgggagaggtagtacgtctcccagtgcatccatggggccccacttgctctggttttagtgccatgatggaatcagggctgggtcctcttcagaaaatgggccctacaggaaagagcacacttgcattcaccctcccaacacttcgtgctccaccctgcactgggtacacacaggtggaggcaaggcccccaggcatgctgcttataaggtatctgtatgcgtccttcaattatctgtacaaatttcacattcactccatatttttctacatgtttcttccatgttgacagttggaagaccttcaagcagcccctggtggctgtttttaggtcttcagctgcagttaggctgttccacgcatgagatcgtgaaagagatcatttctcgctcggtctaacagcagggccctgtggtcagtcttcctatcagactttctgaagggttgggaataacagaagggtatttttaacacatgagagaaaactgccatctgaatgctaaacatatttgtccccaacaccccagagtaacaaatgaaaagaattacatgagttgcttgtggacacgtcccagctcctttttttatcttgctctcctgtcttgagggttcttctccaagtgacactccttcctcaagccccccaggcctatcattaacctgctgggatccttcccaccaggactgtgattgccctgaaacttgaccagtataatccatggtgcacagtaatttatggccatattcttcagtagcctgagttagtctgttctgtcatcatgagaggtgagctacatacagcagagagggcccgatagggcttagatgttttgtctcctccaaatctcgtgttgaaatgtgacctccagtactggaggtgggcctgctgggaggggtcgggtcatgggaacggatccctcatgaatggcttggtgctgtccttggcaatagtgagcgagttctcactctgagttcacaggagatctggttgtttaagagagtgtggcacctgccccctcacagtcttgctcccaccctagccgtgtgacacacctgttctcccttcgcttccagcatgattggaagcttcctgagcccctcaccaggagcagacactacccatgcttcctgtacagcctgtaaaatcatgagccaattaaaccccttttctttataaattatccagtctcaggtatttcttcatagctatgcaaaaaatggactaacacagggtcacagaaggctttgcagtagaaaagtccagatggatgtgactgttcctcattcagaaggcggctgcagtgccccttccacagggagcctgcctcgagtccaggcctggccaggagacagtgtgcatgggtagagaagaatatgcttatcatacattagacactaccttgcacgttctgtgccatgttccatttagtcctcctggtaccccatgaagaaagcactattacaatccccacttcttagagaacagccttagcttatgtatagtttcccacagctgcagaaacaaattcccacaaacttggcagcttaaaacaacatgcacttgtgatcttacagttctggaggtcacaagcctgcagtgggtttcactgggctgaaaccaaagcattgacagggctgtgctccttctggaggcccttctttgccttttccagcttttggaagcagccagcattccttggctcatggtcccttcctgcatcttcaaaaccaacagtgtggcatcatcagattacattgggcccacccagataatccaaaataatctgcccattttaagatcctccacttactcacatctgcagagtcccctttgccatgtcctatggtttgaatgtatcccccaaagttcatgtattggacacttaatccccagtgcaacagttttgagaggtggaacctttcggacgtgattaggtcatgaggactctgtcctcatgaatggattaatgacattatcacaggagtgggttagttattgcaggagtgggttacttatcacaggagtaggttcctgataaaatgatacattaggcccctttctctctctctctctctctctctgtctctctctccctcgtgctttcttgcccttccaccatggaatgatgcagcaagaaggccctcaccagatgcaggccccttgaccctggactgcccagtctctagaactgtaaaaaataaatttattttctttataaatttcccagttagtagtattctgtaatagcaacacaaaatggactgagacaccatgtaaggtgacacagtcacacattccagggattaggacctggacatctttgggggccattattctgcctactactggttgtacaagtaatggattcaactctgggcttagctctagctcctaagccattagagcaaaacaaagagacacaggcaagggacattatccctcatggcagtgggtggagaggggagagcctggagcaaatggccctaatggagcatttgtgataactgctatgtataagaaagacacggcactcagggcccacctgagtcagagaaaaccctccatcttgaaagcttaggcaaccatgcattcatttaacaggtatttactgagtacctgatatgtgtcagtcactgtcctaagcactgggattctaagcactagcagtgagtaacacaggtcaaaatccctccacacgtatgttcattgcagcactattcacattagcaaagacatggaatcaacccaaatgcccatccatgatagactggataaagaaaatgtggtacatatgtgccatggaatgaaaaggaatgagcagccatgaaaaggaatgagatcatgtccttttggggatgtggatggagctggaagccattatcctcagcaaactaacgcaggaacagaaaaccaaataccgcatgttctcacttataggtgggaggtgaacaatgagaacacatggacacagggaggggacaacacacataggctcagctaatgcaagctgagcttaatacctagttgatgagttgataggtgcagcaaaccaccctggcacacatttgcctatgtaacaaacctacacatcctgcacatgtaccctggaacttaaaatgaaaataaaaattgaaaaaaaaatccctgccctcatggagttccctctagtgaggtgttttagtttcccaaggctgccataacaaattactaccaacacaaatttatcgtctcccagttctggaggccagaagtctgaaatcaaggtgtcagcagagccgggctccctctggaggctataggggcaaatccttcctcacctctcccagctccgggtgactcctggtgtttcttggcttggggtaggataaccatctctgccttggtcttcacatgaccttcttctgtgtgtccaaatctccctctcctttctcctagaaaattcccattcactgggacaccctaaatccaggatgatttcatctcgacgtccttaactctttacatctacaaagaccctatttctacataaggtcacgttctgaggttctgatgggcacgaatttgggggaacactctttaacgcacaacatgagggaagatggacagtgtgaaaataaatgaggaaagagagaacatgtcacagagtaaacagggctgtgaaggaaaataaagcagaaaaaggaaatggggagcgctagttggaggcagggggcgctaaatttaaacgggagccctggaaggcctcagtgagaaggggcatctgagccaagacccaaagggacccactcagttttggggctatccgccttcatgggctattgcactattgagtggaatggccgacaatttgagacagaagagccttcctcctttccttccaatccgggatgtgtccttgtgcagatctcaagcttgacgtctgtgcggtgacacttctttatggtccagtgaggctctaatgacagcaataatgataatggaattggggatggcccctccttctcgtgtgaggaccccattgtgccgactaattgtgtagaagcaagtaggacaactgtctgtggggtggaagcggtggggagcaaagaggaatatgtcctttgggcctcagggaattactgaattaccgttgtgtgggctgagtccatgcatctgggttactgtgaatgctggaagggatttggggggctttccaacaccagaaggggtctgggggtcaacctgtgtcctgtgggttctctacctcctttttcagctgtgagaggagctatgagttctatgtatttcaaagcagaaggcaaaggggatagcagtgctaaggggcacctctccacccttggtgtcccagacagttggcactgggaaagtgctcgccatgctcagaagccaggcttttttgtttgtttgtttgtttggttggttggtttttttagatggagtctcattctgttgtcaggctggagtgcaatggcacaatctcggctcactgcaacctccacctcccaggtccaaatgattcttctgcctcagcctcctgagaagctgggactgactacaggcgcgtgccaccatgctcgcctaatttttgtatttttagtagagatggggtttcaccatgttggccagtatggtctctatctcttgacctcgtgatccccctaccttggcctcccaaactgctgggattacaggcgtgagccaccatgcccagccaggtttgttttttgtttagtggagctagtaactgacgttctcggacctcagcctccgtgctacttacctgcaccatctctaatggatgctctctgacttccaacaagcaccattaagaacatcccttttagtaaatatatgttgtaatggaatagatttttttgaaatgaccttatctcaggcagcatgcactttcataagaatgtattgattggcctttaaatattcctcaaatgttttcacttgtctctgtgacctaatatttgtcctgttcccagcatctcctccatatccaaacacaatgttcaggtcttcattcgaagccttcctgccagtcttttgttttttgctttttaaacattttgatgcttttattctgctatatggagggtgcactgtttctgataggccaaatgtgggatttgatattgctttcaggaggatcgggttttaatatcattgccacctgtttagtggtggagaaactgaggcccacagaggctaaggaatgtggcccccagttacacagggagtatatgggagagcagctttgaacccagacccttctgactcaagaggtgtcattttcccatttttatttccatgctgctgtttttttaaatggctcccctaaattatttagttcatggtttgcatttggaaataaacaccaacttttagtacactcattgcccacaaaagaaccacatggagcaaaggccacaaacccattttgtgtgagtgtttcagtctgcaaatgtgttttttatgtgctaaatagctcaaagtttcaagacaaaggctgtttttccaccacgccagtgaacaggccaacctagtgaacaaaaatcaatgaaatgacttctgctggtatcactgaaacacagacaagaatttagccattttaaaatttccttgttaatccaattcagctaccttttgttgaatcccagccatgggccaagtcctgtactaggccctgggggaaacaaagatgaatgagggtctactctgatgaagttcacaggtgagtgtgggaataatttcaatacactgtgtaaaatgctctaatagctggtactcaaggtatgaaaggactccaaagaaccctttaatatttaggaggaaacagagctgtgattaagaatcccccaagaagcctcgaattgtgtctgcctccttacatagaaaaggcatgttgggcattgagctggtgtgtgagcaatgccaaagggcatctggtcaacctcattgcccaaatccctttctcatcactaccattttgtctttggcttatgtcatccatttttttgcctaaattttctgttccattttcccatataatataataataataatgaatatttattgaggcataattgtaaactcttagaacagatgtacatttttctcccaacttcatcaggtgaaaactattatttgcatttctgcagatggagagcctgaaacacagagagggcacatgtcttgcttgaggtcaccagcttgcaaatggcacaaccactatcctccttccttcactaagttctagccaagctggtctatttcatcagttccttgcagagaccatgctttaagtgcactcagatactttgcacatgctgttccttctgcctggactgctcttcccactacttttttttttttttttttttttttttttttttttttttgagacagagtcttgctctgtcacccaggctggagtgcagtggcatgatctcgactcactgcaggctctgcctccagttcaagcaattctcgtgcctcagcttcccgagtagctgggattacaggaatgcaccacctcgcccagctaattttttgtatttttattagagacagggtttcaccaggttggccaggatggtcttgagctcctggcctcaagtgatctggcctcccaaagtgctgggattacaggcataagccactagcactggcctcttcctactactcttgacccgactacatggttctcacccttgaatgcttagctgaaatgccatctttcttcactagcctgtctaaagtgggttcctttctactatatctttggtttctgcagaagacgtacctcaatttgaaattattttaaatgattgtctgtttatttggtttttgtctatgtgcttctctggactgtaagctcaataagagaaggaacttaactggcttatccatggaagtgtctgcagttcctagtggagtgtttggcatctgatgggctctcagttaatatttgtagaatgaatgccaggtatggtcttaggccctgagggtgcaaaggtgaataaggtgggcctttccctttgggggatttacagtgtagctggagagacaggcaggcaatcagcaactaatgcagtatgctgtgtagagtaggagcatgtgtaaatgtcatggagacacagaggagggagtgactgctttgcctggagtctgagcaaacatcatagaggaagacactgaaatagcccttgaacaaggaatgtgatttcaccaagtgttgcaggcccaggcacgttcagggcagtgaggatggcacacgctcgggagggcctggcctgtttgccctgtatgtgtttatcaaatgcctgctctccacgaggcactatggaatagataccagggatgggtgtttttaggagcttgcagtctagagagatagactcatcaaccaaacttacctggggatgagtttgaagaggaaggcaggggccagatcacagtgttggggtcagagatgggcatggaaacatgtattgcagactgaggtgctgaaaggcatgtagacaggagagtctggtatgggagaaagggtgtcatgagagatttttaagcagggagtaacatcatcagctctgtgcgtaagagtaacccagatgttgatgtggaggttgatgagaggaacaggaagtgggaagcgggagacctcatttggctgctgcaggaacccaggtgagaggtggggggtaagcatgggttgtagaggatgcttagaattcgtttgggtacaagagttacccaaactagccaaagtaggcacaaagttttgtaatttgatccgccgtgaggattattgctcattaaaccagaccaggtagtggttcccaacatgtgtgactagaatttctcatccctcagaacatccttcaacaaaaaagctggaagatggtacatcattcattcttgtctcagaaagttacaaagcacagtggcatctacaaggctctgagaagtcctgcagcagagagacttgtttaattttatttaactagtgtttcccaagcttcttggcaatagaaccctactttaatattaacaccaaaacaaatccaggaacacagtttgaaaaatgctgagaaattgagtaaaacttgtattttcctatatgttcatgtcttggaagaatctacttgctattatgctggcatttgtgatgtcgctgccctggaagccttcaaaatttttgagcaattaggtgtagtagtaagagatagatgccagtgccagacaccatgctaactaacctctctgcacctccgtttctcaacctctgacatggaggtggtaacaataacacctacttcatgggctggttgtgaggattactgtgttaattcccagaagtccccagaaacagtgcctggcctatgggcactaggaaggtgcgatggtttgaaaatgtcacctaaaaagcgtgtgttgggaatttaatccccaatgcaactctgttgaaaggtgggacctagtgagaggtgtttaggtcatgagggctctgcctttgtgaatggattaatgccaatcatagaagggcttcaggctgcaaattcagtctctttctcttgttcacatgcgcatgccctcgctctctcttgctcttccacctcctgccatgggatgattcagcaataaggccctcgccagatgcaggcccctcgaccttggactctccagcctccagaactgtaaaaaataaatttcttgtctttataaattacccagtctgtggtattctattatagcaacacaaaacagactaagacagatgggctcagtcactattagctattctgagaggcaatataggtagctgatgagaccacaggctttgaggctacactgcctgacttagtaggtcagctcctctgcttactatccctgtgaccttaggaaagcaatatggaaccagctatgcctcagtttcccacatctgtgaagcagggacaattattgcagctacttagaggtttgttgtgaataataaatgaatcaaatcatgtgaaaagacatcgcctggcatgttagatgtttttgcttaaaaaaaatcttttaattgtctctgttattagcataattttatcatgtagactgactttcagcttcagtgatgaagatccaatttttgagctttcccagcaagttattttggtcttatgttttggcattcccctcttaaagagtctggaggcctttcatttgaagtttagtttgtcacagacttcctattctcgtccattcagtagactttggtttcctcatctcatggactggcaattgtaaagaaagtcccccgattctggagaccacctcgcccctccactgggctctgtgccttccctaaaaatgcagacatctgtttcaaatcacttagcaaaagaccttgggttgctcttatagcaaagccctcccccagcatggatgcagtctcttgtttcctgggagagagagaagctggattgtttccttgttaaaagttttctgatattatatcagtgtagaatctttggaacagttcacactaacccccacattcaagccacttacctgatatgtagttatcagattccttcagggactgtctgctcttggtgaacaattagattagaggatgctgatgaaatttgagtggcaggaagtagaagttacatttctgagttcagagtttctatttcaaggttgagtaagtggtaaatttttactgcaagattctagcctaacagagttggcttctcaaggtcccccagcccggcccatgggtatttcacctgcttggaaacttcagctccttttcagaggtgggcctccctgttctttatgttggcatgaaaacaattaataatttaagccatgcccattaaaaaaatagaaatgctgtataaatacaatactgtaataataaatttaaaagtcgatccagctgggcgctgttcccacactaccagctgagcagaaacacaaataagtaaagaagaaaactgctatataatgcaaatggctgcaatctcattgttttctgctattgtttattgcaaatatatagtagtaaagttacattatggataagtaggttttgtgggctaacctggaaacctaatcactgtttataacattatttctatgggggaaaaatgcattttatattagaaacagatggtttgcaagaaaacctttttgggagtagaatggatttctaagtccagggccgcctgaaattttaacctcttgctagttgtgtggttgtgttgtattcacagctagtgatagaggaaaattagaggcctctcagaatgcccacttctgtgttctcccccaaatccttgctaaccgcttcatcctacagtctctgccttaccttctgtcttctctgtttctggggtccccatccctgtgtcctcatcctggcccagctccaccctgcaaccactggttgaggtcccaggaagccaggaggaactatgaatgtcctctattaagtggtggttaggatctataggaaggcatgaagccagggggccaagtttgtgggctctgaaatcagacttctgccacttggcagctatgtggccttgatatgttactgtacttctctgagcttctgtttcatccgtaaagagtgaggttgttgtgagaactaactgcaaacactcccatcagtgcctggcacacagtaatgtttcctccatgccagtctgtggtggggtaattattcagggatattatgggttacacatatttctatgaacccaggaagcaaacccactgtatataaagactttctaagttttcaaacagtgaacttagaaacaagtgtctgggaccttcctgtttatgacttggggccggagtaggtttggaactttttttttttttaaatctgttgggggtgagggagggggcggttacatacttatatagttgaatgccaatatcaaactctagtattatctcgaatacattaagctctacagcagattttatagcaaactaacaagaacagctttcttaaatagtttcattgactgaattgtttctacatacagtgtttttcacataagggaagtctttttaaattaactttttggtttgggggatttttttttttttccttcaggcaatcttttctttgcatttgggcaggttctgtattctaatttgcaaataggcttgtgtctgcctgcaggctttatcatgaaagtattagctctaagtggaaataaggactagaaaaataaaatactgactgggagtctgaggactttgggatagatcctcagtagaggatggagcaaaagtaatagtaagtcaagaaagcaaatatatctctaccagtttccctagaatatgtccattcttatccaaatccaattttcctcctattcttggcctgaagaaattgaaatgaagccattaagatatcagcctatctgagagtgcatcactgaagaatcagcctcactaagagtcctgtgtgacaatgagattttaatttaattagggcagtggctcaagtgtttatgcacttgaccgttgctcttgttgatacgcaggaattagagtgatagctttcaaaaggaattatttcagagtaactagctttgtttactaaaatatgggagctataagatctgctctgtaagaaatgtaaatgtatgagtaatatgctgtcatgaagattttataatctgcagtatttgagaagtaataagatactgttgttggctggccatctggttatacatacttggtgtcatggtttgctttttattttttcattttttatttgtactggtgagaggcaaagaataggagttcagaggtggtgggttgtttttttatatatatataaaaacaaggaatttatgtttagttgcttaacatggttagattttgtttttgccttatgcagaataaaaaatgaaaggttcattttatactttcttttccctttttttttcaaaaagtaaaatggaaacctcacccccaatttgtccccagatttaaactttttgcttgttttaaaaatagtctctttggcatgaggaggagtcagacatgaattaaaactctagaaagaaaaatcagcaacagaaaagacctatagagatttcatatttcatcctttcattcaaaaatatttattgaaaccctagtatttgcatatcatgctgccagacactgagggatttgctaaagaaatattaaagaccttctcccttctttgaggagcttagagcttacttggggagaactgagatagacttatgaaatagttaagttgtaattcgaggcagcatatgattaaataccgaaatatgtacttctgacaagaaatgctataggagttcagaaaagggagtgataactcagtggcactactgttttctgcctacaaattggcaaattgtagcactatttgtatgaaatattttacacttgtttttttggcagccttaggctttgactcccaggcagcattaagagccaacaaaaatatttgtactccagtctcttcggaattggcttatttttttttttcttataggcagaggaagtgccttacacaaaccggagtgcccatgagaggcagggagtttttgacagtcatgatctatttcagatacaaccgaaagaaccagcttcgtcattctgtttttcaatccagcagtgcttgtctctccgttgcaaactctctctgacattgacaggcggtttaatttgaacttaatgtctttgacggatgagctagccatcaagggtcagataaatttatggctttggagaattgccgatgaaaatccccatggttataatgttggagaagaaactgacacagatgtagtgggaggtggaacacagatgtgcttattgggagcagggttccccaaatgtcagaagccggtgacatgctaaaggtattgtgcttggggatgacgtttagtgaaactcactgacttcctgttctatttttgccatattcaaattaacacagagctcaaagatgaagccatgaggcctaaattcttaagaattgaaagagagagagagtagagaaaggagaaaaaataaaacctttaggaagccaaatacactgtttgggcccatccattcctcattccgctcggatcccctccgggactccccgtagctgaatgtggtcatcatttggttgcttttcaatctcatgattcatgtgttttcagtttcttttaaaaattcaccatcactggtttaccacccctgcattttaatcttcagccttgaggaggtgtagtactagaaatatttcgttctttccttgatgctattcaatggaatatctgtggagtccaacaccctttggcgataacgtgctgttggtatttgttcttcttgccaggttggtgccccgtctggtgaggcaagggttcccaagttagtgtgacctagagtgactgacacatcaagcaagccagtgatctcaccactcagcttctgagcatctctttatcaaagtagttggccctggccacagcttaagacttatctgggtcagcctctgagctggctgacttgggaaaatggccctggaaaaatgtttcacctatatcttttgatataatttggtatctgtctaaataaatggtatgtagcagatggttatggaatgtcttatcaaattcttaggcagactctgcccttgaaatttttctatttaattatcatactgcaaagcacaaaatagtaactttgttattatttttaaacaaaatcaagttacacaataggttgatattctgagaatgaatagcaaacctaaaatttatacaatatgtgaactcttccttgagctgttctttgctaggcatttctaaaagggagctccctatttcagaatccatgggaggatgtgtttcagatatatttggcgatgtcatcttgagagatggctcaggagtcgaagttcaccatgttgtctacatttgttctttgctcctagacatgatggaaaaaaatgctctgctgttttcttgttgcttttcatggttttagcatcatgttcctattctcgctcaaatcaataatccactgtacaaggtctggcattttgtactgaagccaagtataagaaagttttaactaatgcacgtatggggtcgctgttttaactaacacacgtatggggtcgctgttttgttgcctcgtttttttaggtgcacttttcaaggagattgtgtacattcagagaacttagaaaactggctggatatttcgtctggagcaaaaaagtgccctaaaattcagataattcgaagcagtaaagaaaaggtaagaggaaagattttaatttgtcctcgttgtattgtctcattttgcacagcggatgctaaatttcttctgtgtgtaaaatatccattagcaatcaaacatgcttagtgatagcactccattcatttagcactcattaacgaatattgagtgcccaccagatgccatccactctgcaaggtgctggggatacagcggtaaccaagtcacatcatgggcctgctctcatggagtttgtcgtcttgtggagctgaagatgaccctcaatggttgaactggaagaaaagttggacttctaatgttgtagaaatacatattgcttttgaaaataaagaaaaaagaggttcagattcatggtcaacgagataccttaaaggtggcttaattgcagaattttgtttagtgtaatggtcccttatcctaatgtgttgaggcttccccagtaaccatcttatgaacatagcttccaacagtcttggtagcgatggagagaagaccaacatgggcagtgaccattgcaagtgaggtcctttggaaagccagtggacccttgctatggcagcaccactcttgacaacacatcagtcctgtcattggatgagagaagggagcaaggagcatatttaagcattttcaaatgcacacgccaaccgtgccctacggaaaaagggaattcctgccttgcagtctcagtggtgctataaggaggcattttctccctaatgacggctcttgtgttatgaataattgtacagagtcctctgttatgaataactgtacagcagccagctgacctgtctgttgagctcactgtgttctgtttgaatgccatattaacaaggaaatgggccactttctcttttcccttacactttgccatttcagagaaatagcaagaactttaccacttacgatgatttaacatttaataaaggagagccaaagtatttaatgagtgataaataataaaataatcaagcttctaagttgtaactgatcagaacgaacagatttaaagttatttggctgttgtcactttctgttgtcttcctggagaaaaaaaataataataataactttcatacaaacttctaccagtcctgaatcagagtgaatagatttggtggaaaagattcttaggcatctaaacataggtatatccaaattctaatttctctcatcagtctgaaaaatagccaaatttggcgctaatagagaatagtagaaagtagaataccataatccttgaatatacccaggactctgataagtggttaaaattctggaagattttttttcttatgttatttataaaaatttaaggataatacttcagctaaatgtagtgggaggaagtagcttgttcattaaattaaaagtgctgcttatacaacttccgtacctagctaggggctcactattacaaattaatcactgtttatatctggtctggtacatttcaaaactgcttaccacccaaacgaccactggtgttttcttcctcgccctaagtcccactgtggtttaccctaatcttcccagagacttcccacacagccactgcctcactctctccagctcaccaccactctcaaagaagataagaagttcgtaatttgactaaagctatcctttgaaaccaacttcggactaattattttaatagtgttgataagccatctgattctatctcttgatcacattatttcaaaatatttcctaccctattgccacctttggcttacctgaaaatctcaggtctttgtttaaataaacctgaccctgacctatggagacggcagtctagggttgtgttcagttccacctattagctctattcaaaggctatttgctacctgcctatcatatgcctagtaacattctagtcactttgtaggcagagaaaaacctccatataataagaacctctgttcacagaagctttatttctttccacaaaacaattaaaagatagtacatcctcatactcactatgggatcagcattaaaaagaaataatcagagcaattccagttgtcctggagggatttctgtgaggttttgttgagtaaaaacagcaagatgcataaaagtgttcctagcatgatcttatattgatcaaaaaatgcccctgtatatgtttatgtatatatgtctctatatgattatttgagcatgggcaaaaatatagaagaattcaaacaaggttgtaaacatgggctcccctggtggaatgactgatgtggtggagaaggaaagcagagatatgtaataaaaatagaaaagacggccgggcgcggtggctcacgcctgtaatcccagcacgttgggaggccgaggcgggcggatcacgaggtcaggagatcgagaccaccccggctaaaacggtgaaaccccgtctctactaaaaatacaaaaaattagccgggcgtggtggcgggcgcctgtagtcccagctacttgggaggctgaggcaggagaatggcgtgaacccgggaggcggagcttgcagtgagccgagatcccgccactgctctccagcctgggcgacagagcgagactccgtctcaaaaaaaaaaaaaaaaaaaaaaaaatagaaaagacacagaaataaaattattattgttattatttattatactttaagttctagggtacatgtgcacaacgtgcagttttgttacataggtatacatgtgccatgttggtttgctgcacccatcagctcgtcatttacattaggtatttctcctaatgttatccctcccccagccccccaccccccggcaggccccggtgtgtgatgttccccgccctgtgaccaagtgatctcattgttcagttcccacctgtgagtgagaacatgtggtgtttggttttctgtctttgtgatagtttgctgagaatgatggtttccagtttcatccatgtccctgcaaaggacatgaactcatcttttttatggctgcatagtattccatggtgtataggtgccacattttcttttcttttcttttctttttttttttttttgagatggagtctcgctctgtcgcccaggctggagtgcagtggcacgatcttggctcactgcaagctccgcctcccaggttcatgccattctcctgcctcagcctcccaagtagctgggactacaggcgcccaccactacacccggctaattttttgtatttttagtagagatggggtttcaccgtgttggccaagatggtctcaatctcctgacctcgtgatctgcccgccttggcctcccaaagtgctgggattacaggcgtgagccaccgtgcccggcctacgtgccacatttccttaatccagtctatcatggatggacatttgggttggttccaagtctttgctatggtgaatagtgctgcaatatacttacatgtgcatgtgtctttatagtagcatgatttataatcctttgggtatatatccagtaatgggatttgctgggtcaaatgatatttctagttctagatccttgagggattgccacactgtcttccacaatggttgaactagtttacactcccaccaacagtgtaaaagtgttcctgtttctccacatcctcttcagcatctgttttttcctgactttttaatgatcgccattctaactggtgtgagatggtatctcattgtggttttgatttgcatttctttaatgaccagtgatgatgagcatttttgcttatgtctgttggctgcataaatgtcttcttttgagaagtgcctgttcatatcctttgcctactttttgatggggtcgtttgctttttcttgtaaatgtgtttgagttctttgtagattctggatattagccctttgtcagctgggtagattgcaaaaattttctcccgttctgtaggttgcctgttcactctgatggtagtttcttttgccgtgcagaagctctttagtttaattagatcccatttgtctgttttggcttttgttgccattgcttttggtgttttagacatgaagtctttgcccatgcctatgtcctgaatggtattgcctaggttttcttctagggtttttatggttttaggtctaacatttaagtctttaatccatcttgaattaattttttgtatcaggtgtaaggaagggatccagtttccgctttctacattttttttttttttttgagatggagtcttgctctgtcacccaggctggagtgcagtggcacgttctaggctcactgcaacctccacctcccaggttcaagcgattctcctgcctcagcctcccaaatagctaggattacaggcacatgccaccacgcccggctaattggaataaaagtattccttaaacaatatggttcctagaggagagacactagaaactttttttttttttttgacagggtctccctctgtcatctaggctggagtgcagagacgtgatcataatttactgcagcctcgaacccctgggctcaaaggatcctcccacctcagcctcccaagtagctgggactacaggtgtgaaccaccacacccagctaatttttaaaaattttttatagagataaggtctccctatgttgcccaggctggtctcaaacccctgggctcaagtgatcctcccacctcagcctctcaaagtgctggcattataggcataagtgaccatgcccatcctagaaacattcttttacaaatcagaactaaaacaaggaattccaccatcgctaatactgttgacattatttgtaaagccctgtccactgcagtaattcaagaaacaagtaatacaaattattatttgaattaaatataaaaaacattacttactcatcttaagtggctgcatatctgcagaatctaaatatgttagctttaaaaattattcaaatgaattaacgttaaatgaagtgctgaatgttcaataaatatttaaatatcaataaccttactacatgttaaataaaacaaacttttaacttcatgaataaaaagtcctattcataaaaacaacagaactactcagccataaacttaaagagcaaggtacatatcctgcattaaaaccatttttactaagagatatgtgttggagtcagctaccaaaaatagtaattttgctttgaacaacttagcttaagccgttctttgtaatagtagttagatagcagagcagtggtgtattaaggctattttttttttttgagacaaagtttcactcttgttgcccaggctggagtgctgtggcgcgatcatggttcactgcaacctctgcctcccgggttcaagcgattctcctgcctcagcctcccgagtagctgggattacaggtgcccaccaccaagcctggctaattttttatattttaagtagagacggagtttcaccatgttggccaggctggtcttgaactcctgaactcaggtgatctgcccgcctcggcctcccaaagtgctgggattacaggcgtgagccaccgtgcccagccttaaggctatttataatttatcatagcaaaaccttattaattaaaaacataagcataaagaaaaataaaaacaaaaatacaccaagtattttcttagaatatatggaaaacatcttgaacatattcaggcatgttctacatttcttggtgagaagatatcataaaaatgtcacttcttcctcacctatttttcttgatttcatgtaattccaatgatttttgagttagtgtttatttaaaattaatataaaattcatctggaatatcatgagctgatcaagaatatccaaaacatattttggaaaaaaaaaagaagtcaatttaggcaagaccactcccattagattgcaaacatagatgatagatagatagatagatagatagatagatagatatcaaaaataatttaatccatgattctggtttaaaaataggaatatagattcatagaatatagtggaaagctcagaaatagatgtaaaaattttaaagaacagatatcataaaataagaggaaacaaaaattatttcataaaatgtgtgagataactggcttatactatggaaacgtaatttcatattttacattaaatataaaaataaaatttagactaattaagaaattgatatgtaaagcaaagtcacagaagaaccaacagaaaatgaagttgaacataatttgaaagtatgatcatttattttacctctgaagcaatatagtatgtaataacaaaagaaaaatattcatatacatgatttccttttacaaaaaataagagttaacttggccaggcatggtggctcatgcctgtaatcccagcagtttggggactgaggcgggcagatcacctgaaggtcaggagtttgagaccagcctggccaacctggtgaaacactgtctctactacaaatacaaaaaaattagccaggcgtggtggcaggtgtctgtaatcccagctactcgggaggctgaggcaggagaatcgcttaaatctgggaggtgaaggttgcagtgaaccaagatcgtgccattgcgctctagcctggctgacaagagcaaaactgtgtctcaaaaaaaaaaaagagttaactaaagcacacacttcaggaaaatatttgccactaacaaaatattcatcataatgtaataacactaagaaaaattaaaaagaaaaacatcaatacaccaaaaagtaagtgggccaaaacacatatattctcacaagaggagattcagaaagtagatataaatatggaaatatgttcaacctcactagttttcaaataaatacaaattaaagcgataataagctatgctaacacccagtgttggtgatgccaattagcacaacctttttggaaagcaatttggcagcatgtttcaaaagtcataaatatattcattccgtttgaagcattaatttcagccttagaatcctgaggaaataacttgaaagaagaaaatccctaggcatgaagatgctcttgccgtagcatttatagaattagaaacctggaaataatgaaactgtttagcaataacgaatgattcagtaaaataagatatgtcgatctgataagagtgttgtgcagcaagcaattctttggccttgtgaatgttgcgggctaattgacaccccagctccctctgcatcccacctgccctttaagtcttcactccctctttatccagcttgattcacgaaaaagccatcagcctggtaaggagtcctatactgggtttcttaggacgaagcttcagctttttaactgtactcgcctggaccccaagttacgcaaaaataccttcacctcactggctcctctctccttccactgcacctgaaaaaaacatgctgtctcctcttttcaggtccactccaacctggtttctgccccagtgttcccctgaacctgttcttgctaaggtcactagtgaactccatgcagccattccagcggacactgtaaggtcctcatctaacttggctgttagccagcattcttgaaactgtcttttccattgctttccatggcacgcccactccatgctctcctccttctctgtggccaggcctcaattcccttgctgggccttgctggtcccttccctccctgtctctaaatattggagccatttaaggcccagttttggctcttcctctcttcttactctacatttcgtctgtagacaatcttattcacttccatggctttataaatcatctgtatgttcatgtctcctttatccccaccccagattgatcctctgagctccaggcccatacccaacttgacacatttgcttgagtatcacacaagtatcttgaactacatacacctaaagctgaagtcttgaatcttctacccatctgcctctccatcagtatgccccatctccatgtatggtacctccatccatcccatttgctcaccagcatcctccatatccacatcccccacttccagtcctgccccatgccacttctaaggggtaccttgactgcctcgttctttcccttttcattgtaccatcttagctcagtcatttcttgatgattccttgataccatgtgaccttccagttttattctggtggaatgttctatacttctactagtctataagctctttgagggcaaggaccatagctgtttggttcactggtatattcagtacattgtgcagcacttggcacatgttgcaagcttgatgaacatttatggaataaataaatggaataattatagttatgtaaaagctacatatgtgagaactagaaggaaatgtggaaactttaaaagagttggtgaaaatgtgatttttaaaaattctgatactcttgttataacgtttgagtgtgaattcaatttaagacatatatgtatacaagataagatgtgtggtgcggatataaatgctgcgttgaagattgagcatgaatgagagttcaggcatttgttgaagatgagttagtgggaatggtttgggatctttcactgtgctcagaattccctaaagataattgaactccagtccaggtgaagtggactgaaagaacttgccttcttccagcatgataatatggccagaactttttgaaaatgggaagataggggtgacctccggggactagattagacttagcaagcttatcaaagaaccagggagacagcagagtcttaggtggcagtgcctaagtctgggaggaagtgagaagtataacagaagacagagagctgccaggttgtctagactatggctcttcatagggggtgataaggttaccacttcctgcactcccaggttccttttacttagcgctcattcccatcagatcccatcatgcgcctgatgcaaaaggagtccactgttggcatgttaattcctataatttcccttctgaacaggacacctggctgccttgttcctttggaccatttccttgggaaaaagttactttggggacatttcaagattgtctttttgtgtccctactatacacacacacacacacacgtacaggcacacagatgtatccctgtacacatacaaacatacacacacaaaaacactccctccacccaattttgatcatatgtttgaccacaagcaaaaccttaactaattctaaagcacatttcacaggccaccttctttaatcattatctaacaatattagcaataaggaatagttgacaaatgtatcttcacacctaggatcatcaaggcacgctgtcttaaatgaaccccagatcaaagagaaacagatgaaaaaagtcatgtgtttggatgggaataattaatatcataaagacagaaatttttctaacattaaggcatatatttaatacaatttcatttagactcagtcccctcaacccctttggataaaatgaatatagatgaataatgctcaggaaatggtaagaaaattatgaaaatagagataaagcaggagagatttgccttatcagatgctaaatatatttaaaattacaggagtaaaaacttaatggcattggaatagaagtagatcaatagattattagagcagagcagagttcagaaatagattccagataaatggaaatttaatataggacaaaatgatatttcagttcagtgggaaaaggaggtttgtttttgtttaataaatggctgtgacataattgattaaccatctggataaagttggacccttatctcacactgtatataaaaataaattccagatggattaaagatataagcttaaaaaataaagcaataaagatgttggaacaattttatatttgtccataagctagagtttgggaagcactttatagccgagacaagaaaccctgtatttgattactcaaaagcacattgtgtaagggtaaaagatgccacaagcaaaagttacaagacaaacaatagattaggagaaaaatatgtgtcagaaatatgacagataaagattaatatctacaccatacagagagctcttgaaaattgataagaaaaatatacacacaaagcagaaaaatggtcaaagaataagaatatgctctttacagaagagcaaaccaaatagccaacaaaacatctattcttttatatttttatttatttatttatttatttatttatttatttatttatttatggaggcagtgtcttgctctgtcacccagaaacatctattctttacatcagctcttctgagaaattctccctcctgtggcaggtcaaagggtgagatcatatgaggctctatgatggatggaaatgaggcaaaaatcatcattttttccccatatcttccccgcacagactacagtgactatggtgggaagcttctctccaagacactcaaagtgcatggtgaagaatgtggactctagcagggagctctgccagaataaaagtcagcccaaccggacctgcacctgtagcatcccaaccagagcaacctacaaaggtatgtggattcttctgggttatttttgttataaaatcaaaaaaacaagggaacctcctgagtttagtttgcccaaggaatatgaatagttccccctctgtagactcactccctcactaccccctggttcccacttttgctctgggtcctcctcacctctggtttacctcattcatttactccaagaccccactatcagatatgcctggacaatgacaagagaagggcaagttggataggagagtgcagaaaagccagatagcactgggccgactacccaaatggtttagataattcagagatctgaaaagcaagaaatgccctgggtgagatgagaaattttaacaaccaatgttccatcagtttgagttcattgcattcatacatccatccaggaagtatttactgaacatctactatatgtgaggcactatgctaggtactagggatacagtgactcccccttgcccctaaaaaaaagactgtacactgggatagagagaagtaagtagctcattacaatgcagtgtgtaaatacagggaacatagagtaccatgagaagcacatgaaaaatgtaccttaccagacatggtggagggggaaggggtaaggaaagcttcctggaggaagtgatgtccagacaaggtgagggtagagttgagccagacaaagacgatggggatgggtatttcagacagagaccaacctgcatgatggccaggagacaaaaagctttatttgaagaaccagaagagcttctacatggccaaggcacatggggtaggggaaggtggaaaggggagacggagggaagatagataccaaaggaggcagccaggggaccatgaagggccttgtgaaccgtgaatcctgcgagctgtgatgaaacactgaaaggtttaagccggaggctggcagcacaatcagatttttattacagaaaggttccattgtgcattgtctgtctttcctgctggaatgtaagccccatggaggcagggacttggagaagacatcttcactgctgtgcttagaacagtatctggcacaacgtaggcattcacaatcaataaatgtttcttgaatgaatgaatggcttgaaggtggagaatggaccaaagaagggaaagactgaaagactgagttccaacagatcacttggaggggtccaagtgagagagaaagtgaaagcggaaagctactggagggtccaggtgagagggaaagtgagagctggaggagaagccaagggggatggagagaagtggattcaatagatggtcagtaggtacggtgggcagactgaggactcctgagtctcttcgaatgagaaagactagaagtagagttgagttcatggagtaggtctccaggactgagtgatgatcattaatggagctgagtgggttttatggtgagagctggagttacccaatatcttagtccattctggctgctataacaaaataccttagactggataatttataaacaatagaaatgtattgcttacagccctggtgactggggagtccaaggtcaaggctccagcagattcagtgtctggtaatggcttggcctctgacttcgcagatggtgccttgttgctgtattctcacatacagaaggggcaggggagctctcttaagcctcttctataaggacactaatcacattcatgagggtgcagccctcatgatttaatcacttcacaaaggccccgtggcttaatactatcacattgggtattagattccaacttatgaatttaggggagacataaatattctgaccatagcacccaattgatcctaaatccttcaaaaggcaatttaatgcaccaggccagagaagtgagcttaaaaatgctctcagccactgggtggtggctgtttgggtctgattgcttggaaaatcacctcaattttccactttactttgtccacactgtgcagcctttgtgatgcatttctggttaattttgttcattaaaacgcagaccttgctcacctataaaatatgcctctaaagtatttgagatcaccttgtaaagctagttggttgcttttagcgcctccatccgttgcacccaacccttcacctgccgttttctgaatatcttacatattctgaacgggcaaacaaatttgcttcccagcctcttgtactcagccagccggtgaccattgccaagcctttatccatggccttctttaaacctagaatggcttccccctttcacaaaatcctgtctccctttctgctttgaaacattggagaaaagtcacctcttccacatgcccttgccagattctgctctgactttctcagccattctaacacccctttggtcctccatgcacacccctatcttggcacccaggttaccagagggaactgaaaccactcatatggttgtttccttgactgtgctgtcatcacctaaattattttacctcttccagaataactgtaaatgctttcctagaagaaatcatgaatattcatttccttgtgatatttccaaatagagttttgtgcctatttggtgcttgaaaaaaagtatgacttttgcagtcttcatcaccggacacttatagattccactggagtgtattttcactgggagtccctctgagctgactgtccctgtgttcattctactcacatgtatcaagtgtctgttcagaggcttttgcagagaggtcatgccagccctccaagcctctttgtcttgagaacagaagatgatcatttcacacacaccctctgtacgtgaaccgaattttatgtggaattctgactttcagagggagtgttattgctgtggagaaggaccttaaagtaagggtttttagactttgggaaccacacactaataaaatttcaatgagaaaattagggttgccaacggagtcaagccagcttcttattttgtcaagacttagatttaaaaagcaccctctcggccaggcatggtggcacacgcctgtaatcccagcactttgggaggctgaggcgggcagatcacttgaggtcaggagttcaagaccagcctagccaacatggtgaaaccccgtctcaactaaaataaataaataaacaaacaaataaatagtaccacctcctattcctattaattcaccaaaggaaaaagatattaataccttgttattagcactggtccgtggacagaaggggatttgaaaggtgctattctgtgttgtggccccaaacctgggctctatacaattgttccatggggagcaatgcaaccacaggttcctgggtccaccccaggcttgctaaatcagaatatttaggggcatggccctgggatctatagctttgtaaatttctcaggtgattctgatagagaactgggtttgggaatcactaccttggatagagcatatatgtttaaagagatacaggaaatactacatttctctaatgctgatttagtagttttgaaatccttgttattttgttcttttggggttttctaaccaatgagtaggttttcaaaggcaaataagaaaacctttatcacagatttggtgacagttgaccccaagaagatcgtggaacccagcccatggaaactacactttagagtatgttaggtaaatatttgcagcgtggatttttctgaaggtgcaggatttctaatgctccggttttcatgttctaggcacttcttgctcggtgacttgttttgttcttatgccttggccaattaaaagctgagatagtgatccctaggagagtatgagatgtaaatgagctgtaaaatggcttcttcctagtgattattcatgggaggcttggaactcgaggtgggttcagtctgtttggaggcttgagctgtgcacttcggctgcctgatgcgaatggcctatggggaaggaaccacatactgattgaaatgttagcaaacagctggcacgctcctgcccactatgcagaggaagcaaaaatatttatctttttttgcatttacagctatgcttgactatagcaggactccaccgtaaatgacattttccccccttccctccagatgtttcagttgtcaacgtgatgttctccttcggttcttggaatttatcagacagattcaactttaccaactgctcatcattaaaagagtaagattttatttgaaatttgaatattctctcgttgatcttaatttacttatttgtttgactcctcgatttcctaaagaactcttttgtgagacagaactttccaaaatgccttttgaagcatggtgtaatgggagataggagagccaccgagctaataagctccgctcgcacattctagccctgactagtaagctggcgctgcgagggagagaaatcccctgtgcttaagtgttcatacccacagggaaatatgtcttcccaggaccgagaggcagccttgaagtaagtaaagaagaagggacaagccaggtgtggtggctcacatctggaatcccagcactttaggaggctgaggtgggcagatcgcttgagcccaggagagtttgagaccagcctgggcaatatagtgagacgccatcgctacaaaaaaacacaaaagttagccaagcatggtggtatgtgcctgtagtcccagctacttgggaggctgaggtgggaggatcacctgagcctaggagatggaggttgcagtgagccgggatggcgccccgcattccagtctgagtgacagagtgagattgtctcaacaaaaagaaggagcgctgctaggttctcttctgattggaatggcttcgggaatttgggcggaacgagaagccttgagtgtaggggtaaaaagtcttacttgagaaggacaaggtgaagtccctttcaccaaaagaacatgttcctgctgccccccttttcaccatctttggcctctttgagctacataggcccctgagttagtgccaaacctcactccttgcttctaaagcagcaagaggacagaggaaatatgtttctcagatgcctgacttgccaattggaagttgggatggaggcctgcagggcaccttgggaggctgcatgagtagcagtgctgtagatcactgcatagtttgattgaccagttatgtgagcaccaaatgggagtttcttttgtcctggcctgggaaccatggtttctatggggaaaatgaatttgaacttgaagctgagctaggaggctgctcttgaatgattagaacaggagcccctgggcctcatctcttccactgaggcactttgaaaaagatgacacaaggcccagttcaattattgctaagaaacagaatggatttaaggagaaaaaaatacaaaaattgctacagaaagcctcagaagttcatgaaaataggaaaaaagggtgtgaattaaatagaattatatagctcaaagacagttgaaagaacgtagctcccccgatgcccactttaaggccagatgaaaggaaccgactagccccaggtcccacaacttggtaattaagaaccagacctcagacctaggtcccccagggagggtgagcgccctttccataggtaactgcttcctgttaggaaagcacttagtacagtaatcacaccctgggggtagaagaagcgagcaaatcacaaacccgtgtctagctcacttaggtggccggatccacgcaaaagccagtgtgtcctctccttccacggaaactgcagtttctgtagatcagaatctcagaatgtttcctcatttcttggagaaggtataaaacaaactgggtcccccggccctgtgctagcaccccttgctagagctaaggcttcctctggcctcccttggccctgtttccagatcaaccctgatttccctttttaacattccttctcataagtgcttttcaagtcctccacagtttacccaatcatgataggtgatttgattagtagaaacacaattcttccttaatttgattataaagcaaacacaggcacctcgttgcctctgcttgccagctaacactttctgtctcacatcttccaggcagttggcagtgtgactgctggagtgagtgagggcttcctgattttggaaggcagagtgggtagaggcggggagagagagagatccatctccagagggacttacctgagggtagacaaatagcagaactggattcagaaacagattcattgggttcctattatctacagaccagcaggtgacccagcttcaggtttccatggcaacacccctgcaggtgccattccggcccatcaacctgagggcttccaagagcagggcacaaagcctcacaggaatgtctgtccagggatttttttttttttttgccttcttttaaatgcttgcatgccacatcacagagggaaattctaggatgtgaacattgtcctaaaacgcaggaattaagtcagttttctgtgttgctagatgcccagcatgcgtagaaactggctgcgcgtggtgtaaaagtgcaagaaggtgtatccaccccttcacagcttgcgacccttctgattatgagagaaaccaggtaaagtgacatttttggtattgtaagtcttaaccgccgggcatggtggctcacgcctgcaatcccagcattttgggaggtcgaggcgggtggatcaattgaggtcaggagttcgagaccagcctgaccaacatggcaaaaccctgcctctactaaaaatacaaagttagtggggtgtggtggcgcatgcctgtaatcccagctactcgggaggctgaggcaggagaatcacttgaacccgggaggcggaggttgcagtgagccgagatcgcgccactgcactcccagcctgggtgacagagtgagactccgtctcaaaaaaaaaaggtttaaccaaaaataaatgtttgtgactgcctggtcctaccttctcttttatgtttgttgcacactttgaatttaccacccatctggatgttgaagggatgttctccattccaggaacagtgtccagtggctgtcgagaagacatcaggaggaggaagacccaaggagaacaaggggaacagaaccaaccaggctttacaggtcagaccctatttttgtgtggttgaggggaaaacctgtctttgaatgaccatgaccacaactcatactactttgggttccttaaaaaaattctctattttactttctaccaaaattcccttttgtgtctttggttttttaaccaagtttcacttaattagcgcaatacatcaatggctggacactcacataaaataaattaaaactctgtaattatgaaaaatgatgttgctctggtcgaaataaaattgtaaaggtgactttgcggctcactggtgaagagctggaaggaagtttagcattccatctgagggatttcaacttgcactttatataattgcgtttctgggggttatgtgtgtggatgggggtctgtgcaaagtgtgcaaactaacctcgattccgttgttttttttcaactttgtagggacgtctaaccagtagtgaacactgctaaaccagaattgttatagaatgtgtatttctctcgccttctcacaagcagttattaatccatgaactttccttggaaatgcccgttattttcttcatagtaaattacataagcccccacgtcagtcatgtttgaaaagaggggacatgtcaacgtaaacatttctgggcggaacacatgtggctgtgcttacaacttcactcagtcaacaaaagttcattgagcatctatatgtggtaaaacacaaaaagaggataagtcctgccctcgctaaccttggagtctagcagaaatagacaaattaaaaatgacagctctggggagaaaagggctccattttccatttctctaatctgtggttttgacttctccacttgctgcttacctaaggtcaagtgcaaaggtaaataagtagcatattttgaatcattactgaaaagtttatagtaacttcaggtgaattaacaaccaggcagagggaatatgaatcaaatggatatgaagttaattaaaggcattagaaaagcttgatgctcaggtatctccagactttagcagtctctgaggtcttgttaagtaatgggctccttttctcatcccattggtttggaaaactaagacacagcgacaaggacttggatcaggaagacagtggctttgtggctttttctttttaattaaactttgttgttgttccagggtttgtttgtttgttttttcgttttgataaaatacacaaacaaaatttaccatttttattgcttttaagtgtacagttagttgaggtaagtacattcacatcattgcacaacctatctccagaactcttttcatcttgcaaaactgaaactctatgctcgttaaataataactcttcatctctccttccccccagcccttggaaaccgccattctaattttttgtctctatgaatttgactactctaggtacctcatgtaattgaatttgtctatttgtgctggcgtctttcacttagcatgatgtcctcaaggttcatctgtgtggtcgcatgggtcagaattcccttcttttctaaggttgactaatattccagtgtatgtatataccatattttgtttatccattcatccatggattaacgcttgggtcgcttccacattttagctatgatgaataatgctactaggaacgtgggtgtgctgctatttcttcgagaccctgctctcagttcttttcggtatatgcccagaagcagaattactggattgtattgtaattctctttttggttttttgaagaaccattgtaccgttttccatagcaacgataccattttgcattcccaccaacagtgcacaagggttccagtttcaccccatcctcaccaatacttgttattttcgattttgtttgatagtagccatcctaatatgggtcaggtggtatctcattgtggttttgatttgcatttccttgatgattaatgatgttgagcatctttgtgtatgcttgctggccatttgtatatcttctctggagaaatgtctaatcaagtcctttgcccatttttaaaattgggttatttttgttgttgttgagttgtaggagttctttatgtattctgggtatcaaccccctatcagatatatcatttgcaaatattttctaccattccataggtttccttttcattccgttgactgtgtcctgtaatacacagagtttttaattttgatgaagtccagttcatttattttttcttttattgcccatgcttttggtgtcagatccaataaatcattgccaaattcaatgtcatgaaactttctttctgcatttatttgtaaaggtctgtagcacttatattttggcctctgattcattctcagttcatttttatatatggcataagaaatgggtctaacttcattcttttgcatgtggatatccagttttcccaacatcatttgttgaaaaaaatgtcctttcccccattgaatggtcttggcaccctcgttgaaaatcatttcaccatatttgtgagagtgtatttctgggtgttcttttctattctattggtctatgcctgtctttatggcagtaacgcactgtttgattactgtagctttgtaaagtaaattttgaaatcaggaaatgtgaattcttcaactttgttcttctttttcaagattgttttagaaaataataaacttttaattttgagataattgtagattcacatgtacttgtgagacaataatacttaatatcttttacccagtttccttcaatagtactatcctgcaaaactatagcaaaacatcacagtcaggatattgacgttgacagcagtcaagacacagaacagctctatcatcacaaggctccccaggttgccctttcacagtcgcatccatttccctcctccctcccattctccatctctgatgcctggcaaccactgacctcagctccatttctataattttatcatttcaataattttatataaacggaatcatccagatgtaccctttgggggactggctcttttaactcaacataattctctggaaattcttccaagttcttttatgtatcaataattcattcctttttatcgctgagtcgtggtccaggcagcggctttttaaacttctttaattttaaagataaatatcataaagtcactacctcctggtttcctgcagtgtatctctctgcaccctttgaactgtgtggttaaaaggactggggtcaccacaagagaagaagaaggctgaaaataaacaaaagcccagatctgtttttagtgcttctctgtggattacccctctaagtgtggagaaagacattttgttgatactgacatgttttctttaaatatgtgactcagagcagaatctctcttttgtttgatagggaatggagtgttatttgtcacaggagggatttctcgtgctctgtcaaacactgctgtctttcattatcaggtggaatgtgtaacattctggtttccactttgggccttcatgttggccttgaacaaagcacccaatgtctttgtgattctgtttctaccagagaagtcactcacagctttgcttcaatgcatctgcccacaccacatatgtactgagtacttcctgtgtgctaggcactaggaatggagcaggtactgtcctaggcgtctaggatcctgaacttgagttgattctttctagaggcatttattgcacacctattagatgcaagtataccgacctccacagattccatgaggaggattcagatgaatcaggcacatctctggccatcagtctcaagaatcttatccatgagtacatgagtaaaaatacaagattttaaaaatattaatatgaaggtacaagaaagtacacagagagcctctctgtgcccggggctttgtcttagtccttcctgtttgcttaaacccagtgccttgaagttgaaaacacttaatcagtgtggttggttaagtctttgattgatggatggattgattgctggagatggcatttcagcccacctttgaggacgagaagcatccagacacatgaatgcgggtatttgaagcagaggaaccagcatatgcacagtgtaggggtaggagccagaagattccaggacacacgctagaggaaaccctaagtaggcacagaggatgcaggaaattatgagacacaaggttgaaatgaccctggagcctgcatatatagggcctcacataccagtcctgtgagtgctcgctttattcttcagtggcaatggaatgccattcaaggtatcttattttatttttttagtgtatgagtttgctaatccaaggatctggtacttatgaggtagggtcctggttcagtccctactaggccagtagccctcacactgtttcatgaccccaagacctactcctgtatcctgaccctgaaacgtatagcgtcatctgccaagggggctgagttacagaaaagtgtgaccacaatagagaaatgagctcaaaaatctatgtatgaccttggaggaggagtatttcaagctataaaggccagtgtctgaccgtctgtctgtttctttccacatatctagtagttgaaaccttgtcagggaccgttggcccttttaccctgccctgaccacttctccttccatttcttaacattctcatatctggtgccttcactcactgagaccagagatagttcccctctcttttgtgcattcaaggagagattgtgaagatttatgatatgatgtcattctaatatttgttattaccctcaatatgcttatcactatagggcagaaataaagcatacaaagtcatatcccctggcaatttacattcaaatggttctttctcttccttgcacctcctcttctcttcctccatcacttcttcccccctccgagatggagtttcactcttgttgcccagggtggagtgcagtggcacaatctcggctcactgcaacctctgcctccccagttcaagtgattctcctgccttggcctcccaagtagctgggattacaggcacccgccaccatgcccagctaattttttccaatttttagtagagacagggtttcaccatgttggccaggatggtctcgaactcctgacctcaagtgatctgcctgcttcagcctcccaaagtgctgggattacaggcatgagccaccgcacccggcccctccatcacttttgaatatgcatttttgatctctcacaggcaatccagatgaatgcttttggggaccttgccttcaagagtgaaattaaatttcacatataccttgctgagtagcttctatgggcctagcatagagccgggtactgtagaattaacttacaatcattcatttattcattcattcaaaatttgtttgctgagcaactactatgtgctagacaggcaggcaaagtgtgtgactgcatggagcttacatggtagaacttataatattttggaggaaataagattcattttcatgaagcagttgcatgtgcacaagagaaaaagatacaagagagaatgccagaatgtactcaaatgaacagtggtagctaagattcgctgagcctgtgccatgccctgagctcagagtatctaagcctcacaatggacctattttccccattttatagataaggaaattttagctcagagagagcaaatggtaggtaagaaatatgaatccaggcaatctgactcaacagagttttaaccattaccctacattgtatgccctaaattgaatataaacattggttaaaccatactactgatgatattaataaaagtcagtctggaaaggactctaatattggcttctcttggcattagactgtcaaagcctgcccccgatccatgccacacatgtagggtgggagcaagacctccaacctggccaggatgtgggaggagtgtattaacctcaaagacatgggagaaaggggtggggcagggtgtggtccgagggaaggagtcagacccagacacggctgggcatctgctccaagacagggagagcagaataggcttagtgaggcaactgaggccctggggagaggggagcagcaagaatctcatgcatgagtcgaatcttggccaaagggtggactttgaggggctgggtttaaattagaatcagggccctccactggctgggaagagctgccctccctggccctggagttttggtcacccagtccaggtctggggagccacactcagaaggctcaaatgccaagaggaatagcaggttgttcggagggtgggcttggcagccaagtcagcctccttttagagtctgcagctcagagaagtgagtcttgatctcttcgcacagggcattggtctgtcaccttctatctggaagtctcaagctctgtgtccagaggcactgctcactattggcatttccagggccaactgaaatcacatctcaagttccctggagcctgtaccgaggggcccccgtgaaaaggcatttgtcccaggggctaagcatcaaatggataaccattttgttccatttcacactctaatttttcttgagtggacctgtattttgctattttctttccatatctcacctccttttactctttcccatttccacggctggttaccactcttaccaatttatacatttcattaatatattagttctatcctcttctcagtcattaataaagatgttaaataatcctgaaccgaatactcactcctgtagggccctacaggactctttcctttaattagttgtgctacctttcatctatctaatgtccttcggtttcagatttccagctggttttgaatccatgtgactttttatctagtcctgtttgaactaatttcatgagtgaaaatccgagagatgttttactgagtgttgattcaggtccaggcctacagagagtttgctatattcagatttttttttaacagattaatagagtacaatttggccttaataaactgagccctcctaatgcacctctttccaatattcttttcaatcatagcagtattttctccattaatgtcatggtaatttgaattgtgttgacgtcagacttcacaaaaggtactcttactgtcagaagtaatcctcttagaccttttgaaagataactatttcttagtggttgtgctatttccaatatcctataatgacttagttaaaaataaaaaataaaaaggatcgggtattctataaatctcctaattaaccagcttctaatgtgctttcttatacaaaacagggactgaaagccagagctcatagtagtttattaaataagttcaaattgtgcagccatttaaaaataaccctgaagtctttaaaacgtaacctacaggaagcacactattctgaggttaattgctggacaacatagggctgtgacggttatagtcaacggtattttgatttgaatacatagaaatccttggacatagagtgagggaggaatcccacgatagggctctaagaatttgtctctttgtattgagctcaattatgttttacaattaactccctctaaaatgcataagcttatagggctggctactatatgccaggttttatgaattaactcttgatgaaaatacaaaaattgatctaaaatattgaatgtgtagaacctttatggggaaatgattctttgctcttttgtctgtactggatttttcaaaatctttattggtaaaaagaaagaatgtatttctaagaattgttgcaaccatacagggcagccatggagctgactctacattttgttttaaaaatgttgttttatacctgcactatttatttaggagggtcctcttggtagctctttaacccatttattaagattagaagaggttccaccagcaaacaaaagacaactaatctgagtctgtttaaaagcagactgaagcacccactttcacaagacaggccagggctggattccatcctagatggccaagagaaccctctctaaacaataggggtttaaaatgtttttgaagtagcaaggcggtctccactcagggaaataaaaagttaataagatgatgtggcaagtcctctgatggtgttcgtagagccatttaaggagcaaaatataacttccttaaaaaatcttttttacattagttgtaaggctctctttatcctctgcagagaatggagaagaagcatttacttggcatgtttgaaaattttgcttgagcagacatcaacagtataaatataagaagcaggaaggactatctagaaagaaaagaaacctgggaatcatagttgacttggatgtaaacgtgagtctgcaatgaggtttacataaaaaaagaaaaaaaattctatcttgctcccctaagaagacagtggactcctctagagcagaggtcggcaaatgttttctacaaagagccaagacagtaaatattttaggctttgcgggccgtatggtctctgctgcagctactccactcgactgctgcagtgcaacagcagccagagacactacccagacgaatatttatgggtgctgaaatttgaatttcatgtgtttttatatgtcatgaaatattattcttcttttgacattttgtcatggcccatacaaaagcaggtagcgggcaggatctggcccacagactatagtttgccaactcctgatctagtgcacacatagatcatgtgtcccccacaatatctggcctaaggaccctgtaggtgctcaataaacacttgttctcttagctgtcaccacgtaagagcgaagagtaagccttttgctatataacacacacttgacatttgcaagagatttatcttgaaggctttgctaatccccccattccaagtaccactctagcagataatttcccccataaaatgcagtcaagtataacagaataattaaagtgaccctttcaggcccttagtgattctattaatacagggctaacgtccttcacaaagtgattaaaataaattctgctaccaaaatcaattctgtgtcatgttacatcattgctgtgatgacattaacaatgaatttacctcaatctgcaaaaccagtccaaagcgctgatgagtgatggggacgactgtgccgtgtagcacctgtgtgtgctggggagcagaatgagaaaatgtctgtttgagcaggatgggcagcccctgtagcccagcaatgccaccccaatgagtgttccatgtacaaaggagcagaggatactcaattgcttcaagaagcaggtgttaggcaggtgttggacatcacggagttctcccagtggctcaggggcttcttcctggactcggtcctccaagtggatgcactcagcatttagaatttcaccaaacgtcatgtgattaagcatctctggactttggggtcattttcaaatatcaagactgagtatattctgcgatggtagaggatataggggaaaaaagagtgtgagtatgatgttcactcttgctgaagttctgctggactttatattgggtagaatcttagaatcttatgtcctgttttggtcaccgtattatagaagaatacagacttgctgaaaatggtctacaaaagaacagtgaaattatcagaatgatagacagtagcatctgtaacataaaagtgaaagaactcaggattgttttatcttgaaaagggaaaatgattcttgctatcaaataaagggctttttttttaaagggagaatttgattagatatcacaaatggagaagtaaggtggcattcacctatatggtatgaagctaggtagcaagggactccaagggacatgttcttgaccttaggcctgataaagtctattgaaactgggtagcaagaaggaggttgtggtatctacaaaccttggttggccacagtggtttagacatccaactacttgatagtaggtgactgaacaggttgatttcttgaggtttttccccctgcagtatcctcctggattcaaatagcctcactgtaacaaaaatatgactgctttcttgggaactgaatttatctggaatgacatttatttcaacttaacgatgagtctgtcattggcctacggtcaatggactctctttcttttccttgattttgcttacattgtgagcctccagaggctgtaaggcagtaaacattttcaaaactctagtgatacctcactcttcagacagaatatcagacttttcaactgtattttcaactgtcttgtgagacaaagactaattggtttgacctcatgctgtcacatgttgagagacatgaatctgcagccctcttccttgaattcattgatttcattaaacactgtctgcttgtgttcgcaaaatgttgtaatttcccagtgatttcttcgaactgcagcgtataaacagatttttttggagcgatgccatttcttagctttgatctcctgttttaatcttttctttccaataggtcttctacattaagtccattgagccacagaaagtatcgacattagggaaaagcaacgtgatagtaacgggagcaaactttacccgggcatcgaacatcacaatgatcctgaaaggaaccagtacctgtgataaggatgtgtgagtcgaaatactaataatttatcctcggtaacgtaacgctcaaacctgtgccaaaggaatatcagtgtgattataaccttaatatagtcaaattattgccatgccccaaagcaggccaattagtcagagtatttgacataatataattccaacacgtaaaataattttcacaacagatctgaagttcattgtgagagaatctgttctgtgttattccccaaaaatctcagtatatagtcatttcaggatgttgcctgtttggggtcttgattcattttcagtaacaaaatcaagtatatggagtagcaaacatcattctttaggtgatgcacttggaaaaatagttgagtaccttgaaatttgatgaggaattttttggagcagctcttccagtgtgccacccaaagttgaaaaaacaaaacctcttggatccattttatgtggacattttattctttgtagccttctctttactggtttggtttcagcctccaaaaattaaattactactacatataatggtagtaaaaaagaacaccccaacataaatatctggtcaatgtatctcttgaacattattatttctgtcacttctttcccaaactcatcacatcggtgaaacttggagaaagacttttcaatttctaccgatgtccttgtgcaaatggttactcccccttcgaaaaaaaaaaagtgatgtgataactgcagttattaaataacacaacagattatttgagttttctgcttgttaactcatataagtttgggctaatttgaagtaaaagatgttacagtctacatagagtataatactaagcttattttcatcatggaaatgcatttaagacaatctgctgaagcgtgatgttttgatttttaactactaaaacagatttgtacagcattctaatctgctatgcttatttactgaattttcttctttaattcattttctgcacatcactgccatgcccttcccctcatagcagtaaatttggaatatctgtgatcttgatgagaaaagctgctcattggtggcttgcctgtgttctgctatttgccagaattatcaagcacacattagaggctgtatctatgcaacataggtttttttgtgctgtttatcctggctaaataccttattgcaaaaatctttcattttatgtagcgaaatctgtgaagttagacacctgtgtattcactgaaaggcaatcaacttcatggaaaataagtagtttttcggagcattaccctgtttctgactctttatgttctcattttaattccgaatgtgtcttgagatactgcagttattaaattaaatgactaggagacctttctgcatgtcgcatttcagtaaccacatctgtgtggtgaagccaagttcacaagcagtcaacataatactcagttaatcctatacctgagcccaggctgtaatcccaagctcttttaatatggtacttttaaaatgggtaattattttaaagagaaaaatactagtagtggaatgacctacattttcacctctcttcttctgaaatttataaacaagtttgaattttaatgttcaaccactttatgataaatttcctagagctttgctctgaatataaacctgaaaatgtgcgtctgaggtggcgtaagtacaaactgactcagatgtttttgaatttgccttatcctaaagggttagtgatagcattaaagttaatcatcatgcacatggcctttaagtagtaataacagattctcatgtagcacggttatactgagcattattcagacacaacccaggcttaatgatttgtgctttagaggatcattgtagacacacagaggaagctgcaggtgacagcgggaatgtcggagaaagcttcgctctgactctgaaagggcgccaagcatcagctgttggacatcaggagcaccctggacagccccagctaagtcccagcctggatactccttagggagcatgttggccccaatgctgattgattctgagatgcctgggctcttggtttaggccccctttgaacagcagaatttccatctctgtctggtgctgtgttttaccctctcagtgcttgactagggctttttttcttaagctttttattatggaaactcaaacataatacaagagagatgagtgtaatgaacctctctgtagccattcccggtttcaaagcctatcaacattttgccaatcttgcttcatctatcttatctgggatttttgggggggcatgataagaaccaaacaccatatccttcactgctaaatacttcagtacctctctaacagataagccatagtgccattatgatactcaacagaattatccacaattcttaacataatgtaacccccagttcatgttctgctttctattagtacttcttcagggcaatggttacacctccttcctttcccacttctaagggcaatgcaaataagaaagataaaaatgtactaaagaaagaggaacccaacccctaataataccaacttgggtcactggcccctcatgagtcagtagttgcctgcagctgttctgctccttcatgaagtgttgtagttcaagtgaaattcatttgctgtcaccttgggtaatcaactgtgctaagtgtctgtgtcatgtgagagttctttttctactcttttctaggatacaggttagccatgtgctaaatgacacccacatgaaattctctcttccatcaagccggaaagaaatgaaggatgtgtgtatccagtttgatggtgggaactgctcttctgtgggatccttatcctacattgctctgccacattgttcccttatatttcctgctaccacctggatcaggtactttctagattcataatctttttctcattgtggttaaaggtcatatgcccaaagatcattgattttattcaagtaaattcagaaacagtggtcattccaaattcctctcaccgagttctccttaggatttactcctagaaaaatgcatacctgacaagacatttgcttcccatgctcatcgtgaatgctatgagcacacctttttcccttcaccatggctgctgagaaactcacagctgaaatgtttgcctaggtttttgatatagatatatgacactctttactatgtgtccctcctgcttgtgataaaaggcttctttcttacctctttcattttatagactttagatactttaagctgttttgaattctttgggggaaatattgggagctatcaaaatgaaaagcagaatcaaccttttcaagatgttccctaagggggagatggaaaccccaaaataaactctcccagataaatccaatatgttaagaaaaacatttatctccctagttgaatttttaaatttattactattatgtattttttgcattttcatgggtacataatacttgtacatgtttatgggacacgtgatgttttttctatgatcatacagtgaatatgtaatcatcaaatcagggtaattggagtatccatcacctcaagcacttatcatttctttctgttaggaacattccaattccactcttctagctatttttaaatatgcaataaattattgtgagttatagacaccctactatgctactgaacactagatcttattctatctcattgtatttttgtagccattaaccaaaccctctttatccctctctggccccgccacaccacccttcccagcctctgatacccataattctactctctatctccattagaccaactttctcagctcccacatatgggtgagaacctgcaatatttgtctttctgtgcctggcttatttcacttaacataatgtcctgcagttccatctgtgttgttgcaaatgacaggatctcattcttttttgtatgctgaataatactccattgtgtataggtaccacattttctttatcctctaatctgttgatggacacttaggttgagtccctatcttggttattgtgaagaatgctgtaataaagattcctcctagttgaatttaaattcactttcataatatttttattcctaaatctctttaggactaaaatcctaacgatattttctttgcctgacacagtacgaagctaattttcaaagtactctctaggtaaacctacagacaaaaagctttgttaaaaaaaaaaaagaagaagaagaagaagaaaaggaggggaagagaaagaggaaaaaaagtagagaagaaaaaaatcacttttaatattcttatttaagatcaagtgagaggtggctatattagtttgctagggtggacataaagtgccacagcgtttgtggcttaaacaacagaaatttctttctccccggttctggaggctgaaatcatggtgttggtaagattggtttctcctgaggcccttacaccttggcttgtagatggtcatcttctctctatgtcttcacgtggtcttccctctgtatctctgtcctaatctccccaattttttttttttttttttttttttttgtgacagtctcactctgtcacccaggctggagtgcagtggcgcaatcttggctcactgcaacctccgcctcccagattcaagtgattctcctgcctcagcctctctagtagctgggataatctcccctttttataaggacatcggtcatgttggattagggcccaccccaatgacttcgtttaaccttccttacctctttaaccacccacgtctctaaatacagtcccattctgaggcactgggagttagggcttcaacatacattttatggggacacattttttggggacacagttcagtccataatagtaagataaggagaactgaaatttcaaaaccaaggctctagcatgacatcccccactctaggaccaattccattctccatataaaaggagacattgatgtggcatgccccatgtgcctggtgtgttcatctattgactaggttaatcctcacaacaaatttatgagatctgctatggcttgtcccttttgcaaatgagggaactgggggaggaaaagggttcaaacaactcaccccagcctcccagacagctggtactaggaggttgggctctgagccacagcagtatcctgctttgctataaagtaagaggctccctactgttctgtcacctgcgacattctgagcctgtgtgtcttggctgctccttggtcactgtgccttgagcaagaatgtggctctaaatgctggccatcgggagatcacgcttggctcggttttctggtaatggctacagactggcatgaggccaactcagcccttccccattgtggctggaggattcagagatcagtgtcttctctctgccctacacaaattgggttgctcaggcccacctcctggtcttgtcatcaggggctcagctggctgttggacctgacgtacccaggctcttgtcccctagaatgagtgtctggtgacctacgtgaacaggggtgcaagggcagacagagctgtggacagctgtttctttcacacccagtgaccgctttgcttatatgcactgagaaacgtgaagttatttggcctggttttagagagatggaatgcagctgttatttatacggcgtaccaaataggaatttacactttgcatgtcatctgtaattctaccttgcccaaagtgtttcctgtctctctaaataacataccattggtaggttaggagtttgattttgaaaattcttagattgaagtctctttatatagattaaacagtaatcaaacaaaattctgtttagtgaaaccttttcaaggtacagctcctgatctgattatatgtggcgatatgacacaaacaaaattcaaattccatcaaagaatctgggcattttcctagaattaaaataggatctgacctgaatttttatatttatgcatcttgaaacccatgaatttgtggctggtatcctgaaaagattcccaaaattgtcctgtatttgaaattaaaattcattaatttgctctcaaacataattgggtttaatattaaacatgaataaattgatagctttgttcataaatgcaaaatgcctgtgtgttagctatgaaacccttattgttgcttttattccttgcagtggtggtcaaaatataaccatgatgggcagaaattttgatgtaattgacaacttaatcatttcacatgaattaaaaggaaacataaatgtaagtctccagctgctttgtaataatagttgttttcaaggatggttctattttcatcacactatgctatgttgggggtattttttgtttctgtgactttggtgttataaacttttacctatgctatcatatattctatccatgctagaatggaaataataagaccttatccttgtagctgagtatttctagttgcagcaatgaggaaagagaaatgaacttggtacgataagacctgacattttctttttatgtgatttgtggcaagtcaccctaatgaggcaatgcttatgaatatgtgtgaaaatgctccgtgaatggttaaggtgtgatataaagaattgcatttctgtgaagagtaggtggtattgttcccattgcacagagagagttgggttcacagaggttagatgacttgccaaggtcccagaaatcttgtcatgtgcttctccttctcttcgacccaatttgttccctaccatctgatgtcaccttctcttacctttcgtctccccacaggagaaatggtaggaggggtctggtttccacctttgcccgattctcccactggtgcctccagatggggatcctctagagcaggggtgtcaaccttttggcttcctgtggccacattggaagaagaattgtcttgggccacacataagatacaccaacactaacgatagctaatgagctaaaaaatggtttgtgcataatttccgtgatatccaccaccacagataagcaaaaaagtcctcacattcaaaaggctggacacggctgctctagatggaagcttctgatgccaagaggggagatgagggatttcacatacaagtcaggcctccaagtgtacttgcacacacttctaaatatccttccccattctttcttcccctttttccctctccttgatgagatatgtgaggtggctgcctctctggggccctgcctgaccacttcctgccaaggctgacacactccctcctcaggagcagtgtgggttcagacccaaattccgggggccgcctgataggccgtccttacagccttgtggtgcacacattcacctgctgacacagttcagagccacttccaagcctcacactgtatctgactccaggcctcatctccatggtgtgaacacctccagttgaatggctcgtatagtttgaccctctgagcagaggcattacctgagtttgtcacggacttgctctccctcctacttgctgttcccaaatcaagttgaattttttgagcacctactgcaggcaaaacattttgctgggtgcagggacaaaagataagtgagatagtcatattgccttcatggaggcaggcagcaaatctacattgggattgaaagttgaggctgggtgtggtggctcacgattataatcccagcactttgggaggccaaggcgggaagactgcttgaggccaggagttcgagaccagcctaggcaacatagtgagacccccatctctataaaataaaaattaaaaaagttgacagcacagagtatcatcaggttctaggtcctctggttccctaactgttcagaaaccctgtgagtccaagaagacaccatttcttttcacattaaagagaaattaaacatgcatgggattaagtacgcctgcagtatggagtggggtgggtggaagcagggaggtgagttcaggtacagaggacagagtcctcgcaggcccgtgctgggaacatcactcaatcctgcttagtgggaacctagagggtgggtctggaatgaccaagagcgatagctgtaaaactgagctggggccacaaaaagcagcgtcagactgaaaactttgcccttaattctgtaggcagcagggagccactgaagatctctgagcaggaagtgacataggtctaggtacactggactcacactggaccgagacaattagtgacaatgaaagcagtcagaaggttaccaatgggaaaagagactatgcagaaagcagtagactagggaaaggggaggattctgacccaaaaggcttcggtgtcctgtcttgagtcctgggaaaccacgagaaaagaagagagtgtccaacccccagcaggggccagctcctgaagtgcttgttgccgctgaatcactctttgttggggaacctcctgcagggcggttattattttggcaatggtgcacagctgagtttggagaggcaggaactgaagaaaggctgggagcccagtgaggatgctcatgccagtgcaggtgtgtctgagacgtccacagtctctctgggctgacagtagctccctttgggctgtggttagcagagcaggtctcaagtgctggggcatcgtgaagctagagatgaccagcttgtctttatagcagtatcgttgaagggagagtgggggtgacatcatgggagtgagagcacagaggaggaagaaaagagcacctaggactggtggcaaagcttcattttaaggaatgacagacagtaggatgggccgtgaaggtggccgagaaggtgctcagaaaccagtgaaaaagagtaaatcgcatggcgcgagtttgtcacgagtatggaactgtagagtcttgaggataatagggttgggtgatcctctcacctgcaatccttctagaaggcatcttcagtaaaaagccagcctgctaggagttaaggctgctgaggcagtagagacagtggttttcatcctgaggacagaaatgtgagcaggagattcagggctatagtttggaaagatgtgaagggaaaggaaggttgtgcttgtccaaatctcagctctttacatcatattttcccaccaattgcctcttcctattgtcttttttatgctctagtatcagggggtggcgggggtgggggaaaaatagtttttcccacctgataaatttctttttatgagttataattgcttttctgtagaatgtttgccatcctcccctaacccaccagcctcctctgcctgtccttctgtacacctaaacaggacaatatatttatgttatgtatttactaactttttaaattttattttttatatatatagagagagacagggtctcactgtgttacccaggctgatctccaactcccgggctcacgtaaccctcctccctccgtttcccacagcgctgggattacaggcgtgagccactacgcccagcctatttatgtgttgttgtttttttttaatcctgtaaatcaggccaccttttttgcattgttttcagttttcatgctcttcatttcatgggagatgcattgttccttttacttttgttttctcctgttttctgttatgcctgaaaacccttgtcctccttgtgtctagtgacttctgctaaggccctgcaggaggttcccccaacaaagggtgattcagctgcaacaagcgcttcaggagctggcccttgctgagagttggacacttttcttttctcgtggtttcccagggctcagacaggctgaccccaaggacacctaagccccttgggtcagaatcttcccctttccctagcctactgctttcagcctagtctcttttcccatggcataaccttccagctgctttcattgtcactcatgatattaatcataatattaactagcatgttttgagtgcttactgtgtgccgggccctgatctaagcatgtataatctcagttaacgtagccctcatttaatgtaatgtagggtgaagtcaatcctgtgagggaggtagttttgctgtctccatattacacatgagaaaacagaagcaccaagaagttaagttgctcaggtcacttagctcttagagatcacagctgggattcgttaacaaagttactaaaacattcttttctttttgtccaggtctctgaatattgtgtggcgacttactgcgggtttttagcccccagtttaaagagttcaaaagtgcgcacgaatgtcactgtgaagctgagagtacaagacacctacttggattgtggaaccctgcagtatcgggaggaccccagattcacggggtatcgggtggaatccgaggtggacacagaactggaagtgaaaattcaagtatgtttcttttctttctgggtgggatgtcaccccgaccccttgactggaaaggtgtgtttatgctcgtgagtttctacatgtgctctgatttctccatcttcattttgttctttacagaaagaaaatgacaacttcaacatttccaaaaaagacattgaaattactctcttccatggggaaaatgggcaattaaattgcagttttgaaaatattactagaaatcaagatcttaccaccatcctttgcaaaattaaaggcatcaagactgcaagcaccattgccaactcttctaagaaagttcgggtaagtgacctggcagtcccacctgctgtctttacctgatttttgtgataattccttggctaaaccagaggccagaatggaatctttcatggatcttcagatcctcactttaaatagaagataaacaaagctggtactgcgagcccaagcaaaatagctccaaaatagctggctgaatccatccctgtgcctgttcgaacgtcaaagcgttggacacaccattgtctataatcctaatgagtcttgatagcttttgttctagccacacatttatacagtaggatcggcaagcaaaatctctagacccattgacaaatgagctgtcactcttttctcaaatgcggaggtgacatgtcttagcagaaacccaaaacaaacaagggcctcttcagcacactctgggtagcattagaatcagatggagaccagataatctctgggtcatgggctgcttccttcaccatgaagtcatactttctgcgattaatcttttcccagatatgtttgggggacggatcactgctatatttatatcccataataaagatgtgagaccactgagaagggaaacacattagaagtcaccctttatagtattcatgccgtatgaggctctgtacagcctatataaattcttcttgatctatcatcataaataattggataaaagacaatgcaaaagaacttcagactggaaggcaacaacaaaaatgtgttcatgtcccactggcaccagttaatagctctgtggccttaggtaaatcacttgagtttcctgagcctctcttagtccatctgtatgataaatggggttaataataagttttatttgtttttttagacagagtctcactttgttacccaggcaggagtacagtggcacgatcttggcttacagcaacctccgcttcccagttttaagcaattctcatgcctcagtcacccaagtagctgggattacaggtgcgcaccaccacacctggctagttttttctatttttagtagagacggagtttcactgtgttgggctggctggtcccaaactccttgcctcaagtgatctgcctgcctcggcctcccaaagtgctggcattacaggtgtgagctaccgcgcccagccaatagtaagttttaagtcaggaataacaactaggctgggagagacaactcaagcctataatgccagcactttgggaagccaaagcaggaggatcacttgagcctctagaagtctgggcaacacagtaagaccctgtctcaaaaaaaaataaggaacaacaactcaactcaccagtgttcccacctttcctgttagttgagaagagcaaatgctaacattcttcatcattcatgacatagctcctgagagcctacgctgtgatggggacagacagagaataaaacagacaaaaacatctgcctttatggaggttccctaaagagacacagcgtgaagaatataaataaaaattgtgttacttggtggcagttgctatggagaaaaaaagcaccagtgtgggggggtgggggggtgggaacaggagcaggtaggggggccatgctgcaggttttgcaacggtgggcagaagaggcctgcttgtgaaagtgacatctgtataaggaggagtgggaacaagccatgggctatctggggtagaacgttctaggcagagggagcagagggagcagaggtcctgaggcaggaggctgcctggcatgtttgaagagcagcaaggaggccagtgtgactggagtggagggagcagagcagaggcttctgaggttagagagttcatggagacaacaggagatgattagaaccttgtggaccatggcaagggcttggcttgtgggctgcagaaggcatgggagagttttgaggagggcgccatgagctgacttattcagatgacgtcatgaatttagtcaggacagcctaccaagaggcactcccaacatcccatttcagagatgaggaaaaagaggactggatgtgcatacctaattcagggttccatagctgagaaacagagcaggtggcagagctggtatggagagcttcagctatccgggtccaaatccatcctccagctactgtgctcagatgcctccacgggggcagcatgagtccaaggatggaaacacgccttaatacttgtatgtacatcagtgaaataattaagcttcatgtagagtttttcccttgacaagtttcacaaaatataacccaaaaaaatgctaaaactggaaaaatccctcagggatgatctgatcagcactgccaatctggtttttgccacagaatgttttattcaaaataggatgccaggtacagtggctcacacctgtaatcccagcagtttgagaggctgaggtgggaggatcgcttgagttcaggagttcgagaccagactgggcaacatagtgagaccccgtctctacaaaaaatttaaaaattagccaggtgtggtggtgtgtaccgtagccccagctacttgggaggctgaggtgggaggatcacttgagcccatgatgagttcaaggctacagtgggctatgatcacaccactgcactccaacctgggcaacagagcaagactttgtctctaaaacaaaaacaaaataagcctgcctgtaaaaatgataaaaattgagtttcttccttagaataaagggcaggcaggggcttcttgcctacaggttactactgcctctttattgccctcactcctgcaacttaaaacccccagagcaaagagggccaaaattaagactctgagggtctagtccagcatgtgtcaactgacatttcaggaaactgaggcacagtgaatattctggatttgcccaaggacacatagctaatctgccacagaaatgagagttgaactcagatatcctacccagctcactgcttctttttgtattgtgaagccattttaggggggaaattatgtaaataaatacagtccccaactcaattgggtctaatgacattctttgtcccatcaggtcaagctgggaaacctggagctctacgtcgagcaggagtcagttccttccacatggtattttctgattgtgctccctgtcttgctagtgattgtcatttttggtaagtgccctgtttaattttgtcagagaaattattccctggggcctctcgccgggcaggcagactttcagctttcaggggctgtttgcttcaattaagtataaatgggtgaaagcccaaatcaaaactttgagaaacgaataataggtacacgctgagggctttctaaacatttcttttggccaggcgtggtggctgatgcctataatcccagcactttgggacactgaggcgggcggatcgccttgaggtcaggagttcaagaccagcctggccaacatggcaaaaccccgtctctactaaaaatacaaaaattagccgggcgtgatggcaggtgcctgtaatcccagctactcaggagactgaggtaggaagaattgcttgaacccgggaggcggaggttgcagtgagccgagatcacaccactgcactccagcctgggtgacagagcaagactccatctcaaaaacaaacaaacaaaaaacaaaatttttttttaaaggatgcttcattaatagaaggctggattacacagatggtatcttgggatttgagggatataatctactttgcttctccattccttcaaattgtggtgacaaatgttcatttatgtaattccccaagaacttctctgggattttgggctcccaggacttggttatttcatcttgaccaccccccaccacccatcaccccagcctcatttcagtcttgattttctgggcagaaccacactttagaagtgtggtcatgcctgggcacagtggcacacacctgtagttccaacactttgggaggccaaggagggaggacggcataagtccaggagtttgaggttacagtgagttatgatcgtgccactgcatgccagcctggacaacagaatgaggccctgtgtctaaaaagtaaatgattttttttaatagaagtgtgatctatgtcatctcttaaagtggtcccgggcccatccacacacagtgagcccatggtggttgctcattggccaaatctggtccaccaatatattttgttttgccgtgtagcattgtctaaaactattaagtagcttataacatttaaaaattagtgattcacatttggaaacgtctcttgaaaatgtgaaagatttggatcattggatcccaaatttccatagcatcagtttattagagctgagtagcagctacgccctagagagagggaatgtgctccctaggttttgaccacagtcgccaccactccatattgtctccacctaggccatttaactcatctatgtacctgatatctgtagccatttcgtttgtgactctggttctgagctgcttgtcatttgaagtctattttctctcatccttctttgaaaaaggaactcttatccaccaacaaatagcactttggctgggcccggtggctcatgcctgtaatcccagcactttgggaggctgaggcgggtggatcacgaggtcagcagatcgagaccatcctgaccaacatggtgaaaccctgtctctactaaaaatacaaaaattagctgagtgtggtggcacgtgcctgtaatcccagctactcaggaggctgaggcaggaaaatcatttgaacccgggagctggaggttgcagtgagccgagatcgtgccactgcactcccgcctggccacagaacaagactccgtctcagaaaaaaaaaaaaaaaaaaaaaaaaaaagcactttgtatttcctgatttaacataggtattgactttctgaaatttgacagctagtacaggcagttgccagtgtctccttctatacactcatttattcactcattcatccctgcatctatttaccttatgttcattgagcacctgttatgttgctgataactgtgcaagtctctggagctagaaaaaaatgagcctttgcgtgcatgagccagtgttgctcaaactgaggcctgaggaacagtggtcccaagtgactgtcctggaaaaaggggttccatggtcaagtaagtttgggaatcactacatcatactccaccctttcttagacatgcacaatgcatgttattaagactgttgactttatgaagtagtccagtgaagagccatatttgtttcctccagcattattggtagcagagcccgtctattatgtaatttcttttttttttttgagaaagggtctcacttttttgcccaggctgagtgcagtggcacgatcacggctcactgcagccttgacctcctgggctcaagtggtcctcccacctcggcctcccaagtagctgggactccaggcatgcaccatcgcacccatctaattttctatttttttgtagagacagaaaaatatctttctctgttgcccaggctgatctcaaacccctagcctcaaggcatgctcccacctcagcctctcaaagagctggaattacagacgtaagcccccgcacctggctgtaatttctataaggaggagaagcttcctagaataacagtggttgattgttgaatacctatacttttttaaacaatacattcttaatgctttttgtgagttacttcttataatcctcccagcatcacagtgagataggcactcttacagagaaggcagccaggcacagagatgctgaggaacttaacccaggtcacatagctagtaaatggcagagcaaggacatgaacccaagcaccaaactgggttggtttatggcctctgcagcacagttagaagcaatatggaggtatgggagttccttgtggctcgctcatcatgtcaccccattagctctatgcaggtttggcccatgtagccaactgtggatctgcggttcctttctacgtttgcagcacaactttatttctccagggatgcttacaaacattcaaaaacaatggaacaatgcaagtggctgcagctgtggggaagaaacttggcttgtttcattacgtttcagccaactgggatctttggttacaagtgaaggttatttgatttagctttcacttgtaaaatgagtaaggttttggtttttttctgctgcattttggcatcttcctcttcagagtgacccctcactgggaaattttcttataagatccagctttttaatgctattttctagtttcattctagctcctgctctctgtccctatctgttttgtttttgtttttgtttttaagaactgtaaagattgctatttgttttcatttttggtttttgagttaccatgtccctctgatgcagcatctctgtctcttagcggccgtgggggtgaccaggcacaaatcgaaggagctgagtcgcaaacagagtcaacaactagaattgctggaaagcgagctccggaaagagatacgtgacggtaggctccaaaattgtgtttgtagaaaaacaagccttttatatttatacttttatttttttacccttacatagagatggccacagtaatgagaactgtttgtataatagaaggcaacggaagggcagggcctgggcctggctttgtgttttatttcagctcttctctgcagccaaccaagtcattatctattgtttcttctttaatgaaaaccaaggtcatactctgtgttagacaaaacagcagaagatcctatccattgtttgttgagttaaaatattgctcttgggattctgttttgcaggctttgctgagctgcagatggataaattggatgtggttgatagttttggaactgttcccttccttgactacaaacattttgctctgagaactttcttccctgaggtaaaagagcattgatcatattccgaaggttgagtcttgaataataatgaaggtgcttgttgctgttgtcaaaacgagtgtttgcttccaaggcagctataatgtgcttggtacaaaaataatggcttaagtttgagcagagcagggaggagggtaattattaattgcattgattagggtataaaacagtgatgggtcactggtgattattctttgcccagtaacaaaaacctaggagggacagaagctcagagtgatgatttttgctttcttttactctcaatgtagaactgaatgtgtagctgggaagtgagctagtttatttaaaaatcaataaattgtgagctagccaatttgttgtgtttatctgcatgacttacattgcagtgactagattattcactattacttctcaattggaaaggaaaaatactactggtcaaaagggaggaaagtagacatggatggaattggagttgaaaacaggcatttttagccatgtagagttcttatggttctctttggtagtttttctttagctggtcagtttgtattgtcctcatttagtagacgtagatgcacgaactgattaattcatttgttctagggctctgaggagtcgtctacttaaccttttgggttgctggtcttacctatgttctcacgcctccattttctcacccactcactcagccttctccatttaccctcccaagtctttggcgaggtacactcatcctgcgtatcatcactgccatgtcctgataccccagctctgccatattgcccttcttttttgcggtatgatgaccacatagaggcccaacctcttaaacacatcaataccaatgatcacatttcaatctagacttctaagcaacggctgaaatctctccaggccaaaggagagtttgtatcaccttaccagaagcttctccggaacaattggccagaagcctagagttcagaaacccagacacatgcagtaagcaatttccagtttctctataatttagaagaggacaccatgatatgtaatgcggggtctggaggttggaatgcctccataaaacacctgccatattttttggtccaagccttagtgttataaatcaagaaggctgtaaataagacttcagctttttgtgctggtgaagtttgtttcctttaacttatcctccaagagtaccgaggcaccgagatctaccatttgccacctcatccatttctatggcagaacaccgcctggggaaaggaattcgattccccgaatcaggatgactgtgtggggcttctgcaaaggttgcatcacgagtcctatttctgagctatctgagatccccattaagaatttaaaagcaataaaataacggagatttttgactatcaacatgaatgctgtgtgggcttttacagttaatgattgcccttgagtgctgaataatctgtggcctgaaaaaagaaatgttcttatcttctaaatttggtaatcaagaacaagatagagtaatgaatgtaaaggaacactgttgcaagttgagtgtttccaaaaaaaaaaaaaaaaaaaagatcccaggaacaatgctaccttattttaggagaagagagatagttgcaaaggaggcaaactgatttaactcagtgttgtgtataatcttgaaaaacaactgggaaagtcataaaaattgaagtcagaagttgtttaaaggagagaacccaggaaaaaacatgcataaatttgtcagaaccctttcaagaagacctaagtcaaaactgattttataataattaagaaaagatagaacagggaaacagatcgtaagaagacaatgccacttaaatgcattccaggctgcagataagtcctggtattaattaggctctttatggattgatcagaagccgaatcctctaggcctggaggttgggggctgtgggggtaggatttgggtgttcagcacctacaaaaaagcaacaggcaaaatccagaggagattgtaggttctcaaaggaggccagggttctttgctctgcctgtcggttttggcttttaaagccttgctttttattttattgactcttctttgctttgcataaagtaggagaagaaataagggtaggcagaggatctaagctgaagaaaagggaaatttgaatgaaaggaggaagcagccttaaaactcagagagccacgggtccaggcgcggtggctcaagcctgtaatcccagcactttgggaggccgaggcgggtggatcacttgaggtcaggagttagggaccagcctggccaacatggtgaaaccccgtctgtactaaaaatacacaattagccaggcatggtggcgtgcacctgtaatcccagctactcgggaggctgaggcagagaattgcttgaacccgagatcaagaccatcctggctaacacagtgaaaccccgtctctactaaaaatacaaaaaaattagccaggcatggtggcgggcgcctgtagtcccagctactcgggaggctgaggcaggagaatggtgtgaacctgggaggcggagcttgcagtgagccgagatagcgccacactgcactccagcctgggcgacagagcgagactctgtctcaaaaaaaataataaataaataaaaagaattgcttgaacctgggaggcggaggttgcagtgagccgagatcacgccactgcactccagcctgggcgacagagggagattccgtctcaaaaaaaaataaagaattgcttgaacccgggaggcagaggttgccgtgagccgagatcgcgccactgcactcctgcccgggcgacagagcaagactccgtctcaaaaaaacaaaacaaacaaaaaaacacacagagagaaccagggcggcacttccgtatttacgattaagaatcaacctgtttctcctgtctatttacatgaagttggttcagcagaaaaatattaagaaccagaaaatgcaaacctagggtctgggggtttttttggtttgtttttttggggcttttttgctttttactaggggaggatatggccaaaatagtttcaggtcttttgcttgggcttgcagatttgaaactatgaagcaaaattctctacagaagaaatttacttcacaagatataaaattagctcaaagtttctattattatcaaaaaagaagaaaaacttgaatgttttgagtttagagtctcattctgtggacttaaagtattgcttaacatacttttaaagtttaaccattgatttttaataagattgatgatacactataaaccctttttatattccagagctacctagcatttagaaaccagtggggtgatagcattgtggtctagtttgctataaattaggaataaaaccagtaatgataactgacacagggcacttactctgcacccattttattttcacactaaacctctgaggtgggaaccattactgtccccatttcagagatgaggcaagtcagacacagagaggttaggtaacacatcccacgtcatgtgaccagtatgtgattaaaaccaggactggaacccaagtagtttggtccagattctatgcttttaactaccccctgtctttcaatatcattgtgtattgaaacagtagatgctacttaggtaagacttgtaaaacttaacaacgtaatttagtctttatctttagaaggtaaattgcttgaagaggggtctgatatttgcataatcttcatcaatgaccccttctttaactcttaaatcacttcttctaaaacgtgggatgataccttcatctaccaaacctggaactaatgccatgataattattattcttagaggctttcggaattcagtggcgtttcttgaaagctgaataattatttattatgtattagagaatacgcagccaccataaacccaggggcgcttcagattagcaaatagtgtctctactttattaaaacggacttgggtattataacaaaaatacactcttcatttcctttggatgttatgaataataaaagtgtctccttcctctcagtcaggtggcttcacccacatcttcactgaagatatgcatgtaagtctctacgttttcatttttagcccagtgactgcctgatgttcatagtgttatcatcatcactatcatctctattattattactttgaatttttattgtgggttttttttggatcatgaattcaatattgaataattcattgtcttggaaaacccattgtgggtctactttctaactttaaacttatatatgattttgtattatactatatatttttttctttttatcagaacagagacgccaacgacaagaatgaaagtctcacagctttggatgccctaatctgtaataaaagctttcttgttactgtcatccacacccttgaaaagcagaagaacttttctgtgaaggacaggtattagtccattctttgatgttttaaaagcctttaagaaaaaatcaggccgggcatggtggctcatggctgtaatcccagcattttgggaggccaaggcaggcaatcacttgaggccaggagttcaagaccagcctgaccaacacagcaaaaccttgtctctacaaaaaaaaaaaaaaagagagagaaatcaaacctgagtcccatattttatttccaaaccactatctgaacttggtatcttgagaacatgcacttttccaaaggctatttgattgggagtttatgcagccttctctccattttagatcataccaccccaacacaatttttttgttgttgttgttggagtctcactctgtggcccaggctgaagtgtgtgatcataggtcactgcagcctcatcctcctgggctcaagctaccctcctgcctcagcctccccaagtagctggaactacaggtgcatgccaccacacccagctaatgttttgttgttgttgtagtagagatggggtcttgctatattgcccaggctggtctcaaactcctgacctcaggtgatctgcctgctttagactcctaaagtgctgggattataggcgtgaaccaccatgcccggcccataaattcttaataaaaaaagcagaagtgttaatttttatttttaaaacatcccgaaactttggaagactcacatcttgttaccactctagtttaaatgctgaaaacacagaaaatgttctagagatagaagtggttagaatctaaacattaaaaaaaaaaaaaaaaaagctcccaacccaacaggccagctccctgccctgccagtgagcttccatggaaactcccatgggtgtccagctaggcctgcagccaatggttcacccagctctctttttcaacaggtgtctgtttgcctccttcctaaccattgcactgcaaaccaagctggtctacctgaccagcatcctagaggtgctgaccagggacttgatggaacagtgtagtaacatgcagccgaaactcatgctgagacgcacggagtccgtcgtcgaaaaactcctcacaaactggatgtccgtctgcctttctggatttctccgggtaagtgtcacatccctcagcaatgtcagaggtaagacaataggcagttatttttagcggactctgatgcctttgccaggataaatcctgaatgctcgatggtgtcagcacttaaccatgtttcgtcttggtcctgacccagaacagagagagggaaagtaaacattgtttttgctgcaactggcctatgcaaatgtaattcatttagaatttcgtcaggtgagacttttcaggtgagtttaccttctcacgtcaattcacacccagagcccagtcagcccatttaagaaaatgtactgagaaaagggaatatttcaaacaccagagaacaaactgtttcaggccctctgaagcattgtagaaatacccgttgcctaccaatatgctgtaagctaattgcagtcaattcctaccagtcattccgcattaaagcagctctccaaagagctgcctccccctggagtttgctttgttggagttactgtgtgcatgtggttgtcactaattgaactttaaaatcttttcaaatgcaaactttctatagattccagtggagaagagggtgggccctaaagtctgctacttgatctgaatctagacttcaccacttacttggttttataaactagagaattggaagaagattttaggactattttgaagtacagatgagaaaacataggcaattgcttagccctaaggaagcctccataaatgttggccgttacgattataaaatattaatgtgaaaataagggtgtcctgttgaactcgatcttcacccagccctctgaggcccctggtacagaagattcttatcctttaattttaccagccatccagatttcagcaaaactgcataattgtgtatttgtagctagttccgaaatctaattaaactttgaataagatacactgctatgccacaggttttaacagtgctacttaagtttagatccaacagcagtgctttaaatagactgtgcttagtttaatgtttaatgcaatcttacaagtagatgcacaacaattttttttttaatttctcaccaacccctccctctccctaaggcaatacccatttattaagattaatgaaatctgccttcttttctgtttacttggtataaatcatcggaggctttggggagatgttgagccagttatttctgggacgaatatttttttgtttcccactgtctttgctttagccacaacagctgctagatggaggcaccaggactctcacccagttccctggtcttggtcttcaaaggccaactcctgccccaccacagtctcactggatcagaagctccggaagtggagcccagtaatccatgattttcacaagtccctgggatagtagagagagcaccacactaggggtcttggttagaagcagcaggtctgggctctggaaccatctcagccccggtcagctgtgtgtccctgggcatggctttttccatctgggcatctgttttcaatccaccaaatgacaggcgtgtgtgggcgttgcctttaaatccctttccagctctttctactggatcttgtgattcttaactctgagctttcaagggctgctcttgggcattagaggggtgagatgttcagaaaatctgggctgcgagcccaaacagcctccttgagcaaagcattctgggtcaagacttcacagtgctgattcaagagcgtctcgagcactctgagtggtgagggggcggctcggctcgccaggaggaagtggcatccagccagtcggcgatactttcactttcagtggaataattcccgctggtgcaggggtctgatgtccctccaccaggtgctcaagggggtctgggacaccgacagccctagtcctcctgtcctaccccacagacgtttagtgggtgacagtagctccgtgaccgccaggtaactttcccttccaagacaccaaggatttgtgggtaaaataataataccatttattgaatgtgccagacagcatgctaagagctttacctatcttttctcatttcatccccttaagggtcctgtgagctaagtgtcttcatgaccattttgtatatgggggaactggaacacagaagagctgtgactctccccagatctcactgctactgtgggacagcaccagggtccgagagctcttagccaccgccctgtgccctgaaaagatggaatctgccctggtctgttaaagtgtcgaagcctggcccctgggggaggggaatcacgtacgcagcggctgtggctcgcctaaaagttgtgtttagtggtgacagagaaacctcatggccctgtgattccccaaatcagccacacatcagaatcctcctcccccaccgcctccccgcccccggccccgggaaggtaatgaaaactacagatacccaggcctcattcttcagagagatggcagctctgtaggtctagagtggagctcaggcatctgaatgcttaacaagagcccgcaagggattctggtgattagccagggttagacccaggagcatgggcagagtgtagggccagatgttacttagctcagtctagctactctccagaaagttctggagaattcctgaccacaggcctcctgagtcaagacctgtcccttcacacagcccccgagagcccacctggccccctgactccaacccctgcgggagtacacagcccctatccaagggttctcagcctcccttctgatctgtgctggaggaaaagaggttctaagttttgtggtcagggcattacttggggtgggggaggtgggcggtggagggaaagagaagagaagggtgaggttgtaaaccactaaataaaggaagtttctcatgagaattaaatgtcatgcactagtcctgctgccctccctaccttggaaatttctgaacttccacttctgccctgcactgaagaggagactcaaggaggtatcacagcagggatagaagctgcagggtggcaggaggtggcaagaggaagcccggggactggggagggcagatattcctgcagcaagtataaaggaagggacagggttggggtgggatgctgagagacttaagatgtcttaggtaacttgcctgcgcaagggaaagcaggtgagacccagtggaatcctcctttcccagctggacgtatcgcttgtcaagcttgactcttaactggcgcttcgagccccagccacgtggctggcctttcgtcatcactaaggcactttgacttcccagccacggttcttcctccaccacagaggcctaatgtccattgattacggaaggttcgttatttagcaaatactctacagctgacccagggctaagtgccttgggaggatgccgtggaaacagaacacaccgcctcccacttgaggtgctcagagtcctttggaatgcagacatccgtgtctgcgaatgtgagccatttccatcacagcaggggaggcagccccacccccagccaggaaaaatgcatgtggcttaaatttgtagaaagagccaatcgggatgggccgagtgtttggagaaaaaccttagaggaaatggaattggctctggttcagggaagaagatggagtccctctggcccagcaccggaaaacatgtccaggtgggactgtgcagtgtgtgtctgggaactgcccgggccgggcctggcctggcccatggagaggagataaggctgcaaactgttgaacggcaggctgcttccttcgagaagtgctgttaacaccaaaaaacattgtatttggcaaatgtataaaatgttcttacatttatccttgttactaaggatacttgtgcatttttttaaatgtcgtttatttctggcttgctaaagggtgattaaatacgaatgtaaacaaaggtacactctccacatctaactgttcctaggcattaacccactgatgagcattagtctgccatatgtaagtttaaacataaaataacaaggtatactgtgggtactgcacgtcgctgtgaatgtgcacgcgtgcgcgtgtgcagatgtgcattcgcgatggagagaggaggcggttttctgagttttgcatccaatcccaagtggagcaacgtgtattttcttgggcgtttcatgttgagtgttagaaaaccctgtctcctgccttactgctgtaaacagaaactttaattctttggaaagtacagtggattccacagaaagctaactgtcacttttgtgtcttttccaaggagactgtcggagagcccttctatttgctggtgacgactctgaaccagaaaattaacaagggtcccgtggatgtaatcacttgcaaagccctgtacacacttaatgaagactggctgttgtggcaggttccggaattcagtactgtggtatgttttcaataaagctcccagccagactcccaaataaatctggcggggaattagagggtgaggtgggtcatttacaatgaaacggtatcatctctactgcgggaggccctgtgtgtttagttaattaaaaacagtagttgataaaactgttaacacgtgttcacataatagattttaattactgagattgggggagaaaatattgtaatgatgcctggggtactcatcaatttccaaagattttaatatcaggattgcttataactttcagtgtcgtcaaaggaaatgcaaagtactccctattcagcacttataattgcaatcagaatttctcaaatggctctgctctgggaagacaatgtgtgaagatatatttcaatcaaattgaggccgtcttattttagaatgataacacaagacaaattccaccacgttccccatgcaacgtgacgccctttattttcatggattagttacaaatgtttggtgtcatgcacttaatgtactgtgatctcatagatatttttagaggaacgctgtaaatcactacaggaagatgattgcctagctgctggagggtttcacccgcttgagaacttctttctaattcatccccaccgcacccaccccatgctcttcctaaagaaagaaagaaagcccagtttggggcacatttgggaatttcagagagggagccaagcagggaaggtaactttagaattaggaattttctatgcttttctgttagtagagacttggagaagagattgctgtgttttggtttgatctttagctttatgaagattctgggcttcttcacgatctcgttagtggaggaggaaaagattacagtggggtttgggaattgctcattaagagagctgagtcttctgtggctttgctctggatggtggggactgcagtgtcatctgggaagaattcattccctaattggagaaggcaccactttgccgtggagcgtgttatggttatgtcctctggtgggagaatagtccgtaggtcagctgtttcaagttttctgccactgccagatgcggctcacttctccatcaaagatggcaccatgcacagctgccatccgagagcgggaagctgagctgaaagtcaacacttctcagcgttctgaattgtatcaatacacccatccacatctgagaggccggagagtgggctgcattggttctcaaacttgagcatctagcagaatcgcccagaaagctcactaaacaccagtcgctaggcagcatgctggagtttccgatgcagtaaatccaggctgtggcctgagaattcacttccctaaccagcttcctgatgctgcgggtgctgcttaacaactgttggtagagtggttaacagcatggactctggggccagacattttggaatcctgcctctgccactggttagctgtgtaatgttgggcaagtttctaaacctctctatgcctcattctcctcacatgtgaaatggaaatgatggtcatggttcctacccatctcatgaggtgttttgaggattaagagtcagtattataaaaagcacttagaacattgccaggcatgtgagtgctacctaaaactttattccatttgatccagatctcattgaacccttgtttaaaatgcaggtgcaaatataccagtgcccgggctttccctcgggactgactgaatcagaatctctggggagggagcccaggcgtggatgtattttgtaaaccttccagatatctctgatgtgtgttcagcctggacaccactgggtatcttggagaacaagagacaaactttgcacagggcctgttgactcacctttcgctgatcctgggcttgttattcctaacctagaagatgttcatgcctttactttaagacgttttagaagccccaaaggtctccaaagagaaatatttgcaaatgattatagtcgggaatcctccagcatttcagtcatgagacaacaccggacccaaacaggaaagacaggaaaggagaagatgggttggaatcaggaagaggtcagatgtctgaggcaacttttgaggttttgaagcctttttaatgctttacatctgaacgtgttttctccctttcatttcgaaacattatttatttcacagtcaattaagaccatgtgtttctgatttgttaacactcgactcatcatcataatgttacttgatgctgaaggaattcatgtcgactcttgaaatttttttttctttatagcccctggggaaaagggtaatggaaaatcatgatttcagaaatccacataaatcttccttttcaaattcagatttgccggtacataagatttgagccttgaaaaggaatgggccacttgtttttaggggccttgcctttaaaaatgattgttagtgcctcttatggggcctggcccagcccccctttcatggttggcagttgtacgagaagctgcagagaaggcacatgatccgttctatgcttgtgtgacaaactgttagcagaaggtcaatataaaaaatttaagtttttcatttcctttcaggcatttcccccagcctgaaccaccatatttctaattttctttcttcctcccttccctcctccccttctttttcacttcccccacctacccctcccaagcatgtacacccagccattttaggacttgatttcccaaatttgcctgaggtggtttatgtaattgaaaaccaaggtgcggtgaacaaactgattctgtgtgtccttgtgtgctggggaggtgggaggttgggggcagattctttcaaggaaaggaaagtcggaaatcaagagcatcctcacgaaccacttgaaatgacagaacctggtgccaaggcagggacacgtttggaaaaaaggcccccacactcgtgttcagctaaatgctcagaagcacagcacctcatatagcaatctaaaagttagctttcacacctctcagatgaggatgtgttctccctgaggtgtgggggattttctagaacataaaggcatcttgccaatttcttatacatgaaatcatgacactaacaaagaggccctgggaagtaatgttctcttcttgcatattgagaagaaaattcctctgtcttgccaaaaatccaagcaaagtcccctagagccatacttcctccaggaccataagaaaccatccttctctatcaagcattccaggctggtgtttaatgaggcaacagtgagacagaatgccctgatatctgcatcctccctaatgtcagcaccaggggtagggctgtgcacacacaggactttagtctttccttaatatctaggaattcagatcagacagctggaagagaataagaccttttttttttttttttttttttttaatttaaggaataccactctagtgcaggctggagtgcagtggcgcagtcttggctcactgcaacctccgcctctggggttcaagcgattctcctgcctcagcctcccaaatacctgggattataggcacctgccatcatgccaggctaatgcttgtatttttagtagaaacgggttttcgccgtgttggctagcctggtcttgaactcctggcctcaagtgatccacctgccttgtcctcccgaagtgctgggattacaggtgtgagcaactgcatccggccgataataagacctattgctctgctgggtttttttcccctttgcaaaattttgaacatgtttgattttgttgatggagtatctcagactcactcagcttacgttttgtcaagagtggaactttggaggagttagtgaaagtttgaggatttcacatgggagaagggacatttgcttcactttcaggaagagatgagaaaaaccaataactcgtagcaagcgtgctgaattagcaagagaaggttgacttgtaatcaaagttaagtgtgaaatggttttttgaactcttagaaaacgagcttgccaatctgctgtatctgagagagagcatcttggcaccctggaaaactgttccgacaaaaatattattgccttcattctcctatctataagaaagttttcaagattattagaaattcttgaaaaagcacaagtacatgcctgcagaaatattaatgcctccaatttgatttattgaaggtttatgccagcctaccccagtctgtctctttctctagcagttaccattttgggacaattacgtttaataaaatatctcatatacaacagagccctaggtgtctccaccaggagtttcttactagtatacttcctttaacagtgctctgcctaccagtgctggctgcttctgttccatttagtttgtccttgcagaagatccattagccccgtaattaaacaacccactgtcccgattaagtcattctctgttacttcaattacattccattgttcattaaatcctgatgtttgcacttcagcaatcttgtttttaatactcctaccatttgtggagaaacagtgaagttaattaacaattcttgagctttttatttttctctctaccatagtgcaaatcatttccattatgacttgcaatagtactgaaaccattactaacttcatagttagtgttctgagcttcctgatcaaagagtgaaaccactttttacaatcattttaggtaagtcattccctcgttgatggcaagtcatggaaaatgaaaaattaacatgtaatgggtgctttaaatgactttcctcttcatacactttcttctcatgcctgtaatcttggaattagaaaataatttagttatctaaatataaaagtatttactttttttctttatagctcaaatgtgactctattatgttattgttaggatcattatttatatttgtacccctcagagaatggtaaattttatcacaagtcatggcggagatagaaagcattttccagatttgtcttgttgctattgtcaaagttagcattccatttgaaggtactgttatctagagcagggaccagcaaacaacagcctgtgggccaaatgtggcccctctgcctatttttataaagttctattggaacacctgttcatttccttattgtctatagctgctttcctgctacagtgcagagtggagtagttgtcacagagatcatatgagttttaagtcttaaatactttctggccctttgcagaaagtttgttggcctttaatctagagcttgacatagtagagaataggaaccagaatcctccctcccacaaacccacaaacaggttggcctctttcctccccttctgggacacagcaatggaaatgccttgccactatttacaagtctgaaactcatggggctctttgccaacacacaacacccacccccacccccaaccctgcacccgcaaatactgtgaatactaaaatcagttatcttgggctaaatcagacagctcttcatacttgattctaggatggacaaaacgttagcaaatgctagcaagtatagaaaaattggtgagagaaacctaaatttgagaaaattatctccattacttttttttttttttaaatggaaaaaggctctcgttaccctgtcctccaccccttactcttctgttagagtagcagatcccttgatccaggaagctgtgatttatggatctttgtggggaaaggaaaaggggagcagagtgaagaggggaggctggatgggcaagcgcagctcaaaggggaacgtcaggcagaatgtcccagggctgctgactctggcttggaaagaagcttagatcagaagtttccctcagacttgcacttctaactggcctcatgctgcttctacggaacttctgaaactgaattttctttcttgtttcttctctctttaattcaggttggtataagaactaggcttttctcttgactttcattcggccctgaaataaaattagaaatatattttataggttttatttaatgaaagcaattattgctccaaggccttttatgataaagttgccagtttgtaataaattatcttacagttactttctaggcattataaggtatcacagaaaggaggcagcaacgttcctgcttttattagccaagaatatggttgaggagacagtgaggtagccagatcatcttcccatgtgggaaaagacctgttcccctgcccttgattcatcctgccagccccctgcagccttatcctctctgcctcctcaatacccaaaaccaccaaatcatgtgacgggacgatgggtaaaaccggtagtgaaaggggaatgcagttacatgttcccaggccgtgtgcagaagaggtggggtttggagtctgatagtcttgggtttgaatctgggctcagccactttactctgggcaagtctctcaacctctcaaaacctgtttcctcttctgtaaacaggcaatgaccaaaacctgccctcgcatatttgtggtgaggtcagaaaataatacatgtaccacgtctagccatctttcctggtgtgaagtaggtgctcattcttttttgattcagttttccttgtctgaggtgtgcttttctcttgtctcctgtaagcttcactaagcagaaagtgtcccgtcagtattctttttggttggttatttattgatgatgtgggatgtgggggagttgattagctgattccatcatcatgaaaagcatttcttgggtgcctgtgtgcttatgttcttgttaaaaatgttacatatgaccgctgtgatggggtgtttacaacctgtggcagacagtatcccattgggcagatgtgaacaggagacgaccgtgataacctgtgagaggctgatggctgacatgctacaaaggggccaggcctttccagcctggccctcttcccgggccttctggaccatacattttccaatagtcttttctttctcataaccctccttggtaataggcatcattcccaaatcaatcaggatgcagttcagttgtacagaacagagacccaagatgtctgtggcttcagcaacagagaagctgagttctctccctggtggcattctgggtgggcagtgcagggctggtagagcagctgctcctctcttgtcctcatattctaagtgtctgctcaccccagcctcattccccatcccagccagcaggatgtaagcagggctgtagaaaggagggcagatggtcaccagccatcttttaaggaagtgccacataacatatccacttaatgtcatcggccaggacttagtcataaccagaacatgtcctgactctgagctgcgaagccaagaggccagctctgggtcaccatctcccagtgcctcctggccctgccatcctagtcacaagatggctgccaccgctccaagcactactctcccttttgttcggatcgaagacttcccactgggcatggtggctcacacctgtaatcccagcactttggaggccaaggtgggaggatcatttgagcccactgaatctggagcatactggccacacctggcagcagcagaggctgggaaatgtcacctttattctgggtgaacagaagctctgtaaaaatgtccttgggtggcaccggaggcacagggtgctccagattcagtgggttctgtggggttcaatatcaagctggggtgaggaggtcaagcctcctctaccagatcgcctatgtccagcctgtctcctgggagggcattcattgaggccttcaagcagaggggaactgcccttgggaggctcatcaccttggctggcctcttcgcttcgcagcccagagtcaggacacgtcctagttatgactcccaccggctccatgattttggacatgcttctaaatctctctggtctcggtttcctcatccattaaatgaggctaataatggcacctacttcatagagcagttgtgaggattgaatgaacctataattgcattcccagtacgtgataagcactcaataaatgctggtccttattattacaaatctagaaccatattcttttctttaccatatttttttcctatgaatagtacagggactctctttcaggtggcaggaggtggttttgggaggcaggcctgggctacaagtcctccacccatacttccacccaaagaaggtgggatttttttctgtagacttcctgacctgatagcctgagtgagtgattgaagcttcctgctcaccagtctaattagagactggaagccaagtgtctccatggtctaggggcctccctcatgaactacagctctttgcgacccaattcaaatgctgcctcctccatgcagccttccttgatttctctgtttgaaaaccccctgccgacctaaaagaggtacctctctaaatccctaaaatgctccgtctgtacctcccacattctacctggcattagaatgtgttgtatatgccccacagttcttctactagtctgctagtacttcccaagcaggatgagtacaggttctgatttgtatcacctacagtgccctgcacacaataggtgcaaagtaaatggtcatcaatagacgaatctacctcagcatccacaaaatgagctctggcagtttggcacatgcagctataagtaagagaaaattgaactaaggatgcctgaaatagtaagagcatgacttgcctcttagagcagaaagtctggagggaaggagctccaagccggtccctacattccgtggtgtcagagctctgcgtcaccatctcccagtacctcctggccctgccatcctagtcacaagatggctgccaccgctccaagcgctactcccccttttgtttggatagaagacttccaacagggtgtggtggctcacacctgtaatcccagcactttgggaagccaaggtgggaggatcacttgagctcaggagttcaagactagcctgggcaacacagcaagaccctgtctctaaaaaaaaaaaaaaaaaaaaaaaaaaaaaaaatttagccaagcatggcagtgtgcacctgtagtctctgctatgtgggaggctgaggtgggaggattgcctgagcctgggaggtcgaggctgcagtaagccatgatcactgcacttcagcctgggcaacagagtgagaccctgtctattaaaaaagaaagaaagaaaacccttggttttatgtgttggccagagctgggttacatgaccagtccctggtgaaagagaagggagttgctgctgatcatgcctcccaacccaggctggacccactgctgtgcagacctggcctttgttagcagaggagggatggctgctggttggacgacaaaccagatctgccaccgcagcttactgacactttcctgccaaggaaataggaagaggcagggcagtccctctaaacagagggcagatttctggggaagggaccagtgtacatttcacagctctttagcctttcatgggtattttctgggtattatgccatcccatcgatttggaccatgcttactttacaaaacattcttgtacttccaaaggcaggatcaccgagtgtttaagaacacggagcttgagtacccggttctaccatcttcttgctggctgaccttgtgccatttatttaacctctctgtgcctcagtttctcatctgccacaaggggatgagtaaaagaatctacctcacagggttgtttctgagatttacatatacaaatacacacacgtcatttaaaacagtgtctggcacctataaagcactccttaatttgctattattatgtgtcattatttagtgatcctgtcactcctttgagataggaacagtgaggattttaaggctcagcgaagttagacgacttccctacattccctcagctggtgagcagcagagaatgggagggtccaggtggcccggtgctgggcctggaactcagggccctgacccccactgtcctccctactcagaatcctctgtggacacttgctgagggtgatagtcactgatgggtgactgttgtcccacagatgatgcttttgtctctgaaatttatcatgaattatctgagaacaaggactatgtcataacatctctctgacatcccagccctaatactaaatagggcaggagaacatgctggttaaatgggctttggtgggagtgtgggagccggagagatggcgcttccatcgaggtgtctcccccgatggggtacagtggctgagggcagacgctgtgatgtcacgctgtctgacatggcacaggcatctgctccccatcacagagcagaggcccgcgtgcactttcccagcctgggggtggaggtgttaagaggctgaccccaagggccttgactgtacttacgccttaagaaactgctgtttggccgggcgcggtggctcacgcctgtaatcccagcactttgggaggccgaggcgggcggatcacgaggtcaggagatcgagaccatcccggctaaaacggtgaaaccccgtctctactaaaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaagaaactgctgtttgagcactaagtgttagcagcatgaaaaatgaacacatatcaatttatgtctgaatttactctcagaattccctgtggactctgtaaaatgccattttacctcttttccacccatccagctgtggaggcagtggcagatttacattattttacatccagttaagggtgttttttcttttggttatgtttttaaaaagaacatttattgcccataaaaaagtgtttttgttaaagacaatagtgcctttaggtagtaatagaatgctgtttcacaaatatttataaaactattaaacaagctgagattgctgaagctccgattaaaaggtgcctcccattcatctttccctttagaaactgaagtagcttaactgcaattacccgccaccatgagaagatcaccttgcagagaaataaggcaagaccccaacaagatcgtaggtggtggcaccagcattgaccccttcacacccacccctcccactggtgtggggaatttagcttaggacattgcttacagcctgagctaagccagggtttctggagggtcaggagggctcctgggctataggtggaaccagaaggagggagggagggcgggtggtaaagcggggatggcatagccgaggggtttgtggcaccaattgtgcagttaggcaaatctggcttcaattcctggttctgccactggtgagctgttcctggagcaagttactcagcccctctgtgcctcagttccctcactctacaacagggatgggaataataatccaggaaacatttctagaaaagggaggtgaggagagggctcgggtgtgaggcttcacatgttggttccttctaggcactctgcccaccagctccctgccttctctcctgtctggtattttttgtttcttgtttgtgagcagacaggcctttgaaccccttcctagtcggtggctggcccagaacataaaggttctctgagagcaggcaagggagtgactctgttgtaggagggaaactcgtacaggccagacggagatcaccggcttacctcagagttcagattccactgattcggagttttaatcatttggttgagaccagaacaaaatttactcttgcgtaattatcaacaggattataagggcaagatttagtggtgtttgtctcagctctttataaacaccataaactgggtggcttataaataatagaaacttatttctcacagttctggaggatgagaagtccaagatcaagagttggtgtcctgtgagagccccctttctcatgatggcgccttcctgctgggtcctcacatggtggaaagggcagggcagctctctgaggcctcttttataagggcactaatcccatttatgaggactctgccctcatgatctaatcccctccaaaggccccacctccaagtaccatcaccttgggggttaggatttcaatacctggagttagggggacatcaatattcagatcatagcagcattaaagacaagaaacacccctgagaacctcccgaaatttcagaagccccacatccacgtcagtggtccataagtcacgggctcacatgccagatgctgttctaagaactgtgcggttactgttgttatgccctctttgcagatgagaaagcgacatacacagaggttacacagctggttagggatgggttcagaggtcacccagctggcttgcggtggactgggatgaaagccaggagtctactggcttccactgggttcattgctggcagcctcctccttattcagagatactgagcatggagtgggcgtcctagctgtccaatgtgggctgaatctgtttgcaaatgagtggatactaatgccaacaatagtaattgtacaggttttattgccgatactatcatcaagcctttcccagcagcctggccccgtgctaagcccttgaatgcatgatcacatttaatctccctaacaatgctagaaggccggtactgttattacacccatttttaagttgaggtaggcctgagggttcccatcttccatatgatttgtgttttcatctctcccctgagccctaggcaaatcagacattgcctcctgcagcctctgcatatatacctggctagtgtccacagtacttggggacctcctctttcggctttggagccccccctccctctgtctctgtatgggcgagcatcttccttctgtcttctcccttccttcttgcctgttagactctccgctccttaaaaccaaaaaaaacaaaacaaaattcccattacttgatcattttacattccctcgttaagccaggctcaaaacattaaataattgtgcatttcacaccatacccaagcctttctgactttgtgattaccaaggtgcattagaatctaaactgctatgttatgctatttgcaaaatactcttggctcttccctgaatcaattcccgtgagggtacgtatcaggtaaaactttgttgttttagatctatttgttcttagacaaagtaaacttggaattgcttttcagtttgttttgaaatattccctagttctgtgttttcacacgtgcacaaaggccttacttcccccattagtctgattctgaagttttgctgcactaggagaatgttcactgacaaaatgttaagtaatggtgctgaaatgtaaagtaattaatgcaagaatcatagtatggggtggggatctcagtgctttaatgagggctggggaaaccatctgactgaggatgttgaaagcggaggggtagatgaatgttcctgtaattaatgctgcatattaaaaaagtgacctctttgggccgggcacagtggctcacgcctgtaatcctagcactttgggaggctgaggtgggcagatcacaaggtcaggactttgagaccagcctggccaacatggtgaaaccccgtctctactaaaaaaatacaaaaattagccaggcatggtggcatgtgcctgtaatcccagctacttgggaggctgaggcaggagaattgcttgaacccaggaggcggaggttgcagtgagccaagatagcaccattgaactccagcctgggtgacagagcaagactccatctcaaaaaaaaaagtgacctctggcatggtcaatatggggacctcgtaaccttccctgtcacctagaactgcacttctgggactctgtggtcctattaataaaaaagataatcaccagtctgcctcatctactgtggaacccttccaattcttttttttctttttcttttgaggagaaattagaaatcaccaaattaccatttttagactatttatgtgtatatgtatattttactctcagatatatttattcaatgcttgctctataatgagagttttaactttctgttttcccttccattatccctgaaaagaatggattatggagaaaagatgaaagtagtctaatgcaatacagtgtttgctaatgtgctgtcagaggtattagtgggacttgctaaggtttgtgtcttttatgaaatgcctttcagattgcaattatctaatagacttggaaacctgtttgtactcttgcaggcattaaacgtcgtctttgaaaaaatcccggaaaacgagagtgcagatgtctgtcggaatatttcagtcaatgttctcgactgtgacaccattggccaagccaaagaaaagattttccaagcattcttaagcaaaaatggctctccttatggacttcagcttaatgaaattggtcttggtaaggcggtgcgggagctatgtggtcccaggccctgatgagtgtccctccctgcctgccctccctccctgtcccccctccctgcccccaccagcttccattcagtgacacttacacagccaggttgttcctggagggcatgtctaggggccaagagactgctttggtctctcatgggcatcctgattcttcgaaggaagcacggtccttcaaagatggcgtttgttgttgttgtctttaaatattacgtctgtaaatcagattgatgagattgcaggccctgagactgcacggaatcaccttgcatcatgaaatacagaaaggtgtcaacacagtgccctctgcgtgtgttgcatttcacattggcatttgatttgtttgttgtgatactgagcgtgtcattactgggtggctcagactctgggtgttaactctagcctgctagaaaggtcatcttcctctgctaatcacatcctgtattaagtatatgctccgtcctccctcagtgtgcagcagcatctgctatgaattcattttcgggctctactggtatactgcaaaggagagcatatgcgtgagcaagctaacagggccccacttccctcaaatgttcatcaacattttaaagttgagctccgtgcagtcctcccaggagactgtcgtgggattttatagcagataatgggacagaaatgaagaatagaatcatggtggtgacagacagtgtaacgaggttcacttccccttgatgtacagttataggccttgactaagcaggcaattaaaatcctcccactcggccctcccagtccagccccctgctaaaaggccattgataaagccttgaggcagggtcttggaagtttgagaccatgcaaatgtggggcaacttggtgatgtggctttaaagaaagcagggctgctaaggcacccctcttctgcttccttccttgggtgaccgttgagtcacttgaggaccattttagctcatttggttagatacaggatcaaagggggagccccagccaggacaccatgaccctgaccccagacccccagcttccttgctctgagcatacatcttgcaaatatgtggctgtcactacaaaggacatgggcataccccgcccgacagtcttggtcctgccgctgatgagtaggtagtagcatccttactcttttcctgagtttgggtgtcccttgcctcctaaagtaggaaggcaaggagcagagcaaggagggggcctggggacacagcctatcagctatgtcaggcttctgtgtgcctgctgatttcccagactacctccagaaaccagccatcaactgtactgaaatccaacaccaggctggacgtggtggctcacgcctgtaatcccagcactttgagaggccaaggctggtggatcacctgaagtcaggagtttgagaccagcctggccaacatggtgaaactctgtctctactacaaatacaaaaattagccaggcatggtggtgcacacctgtggtcccagctacttgggaggctgaggcagaagaactgcttgaacccgggaggcagaggttgcagtgagcccagattgcgccactgtactccagcctgggcaatggagggagaccctgtctccaaaaaaaacaaaaacaaaaccaaaaaaaagaaatccaacaccagaagcagctatgcttggagctcttacagcagagactcaaaaacgcagatgcccaaaggggcagaaaatacataaggggtgtcagccgcctgggactacagaaagcagtggagcttgacttaatgggaaaggactcgccatccaaggggacagtgccatttgcttcagtggttgccatgtggactacagattgtattactagactgttcgattttctttttttaaagaaatcagatatccagttttttatatgcaacttaaaaacttttaaaaaaaattttatagagacaagtctcactatgttgcccaggctggtcttgaactcctagcctcaagtaatccccctgcctccgcctcccaaagtattgggattataggtctgagctcctatgtccagcctatgtgcaatcttttaatctttaaatgttggcactgagttgacactaaaataataattaaacaccatgcaggttccaaaaaaagaaaaatcacatttgtgcaccacatgctcacctaggcataggttagcagccttggccagagagtctgcccactgtggtgctgggaccttcgcacactgatgcctccccctccaccccgaacaggagcctacagagatggttcatatcatgcctctctttgtgaacatgggcacacaagtgtgagcatatacaaatttgcttctggaatttttgttgaagagcttagtcgtccctcatagaatgcattattttgtcttcagtggctttacttccaggcttatcagggaagaagtggtttgaaacatcagagccctaaacaaacaaacaaagtaaaacagaactcagaattcaggctaccagtctggctgatgcatctctacaccttcaaacaaagatttaccactttattcaagttttagttatccataaatttgtgaaagtaaagtggtggcattttaaaactctctaaaaaggaacaaaatgctctttttcagagcttcaaatgggcacacgacagaaagaacttctggacatcgacagttcctccgtgattcttgaagatggaatcaccaagctaaacaccattggccactatgaggtaagagcaagacttgaccccgtgtctccttcctcatccccaatcctagtcccatggacattcttttaaaacatccaggactcccacccatttcctggaatgacttgcagatcgatcgtgtctggggctgaagttttctttcgttgcttgtgcagacaagcccatgaagggctctcacagtgtacttgtcacgtattcccttctcagaaggctatgattttctatctcctgaactctctccaccctgaggttcagcagaaaagaacccaggaaaaaagtctaggaaagccagagaagagttatcctttagccttcactgggtgacaagcgtgctgatgctaaacaaagcccgggaagtcccaagcctcgcctccctccacaacattcacagtagaccttgtaaccttttgtgtaggtccttgcttcctgaagaagttctaaatttcctgtttgtttgcaatattgagcgatacttcctttggcctcttaacccacatactgggtgagtgccgagggcggtgaggggtgcacgtgacttctcagagatctgagtgccagagaaacctgcacataacaagacagaggaggcagtgaaggttcctgaacacactgggatactggggttcacttgtttagcagtattatctgaatctttgttgaatatccactctgataagagctggggctgcatgggagaggagcaaagaccaggtccctgccctcacagagcctgcagccctggggaaggagtgcaaaaaaggacggagagacaagtagagtcaacaccttgcgtgtagtagtgctgtgtggcttggagaatccaagaggcttcctggaggaggttatgactgaactgagagctaaacaatgagaatttagccagactgggctagggtgcaggcacatccagcagggaagggagagcatgcgtgttagactagtcaaaacttgagaggggcaatggagagggggaaggagggcagtgacagctgattatagtcagtgcttatgaagtacttacaccacaccaggtactatttccagcatgtccctgtaatgtaactgcccaacaggttcaccttccccattgcctagacagagctgatttatcaagacaggaattgagataaagtaatttggctgtacgggagacgggagttttattattactcaaatcagtctccctgagcgttcagggatgagagtttttaaggacaacttggtgggttgggggaagccagtgagccaggagtgctgattggtcaggtcagagatgaaatcataggaagtcaaagctgtcttcttgcactgagtcagttcctggggtgggggccacaagatcagatgagccagtttattaatctgggtggtaccagctgatccatcaagagcagggtctgggccaggcgtggtggctcacgcctgtaatcccagcacttcgggaggctgaggtgggtggatcacctgaggtcaggagtccaacaccagcctggccaacacggtaaaacgctgtctctaaaaatacaaaaaaattagccgggcatggtggtgcacatctgtaatcccagctacttgggaggctgaggcaggagaattgcttgaacccgggaggcggaggttgcagtgagctgagatggtgccatggcactccagcctgtgcgacagagcaagactccatgtcaggggaaaaaaaaaaaaaaaaaaaaagcagggtttgcaaaatatctcaagcactggtcttaggttttacaatagtgattttatccccaggagcaatttggggagagtcagaatcttgtagcctccagctgcatgattcctaaaccacaatcccaatcttgtggctaatttgttagtcctatgaaggcaatctagtccccaggcaagaaggtggttttgggaaagggctgttgttgtctttgttttaaactgtaagttcctcccaaagttagttcagtctacatccagaaatgagcaagagcagcttggaggttagaagcaagatggagttggttaggtcagatctcttcactgtcttctaacacatctgcttcaccgtcttataacagtgaaaggcatctgaaaggtttgtttcagatgtttttcactgttcacctttcagatgtctttcactgttatagttttgcaatggcgatttcagtatttcgccccattctatcctatagcagtcctacgagataggtactattattaaccccactttatagatgggtacgatgaggctctgggaggtctggtaacagctagtcagtggcagggccagattcggacctggatagttggctgtagggtctgtggctgaaccagtccatgctgtggcctcttacaagatgtaggggtagggaggcaagcagggaagatgcagatcacacagatgggggcagcctcttcaggagttctgagtcttatcccaagaacagtgggaagccatgggaggtcctgaagcagggaggttagtatttcagaaaatgagtggggctgtgtgtgagatgtagatagaaggggtgcaaacctggaaatagccccattagaagctgtggatttctggtgaggattggtgctgtccagcaataatgcagtggctctggacagacacagagacacacaaatggaatcagatgctcaggaggaggacaccacaagtcacgtggatgggagggatagtaagatgagggtggggtcaaagatatcagttggggatgactgtgcagatgcctggaggcaggtgctttcctagagaagacaggaggaggagcagcttcccagcacaccgggagggtagggaccccctgtttttcatggctgtacagtcccagggtgacaggtctgcaccaggaaggacctaggactctgccagattctccccttgcccaggaagaagtgagactgttcccgagcagagcttcttagacaatggccagggacagagaacacccatccttgggctttttggctgagtgggtcacccagtttgaaagtggttgcgttgggtgatgactgaggtgctgcccctgtggcattgctgtagggagtctagcagagaaagctgcaggctagcaacttgccccgtgctcactctcctatagctcagacttgccaaccctggaatcatcttgccaagagcagtcgttcttagcttttggagtttgtaaaaatccccagggagttttctaaaagtgtgcattcttgggctcaggaataaggggcatctttggctgtatttggaaaaacacggccccagagggaaggtaatggccaggaggagatcggagtcagagatgctgccctgctgggtggaagtgcttatcatggcatcagttcagggttctagacctgcaagccagcacctctccctgtgtctgggtggcaggcttgtcttgatgagttaggaggggacacagactccaaggccctcctctggtgctgttgactggagttcttgtcttgctcagctgtgcctcccctgccaggcttctcagcatcccttggccactgtggggcatggggtgggccgcagaggcaggggatggggctacccactgccattaataggaggaggcagggcaagtctctccagcagggagaatgaagaaccaccacagctgtctgcaaggcaaggtgaaggcctgtcgggagagatagaacatcagtcttcactgcagacatcggccgtgctagacacctatctgcttaaggatgataatgaaattaatccggcctgtagtcacttcccgtccaaatgatttattggcctcataccccagtgttgctgcatggtggtaataaatgacaagcctaggacatgaaggcttaaaggattctccttatgtttaaaaagctaagccataaggcaaataaaccagagagcctgaaggaaacgggaggtcattgggctccatgttctctatgcctggaccatctcaaaagccctgttttttaaaggctgcttggagaaaatcatcccccaccaccctcagccacctacatctatatttgattaagcagcgcctccgcagactcaacatttgggagtaatttgacagggctgggctgaagtttgcttttacccttttgttaaagaaaaaattttctcttgagcactagcatttccctccaaagagacaagatgctaattatcactcttattcatttactaaagcaccctagtttgagtcactgtatgtgcttaaaagcaaaaaaaaaaaaaaaaaaaaaaaaaattcatttaaaaatagggtctaattcagagttttaagtgaatcagactcacctccctccaattagtccacattagttaggttttaaagttaatctgtagtgacggccagttcctcctactatctaaacaaagtccctgctgttggagagccagcctgtttcttctttccttgtctgtccttagggcaaacagagtgtagctggtctcgtctgaatgatttactctcagcacatttgaagaacaggtttctagaggggatttgagggcatgacaaaaatatagcatctcatggactagatgcagcccccagagccccacattgctggcagggccctgtcacctactggctgacacccttggcaacccccagcaccggggaattgctttccatgacaataaccatggcagccagtgcctggcactgctcacatgcattagttcaattaatgtccacaaaaaccctgggaggcaggtgctttccttactcccattttccatctgatgaacacagaggagggtgcatttctgttccagtgtcattctgtcctgtgcagacaaagggttaagcgtgtctttacacatgaagccagaggagtctttctcccctataattaaaccctcccggtgcgcttccttaactggatgtcattctgtgtgcgttgactatgaaggggactgtgctttgctctggtgccaacagggtctggggcatgtgcacctgcatgttcagggagtggggcacactcgtcccctaggactgtggcagggtggtttctctggagtccagccttcttcctctcactcgcaccctgctgtgacctttggctgggccgagttattgcacccgcaccctgctatggagtagtggcgagtgtgcaggacaggtgttgggcaggaaattttctctaaagattacacttcgagttctgagctgcaaggttttgagaggcagaaatgttgtttaaccgctttcattaacagatgtgtactaatgcagaagtggtcactgctaacaaatttgtaattcaaaagatatttaaagctcataggaatgccccaaagggtctgttaagtaaggtcagcaatgcttctggtcaagtccatcatctgtgacactaaaagggactggacaatcgctaaaggtctgttgcagtgtgaatgtctttagatattcatttaacaaacacgtataatgcttcttgtgtactgggtactgttctagggctttgaccaacagcagctctttccgtcttctttaccgctccatgaggtgaatactatcagccccattctgaggcccagggaggctaagaaacttggccagagtcacagagttccttcactgatgcctcaaggcttgaaagcaggcgaaataaccactctagagactgtggctctgcgcagggcctgagggataccttcccccagatccaggctttcagcccatgctcctaacctccgaggcagcctggctagagagctgggcctgattgaggagaaatcctggtagttacattctctgatgtcaaattcataaagggtaacttctcttaaaatcccagggtgaatctcgtgtctgtgagtttatcaaaatgcttccctacttctactttaaccctctttttggccagcagtccgtgaagatgacagttaccttcatccaaagggggcctctctcaggcatctgggctctgacaactccaacccaacaggatcactcttgagtcttaagtgttcaggtcttcgcagtttcccacacattcttggtggcccaactccctcaggaggaagacagtctcagggctatcactaataggccgcagaaggagctggctagtggcctggaggttaatttcaagtaaacaagagagaagcaggagccctgtggcattttctctggtttccagcatcctgtaagccctcccctggatgtccagaaccttctgtgtgatttgaccagcctgtggaggatgttctgacggccccttccaatgcactggtgaacccctgtgctgaaggactcagcaaggttatccctcaagccctgagaaacaagattttgttttcatcagtttccagccttggggcatcagtgagaagagctgagggagaagacgatactgacggagggagagcaatattggcacgtggctgctgggacagcatgtggaatagaattctgttttcacgtaatattgtttcagcagaaaaggtgatttcaggaatgagagatttcaatcagagtttctgtgtagtgatttgattctcatgttttcagatttttttctttaaattatcacaatattcagaacatattcataatttttcataaaatttatagctacaatgccagcatttctcttaggtggagccatatgaaattgtcaataggtgaccatttttacctacaaaagtggtagtttcataaggttaaacataagttcaaccttacatttctagaaaatctcttttcatggaattctaagctgtgccataaacatggtatcttataaagaaatcttaccttcacttgcaagtggtttggaggatgtgtagctcctgtttattttggaaatgacttaaagttgttgatatgggtctttttctccctgagtgattacaacttctcattctaatgatgggaaagtctacagtcatctctgccacttctaacgtggggtggccccaattcccctccattgatgattggaggggaatcgcttgttgtcacatcgaatcctagaaccctgtgagactggaaggaatttaatttgaaattgccgtgcgtaccagttctgctctgggctggagaaacaatcctgctgcagatccatctagtgacattaatctttctttgacttaatttggttttcatccctaaagtaggggcccagaggacgctccctgcctcacaggactaggggacgattaatgagtcactcttagaagagcatttggagctcctcagatggaacaaatggcatctttttaacactctgcattccagggcacttttcaaaaaggcatttctgtccttacctcagcagcagctgacttgtgctaaaaagaaaacggaaacctttcccccacaaacatctgtaaataaactatttttctgtctttataatcgtgttaaagtgtcacatgggggaaatgttccagctctagagcagctgtgaaagttagaaatgcactcacacatacgcgctcacacacacacacaactcatccactaataaaatgtttctacacttgctcttgggagataatttcagagtaaaatttccttggtacaagctgtgtctatgctatcttaatgcctgagcacagcactagcagcgggctgttgccagctcttgaggagacatttgaacttttggcagcgttccttatcagaaggcccatccgaggtatttgtgattatagagtaagggtgctcgcttttggcaaaacaaagcgtctgacagtagtgaagtactggctcaacactcaatgggagacatttgggattcattctttgacaattacccagaatgaatcatcagcttccttttataaaaagatatttattggcttagaaacagagcatatccagctcttcgtggggaggaattttgtaactatgttcaaagcttctcataaactcggtgtctgagtattgctaagggggtgcctgcacagagcatttagtttaattgcatcaaatatggaggagaattgaaaaatcagccagcaaacaatgaatagctcaaggggaaaaggagaggatgctcgttaataggagcagagtcgaagagctcagtaagagttaagaatccctgctggagtcactttgcagaggcctgatggccccagccggcccctgcccagtgctgcccccaccccaccaccaagatatcatgcacaccagcagttggaggcctctggcctaaacttagcggctggctggacagctgtgtttgaggacctcttgagggctggctcttgctctgtgttcctccctgtgggtgtaacctgaaggagattaggttttaatcctttggtgcttgctaggtgggctagtacattctgataaccaatgtgcagcaggccagaagagaaattctaggtttccactctttccaaactgggaaggcaaggtccaaattaatattagaattgagaatagctttggagcttcagaatggagggaaaagtcacttagctgataaggttcagaagtgacagggtcagtcctccagaaacagttccagaatgaaggagatttgtggatctctgacctgcctccttcttgccacccgtttgtcttgtaattttgtgaatgagcccctcctcccacagagccaggcctgcccccagcatcttggcatctttgtccccctttgcccgaagggcacttccttgcttggggatttgcgagtgcccatcagggtgtgggggaggggcactgtagggccacttgaccctggtttccatggtaccaaaaggtcttaggtgagaacgcttgattttaactccaaaagaggcaatatatacagaggcctgcctttgtcaaatgtatacatttaaaatctgtggcaattcttatcagttctattgaagcataatttttgagacagggtcttgctctgttgcccaggctggagtgcagtggcacaatcgtggctcactgcacccttgacctcccacgctcaagccatcctcctgcctcagctgggactacaggcgtgtgccacaatgctcagcgcttttttgtttgtttgtttgttttgaggagagatggggatctgagttctccgggctggtcttgaactcctaggatcaagcaatcctactgccttggcttcccaaagagctgggattacagtcatgaaccactgtgtccagccaaaatataattcatattaccataaagctaattcgtttaaagtatacaatacagtggttttaggtatacttatagaattgagcaaccattgccacaatctaattttagaacattttcatccctcccgaagaaaccttgaattcattaacagtcactccttatttcccccagccctgctttagccaactagtaatctacgatctgtctatataaatttgcccattttggacatttcgtatattctttttagattcgtgggtacatgtgcaggtttgctacaagggtatactgcatgatgctgaggtgtgggcttctattgatcccatcacccagtgaacgtagtacccaacaggaactttttcagcccttgccccagacccatccccgcttttggagtccctcatgtctactgctcccatctttatagacacttcatatcaataggaccatacaatatgtggtcttttgtgactggcttcttcgcgtgtttttgcagttcatccatgctgtagcatgtatcggtaattctttccttttattgtatggcaatttttggtagtatattcatactacatgaactaacacatagtaataatgaactacttgtagttgcaacatgaatacatgtcacagaccttatactgaccctcaaaatctagacacagtacatactgtatgattctatttatatgatacccaagaacaggcaaaattcataaatggtgatggaagacagaaaagtaattacctctggatgaagatggggtggtcattgtctcggaagggacaatgggagcacttttcaggaccttgcaatattttatatcttgataaaggtggtggttatgccagtatatatttaatgtgaatagtcattgagctgcacacttaatattagcaaaagttaagcatgtcccacattatgcttacatttcaaagcttttattaaaaagtatatgcaaattttgtgattttacaagcttttgaaaaaatgtcacaggttgaatatcccttatccaaaatgcttggaaccacaagtatttcagattttggaatttgcttggattctagaatatttgcatacacataatgaaatattttagtgacaggacccatgtttaaacacagaatttatttatgtttcatatacaccttgtacacagagcctgaaggtaattttatataatttgtgcacaaatcaaagtttttattgggttttgactgtcactcatgctatcatgagttcaggtgccgaattttccacttgtggcaccacgttagcacccacaacgtttcagattttggagcattttgaattttcggattagggatgctcaacctgtatatacctacagaaaaacaaataaattataagcgtactgctggatgaattatcatcaagtgagcatatcctgaaactaccacccatgtcaaaaaatagaagccctctcctggcctttcctaatcactaccgctgctctcttctccaaatatctaacatgatagttttgactgtttgggctttttcttttttcaagctctatgtaaatggaatcagtcagtatactttcttttctgtcgagcttcttctgctcaacattatgattgtaagatttacccatgtggcgtgtaacagtagtttgctcattttcattgttttataaactgttgtataaatatgccccaaattattcattctgatgatggatgtttgagttgtttccagtatgggacaattacaaatcgctccctatcaggatttatacttatttctgtggactaaggacctacatgtgaaatggctctgtcatagggtagataccaactttatataccacaatttctgaaaacccatttcagcatttcttaatagagtagtgtcatagtcagttcgggctgctataacagaataccattgactgggtggcttaaacatttgttccttatagttccagagactggaagttcactgtctgggcaaagtactagtagctcggtgaggaccctcctcctggtttgctgagagccgtcttcttgtatccttgtgtagtggaaagcagaggggaccagcaagctctgctgtctcttccttttcctcctctgtttagagacaaggtctcactctgtcgcccaggctggagtagagtggcacagtcagggctcactgcagccttggatgtctgggctcaagtgatcctctcacctcagcctcccaggtagctgggactacaggtgtgcaccaatgcgcccagataattaaaaaaattttttttatacagagggatctccctatgttgcccaggctggtctcaaaactcctggactcaaggatcctcctcttcttcctcccaaagtgctgggatcgcaggagtgaggcaccacgcccagccctggtgtctcttcttataagggcactattcccatcatgagggctccaacctcatgacttagtcacctcccaaaggccctacctcctaataccatcacactgggattaggatttaaacataggaatctggaggagacacaaacattcagtccatagcaagtaacaattttttaacctcaaaaaatgaaactggcctaggtcttgcctgacctctgcgaattggggggaatgtcctaacacagctcagtcttcccctcttccagggcttcccacctcccatctgtcccacagggtcctggcctccaccttctgcgtactaccccactgcctcccatggcctcatcagcctcctccacaggaccatgagccccttgaggacagagacactgccttgcttgtcatttagtcccagcctccagcacagtgcccagaacatagtaattcttgataaatatttgatttaataagtgacagcatgtaagatccatccagccatctaattcctgggtgaagttgagaaatccattaaattttgaacactcatatatcttttatctttggtttcagatatcaaatggatccactataaaagtctttaagaagatagcaaattttacttcaggtaaccaatataatattgttaaccttttgttctcacccagcttcataaagtattgctttttgcctctctcagctgtattgtcacaaaggtgagattgagttgttgctatgtaattctctgaaagttgagaaaagtcattttgatctctttgcagtcctaagaatgtgatccctgcaagaaggaaaggaaactatagatggtggttggcctggactgcccagcactgaggaagtggctgcctctttatagccctaaactcagggcagaatctcatagctttttttcaaccctttagaaggatggggcctaacagaggagatccccctggcaaactgagagggaagagtacagacaatcatcacagagccccgaagcaagcgctgaacaaacaagataatccacttagaaggtccaagtctcctgtgatagcacttgcaaaattcccagaaattggagagagacaaactaaagggggaacttttatgggaaagtcaataggctggtctctaaagtgatcttctgcttccctgatagccctggggcaggaaattcctgttccaggtttgtctccagagaaattataccccagtcaagacaatcagctctcagcccttggaaaggttctgagctcctcccaaacaggctcctttcacacacacagccagaggtagggcttcctgacttctggattcactattagaaggagcagggagcatctggccagtgcaaacagggaatgtggggttcttgattatacagacaggataattgggtaggactcctttggggaaacccaccttccatcactatatggggctgtggtgaagccatcttgcagagatcattccagcttaagggggatggtgtctttgtgttgaaaagtggaagagcatggtttttaggtttcaaagattgggccttttgaagagcctattatttggggattgaatagtagaatcttaggtttggatctcttcgtgggccctccagtcagtcaacactgctgctagtttccattcactgcaactgagagccaccgtcttacaccctgctaatactctaaacctcctgtacctctgtcctatcatcagcccctctgtcaaaatcccaacgctggatgaacccaacgattatcctttcctgaccctacagctagggagccacagaagaaaggcacataatggcacacagtgggtcactataagttcatggtacccaacttgaccagggccctccacacagcctgctctcattgggttcctctgggcaattcaactctgtgttgtccataatgtctgccttctctcctcaaagctttgacccacacagctctcctctcagcagatgacttcaccctgcactctttacagagaaaactaatcagaagtccttcaacagccagtagcaaacctaccaacctacctgcacctgccttcttccttgatgcttgtaggctgaccttcttccattcaaggccagtctctcacctgtgctttgggtccaccatcctttccaaccttcttggtatccttacaccaccagtaatctcttttctcacctgtactttcttttcctctccatctactccccattttccattagcatttcaagatgtgctcgtctctctcatctttatttttaagacagtgtctcgctgtcacccaggctgtagtgcagtggtacaatcatggctcactgaagcctcaacctgctgggctcaaatgatcctcccacctcagcctcccaagtagctgggattacaggagtgtgctaccatgctcagatactctttaaaattttttgtagaaatgaggtctcgctacattgtccaggctggtcttgaaatctggactcaggcagtcctcctgccttggcttcccaaagtgctgggattacagatgtgagccactgagcctctctcaactttaaaacaaacaaaccaaatgccttacttcctctcttccctccatttaccactcccttaccctttacagccacatttcctcactctgcgctactcttgacttgctctgtgagcaccacctcattgtcctttgagatcctagaaagggtcagctccttcctacctttggaccttcctgcaatttgcctagctgactctatctcttcattagattcagctcaagcatcccttcctcaaaaactcctggactagatttggtctcttgttaattctttagcatataattctccttcataacctttatcacagttataataattgtgtacctagaagtttgatgtctctcattggccagaatgcaaattccatcagggtgggaactgggtcttattcattgctatatgcccagtagtccctggcacataggaggtgttctaggtacatttgttaaatgaatgaggcttgagcctctcctaccagcaagagatcagagatcactagggaatctacttcctcctccaatccctcacccgtcccatcttcacgctgttcttaagatcttaagatgcagcagggggaaaaatgtagctatggagagctcaagtcaaaaagctcaagtaacttcagtatacagcacaaatggggccttttaagagaaggccgattagcccatggttgctttttttaatggactgctttctctccctctttctctggcattcagatgtggagtactcggatgaccactgccatttggtgagttcaggctttcttgtgctcaccactgaactgcatgccttctgtagcaagagtggtctccttgggtaacgcttctgctgtcttcccttcagattttaccagattcggaagcattccaagatgtgcaaggaaagagacatcgagggaagcacaagttcaaagtaaaagaaatgtatctgacaaagctgctgtcgaccaaggtacacttactgttctgggagcactttatggctacctagggggtgtatgatatgtttgacttaatttccactgaagtgtgaaaatgttacaaatcccttgtgccttctagcaaagcaaaatgaaagtttaaattgtaaacacttcctacccagttcctcttctttttatacactacaaagataacagcactttacagatttgtactgtagtatcttcagtcagggatttaatattgttcccagtctctttctccaccatttcactattattgttattttttaggttgacagcataattattccttttggtttacttgttattatagatgagcaataaaactccctttttgaattgcgaataaaatgaaggggatgggaagggtcaatgactataaacctagtaaatcttaatttttgtttttcattttaaaattaagaattctgctcacacataaaagtgtcagatgtgaaagccggtggaataccaaaccgagagcaaattttactttatctggcttttagtggaattaacagaagtctgtggtgatcttttttttcctccccctctggaatgatgagcactataaatgctatgatctacacttggccccaggaacttgatgggcatgcttcttcagattataacaaagaatctgcttagagcttaggagatttgtttagtgggcagaggacagcccaagcctcttgattttctcagctgtcccatagagcccagcctatttggcttttgtgaaatactcaaatgctttggaaagtacacaataaaactttatgatagaaatatatgcaacaggaaaaattctgggaacagagcagcatcacttgagcttttccaggctgaacataactaataaaagccaaatatccatggcttcctggtttatgtaaacagccctacaactgacatttcaactgctagagatttctgatatcctcccagttgactaaacaatgttatcagcaagaagcttatgaaccaaatctaaacctgggcatggattttcaagacttttgacctatactgtgagcactggccacatttgacaattttacatttttctcttcagtttgtttttccctgttttgaacattattttctctgaatgtggatttgcttttgctattatgttttcaaaaccactaccacagtttttaatctcccaaatctgatgttgtctatctttcaggtggcaattcattctgtgcttgaaaaactttttagaagcatttggagtttacccaacagcagagctccatttgctataaaatacttttttgactttttggacgcccaggctgaaaacaaaaaaatcacagatcctgacgtcgtacatatttggaaaacaaacaggtgggaatgtaggtgattagtgactgttttcaagaatctgggacagaatattaactaaaagaaagacatagatagttatagaaggattcatttatctctatatcagaatctttgggcttggtaagctatcatgtcaaagtagtttcttattctgttactatttttaaacaataaaggaaaccattcctatgccaagaatcctgttcttgaagataaactgttatctttggtgcatgatactttgtctagaatgttaaaagaaatttaagttgaccagtaaagaatgagaaattaacatttgtggttttatatcatttttgcattagagaaaattttatgataaaccattttttgttcctaatcggttactttgcagtctccaagctgtctatactctgattctgtacagaaatttatcaagtgcagtactcagatactatgagaattagccaaaagtttgtgttttgttttatattttaatattttaccttaaggacaggcaaggcatccaaattttgcctcctcagtaaagaaatgtagctcatgagctctctttgaaatgctgtgtgcatgggctggataagactcagagttatgatgaagtagaacttctcagtgcaagctcaaggctttccaggcactgagggcagccaggtcactttaaatgagtatcaaaagctgaagttcctctaggtctaatctcccatttaatccaggcctatcccaattctctacgctggcttgctcccttctcttcctgtgttctagcctctttttttttgagacagggtctcactcttgttgcccaggctgcagtgcagtggtgggatctcggttcactgcaacctctgcctactgggctcaagcaattctcccacctcagcttcccaagtagctggaattacacgagcatgccaccgcactcagctaacttttaaaactttttgtgagatgaggtctcactacactgcccaggctggtctcaaactcctggactcaagccatcctcctgcttcagcctaccaaagtagtgagattacaggtgtgagccactgcccctggcctgttctagcctcttatctccagtccctgccactcccacatcaagactgggagctgagggccaccattccaccttgaagattatggcatctgagcaggggcagcagccaggacagtagagctgttgggagacctagcagcatatgggggaggtaatgagctaggccagagttgaaaaggagataatggaaggactttgaaccagtcccaagttcatgttcgggtatttgagtacctactatgggccaagcagttagttgctggagatatagtaacaaaacagatgaaagtccaggtcccattctaatagttggggacagacactaaatgcaatatgcaaacagtagcacattagcagatgatgagtgcagtggagaaagtaggaaaggaggctagtatgtgtcaggactaggtgatctgagaaggcctcacagagatggtgacacttgaaccaagtcttgaaagaggagagggcataaaccatgagactacctgaggcaagaaagtttcaggcagacagacgccaagagcacaagttgtgaggcacgtgcttgcttggcccatatgaaaaatagcaaggagaacaggagagttggaatgagcgcggtgaggagcagtgggataggagggccaggtcatgcagggtgttatccagagggagatggagagcctcagagggttggagcagaggagagacatggtctgattctgtgttgagaggactgctgatagttatgtgagaacaaactgtcaggagatgggaaataatccaggtgagagagattataatcaagagctatctggagaaaattcttgcccatggccactttcaaacttaccctcctctatccttcttttacagtagctctgccagttaaccctttcttcttctctccaagtgacgcttctgtctgttgcttggtatgtttggctaagcagagttgtatacttcaataacaaggacaaaaacacccgtttacaaactgtgataaacagaccattggcttcatgaatggccctatttgaaaagagattattctctctttgaacagccttcctcttcgcttctgggtaaacatcctgaagaaccctcagtttgtctttgacattaagaagacaccacatatagacggctgtttgtcagtgattgcccaggcattcatggatgcattttctctcacagagcagcaactagggaaggtaaggcccagcttgagtatttcttgtatgcagtcttatgagtttgacatacttgtctttctgataagcattcaaataataaacaattggtctaaactacaccagctaaaaagagatagcaagggccactgtcaatttgctgttatttaaaatctgtctcattatttttaatctaatttttttaaagtgaaaaacaaaataattagccccacccaactgcagaattctgcctgtgaaaaactttatcacaaagtatgcgttttgtttcctagaaaaatattctatggacactgataaactattaacccaaaatatgcaaccattgaaatttgcctaaatcaattctatttgaatatacataaaatgcctatttgaatataacacattgcttatgggacacaaaatcttgctcaagatttctaacaataccagtttgtcagtttctaatcaaagcatgagtactgttttcctatggttttctttgctgatcaatagtcccaagaactcaaagaaagacaaaaatcagagcaaacttcgaaagagatgttttggtcttatttgagcgctccaaaatatactaaactgagcaatatctgtgcctaatggatctttgaacactgaggaggagttcttgggcaggactttaagagtacctggaatgaatggagactgatgttccacaggtgcctcagactcccagtcataatctaaactctttatcagcagtatttctgcaaaacaaacctgtttttacttttgtcttccctagcattgcctagtctctcaaggtagaatcctcaacgttatctttgactcctcttccttccaacctctatccccaaattattggttaccacttacttctgtctcaaatgtctgtcgctccctcctccttccttagccttatcacttagccttatcccttcatcccgtccctactgggataactgcttcctaattggtgtccttgcccctgctgtccacctttccttctaaacttttccttttcactgtctctcaggtaatctttctaaaacataaatctgatgatgtcagtctgcttcttaaaaattgcaactatttcccattacctaccagctaaagtcttcacagtgccacatagtgcttcctgatgggcttcagccctctttgctggcctcgttattttcttgcacgccccacatacccactgtgctacagcttttacttttcccaagttcacaccatgaacttgttctcacacccctttgctcatctttcctgtctcacagtccctctgtctagtaaaatcctacccattcattcatcataaacattttattcattcgacaaatatgatttcctaatgaggaccagaaactgtaggagactcagatcagtctacatatgcctactttgtgaactttccccaatatatttcctacagcactttcttcatttgactaataaagttcatcttagcatgcagcacactgaaaggcacttaaatgtttgttcacactaaaaacagttgtttatgaattatgttcttgacacacttcacttaatcctcacaagtaccaaataaggtagttattattaccctcattttatagatgagaaaattgatgttctgggaggttacaagtcttgcctgaaaccacacaaagtagcagaattatgatttctgatttgtccaactctttctgtcaactactgctgctaattatttgtatcatagtaagcacttcataaatctgtctttgcaactagattgtaagcttctcaagggcagccactagtctttatcattgtactctcaatgcctgctccagtgcttaataatgtttattgaatgaatgaatgatagcatgatttctgggttccacttaaatttgacaaatgagaaaatctcaataatatctcagtctctaggcatccttcagaatgattcatcaagccattgattcagcctcatgggctgggacattagccctatcattaacttacctatcttccctgagtagaattttttaaagttttgtgaaaaataatgatttttaaaaataaaatcatatttaatttttaaatatcactgttataattacgtagaatcattcaaattgccagagaacctctgcaaaatcacacatcagagccaccaatactaatgaccatgtgcttccctgaagaaactggatgatgtctataatctaatgaaataaaagggacaagctggaaaatctgcctctgccaattacttaccagtttcatggttatataaagggctcaatcagacctacaatcaagtcttttgtaaatgccaaattcactggtgggtgaggatgagagcaaatgttttaattcaggctttttacaaccattagtaatgaactatgattgaaataagttccattgttacagtaactcaaaatcatgcaaaaataataattttagttcttttatgagaggaaggcagaatatattagcatttaatctgcctgaaaataacagtgactcaccagaactatctagatagcagtcagtcattcagtcaacaacatttaaggcctactgcatgaagccttgttagcaagaggtaaaactggttggtggtgggggttcagctacattggaatattataaattcctccatctttttttttttttttttttactcttttggtgatggttgctttttttttttttttttccccaggaagcaccaactaataagcttctctatgccaaggatatcccaacctacaaagaagaagtaaaatcttattacaaagcaatcagggatttgcctccattgtcatcctcagaaatggaagaatttttaactcaggaatctaaggtatcattagaaagcagaaataagcttatatttggttactttacgtcatttcagaatctctcaacaagtctttcttttagaaacatgaaaatgaatttaatgaagaagtggccttgacagaaatttacaaatacatcgtaaaatattttgatgaggtaagattttaaataacattgtttttaacctttgaatcaggcacaaggatgtggttatagcattctgtcagtttcagaacagctctggcatcccaaaaggccagaaagggaagccaggaagcctgtctgagatgggggatcctggcactgagccagaccctgtacatggctgccccccttacagttttatcatgctgcccacatttggaccagcctgaatttacatttgagttcatggggcctacagccaccctgactcaagttaactttgatgagtaagtagtggccctattaaatggggtcagcttatgcttgattgtaatttgctaaaaatgaaagctaagcttgttaaattgcctagattctgtattcaatcgttatatgaaattatgacatatttctaacttaagcgactatttcaataaaccattctcctttatgattaattctccttaatctgggtttttttctttggaaattcaaacagacacattcatcagatgctttgtttccaaacaaatgttaactcccccttccctgattcccccccaatcatgctgggacaggctatccatgtcaatggtgagaatagctcaccaattccatttgctacttgaagatgaagtgaagctctaaggtagggtagaggcaatgagttcttaaacatgataagcatccctcgttccaggggtcaggggagagaagggaagcacgaggagggactacactgcccagatgggagggaagggaaggatctgtctctgaccaggatgtccctgcctgctgcatttaaggagaaatacttgcctgcatgttggctgcccaggaatgcttgctgtgcttggaatggctgtgacataatgcataaagcagggcctaggaagcctggccccatatttgtaagcaaatagttggtatttcttgcgagcttctattttaagccaaggtattgttgatcctgtgataaggacttagcaaaacaacttgcaaagtgagtatgtaaatgatggaagaaaatgttggcatctgtttcatacagattttaccactcacagcatcaggtatgcaaaaaacagaattgtaacgctaaaaccacaatatctaaaataactgttctaattgtcaacagattctaaataaactagaaagagaacgagggctggaagaagctcagaaacaactcttgcatgtaaaagtcttatttgatgaaaagaagaaatgcaagtggatgtaagcactctggggcctggcttaatctggcaaagttcttcagacgacttgggagcaaaatggctgcttgagctactctgtgtcgttaatttgttgtttgcacataggttccactttgggcactgtctttttaagagaccaaggcacatgcacagcttttagaaagcataccaacccttgtgcctgtgtgtataccgtgggaacccttctgtaaatagagttgaagtggttgttgcaaacagcctccttgtttacagagaatacaaggccagtaagcgaatgtcagtattgtaactacagtctccacttaagcacaatgatataagtggttttgtttgaaaactacagctatgtagcacttgtgctacactgcacctctgcattgtaaagggatactgccagtgctcaaaacaaaatgtgaaatgagtcatttggaaacaaggtgggggtgttagggcaacctcgaggatttgcagcattgaaactttccccagtagttcttggaaaagctgaccgcagaatttggtagtgtacacttagcatttgtgagtgtgtgtgtgtgtttaaaccaaaaactaacagtgttgcaacattgttgaaagggctcgtgtttttcagtggtcatcaactgcactccatcaaactcacctccatttcaccaaggagctctaaagtaaggagagtgggctttatttaaatgaacagcattttaaccagatactttgtcctaatgtatgttccttttcttcatctgttttttcatactaaatgtatttgatagtggacatgttggatattatacaaaaaaatcattaattcatttctgttccaaaacctttgatcagaacgatctgtggaagagtaactccatttctatatgagtgagtgtctccttgctttagatttctggtgaaccctgtggttatgaatacttgtgtgtgatttaaaaaaaaaaagatacattttacattttatcgaattgctgttcacactggagtattatatataaatatatatatttgaggcccaaggcctgaaaaatattagtatacaacttggtatcttagtcttactatgtactttttgaaagtattcctcgcaggagaaagaatttaaaatacccattttattcatgcctttctttttaaagaattctctatccagttatactgtagtctttttagtgctgattttttaattcctgaatttttgctgctcatgaccagttttaataccactgtgttttccttctattaaaccagaagaagtaaacagcataattggcaactcttgagcttttcttgtggcaggcaccttttacccttggtgctccaaatcccccatctaggaaagaaaattttttcaagtcaaataacattgatcacatattccttgaaatcatttaccaacactgtatggagcattaggatttaaatatgaatttgtcttaaaggcaattcctttttgcttctgtattatctggaaaagcatgagagaggtgacacctcaacaaactgatcagagaaaataagcagttactaccctgataggcaccttcccaatcctgttgcttttgaccattgtctgtccaacggacacacctcaaacaaacaaaactaccaaatagatgacagatcagaataaaggtgagaggtctggtccccattgaaggctgctacagtcttcaaagaggtgaaggagttcataagagaacaacagtaggaaagttgagagccaagggtaggagagttgcccaaaagacttcccctactactttagggtactgaaaactcaaaggatcagctacagctttatctaagtatttactaaatgctacatgagggtgtccctgtccagctttctggcacatgagtcctgtgtggagagttacctcctcttccagggactgtgctgttgggaactttgggcaagtcacttacctctttgtgcctcaatttctgtataatatttctaagctacctcactgaggtggtatgaagattcactaatgtatgtagcgtgtttgtcaatcctccagtgaaaagcactatctagatcacattttggatcacattagccaaatgcagtaaatggccaaattagatgtgtgctgaagacaatcagtcactgggtctatattaaacagcaaccagagcaacaaatggcaaacaatttctattttcaagtttctttgcatatttttttggtgcaaaaccatttataaacttttttttctaacactagtgtctacagcagcattcaaaaaaattctgttaccttttctgtattaggatttaaagtctatttcttattgtatacctgattgaagctgttcttggagatgaatgttttaaatgtctatatccaaaaaataaacattttgatgtaactgtg

SEQ ID NO: 322 - DNA, 45155 bp, Homo sapiens
  source 1..45155: mol_type = genomic DNA
acagtgctgattcaagagcgtctcgagcactctgagtggtgagggggcggctcggctcgccaggaggaagtggcatccagccagtcggcgatactttcactttcagtggaataattcccgctggtgcaggggtctgatgtccctccaccaggtgctcaagggggtctgggacaccgacagccctagtcctcctgtcctaccccacagacgtttagtgggtgacagtagctccgtgaccgccaggtaactttcccttccaagacaccaaggatttgtgggtaaaataataataccatttattgaatgtgccagacagcatgctaagagctttacctatcttttctcatttcatccccttaagggtcctgtgagctaagtgtcttcatgaccattttgtatatgggggaactggaacacagaagagctgtgactctccccagatctcactgctactgtgggacagcaccagggtccgagagctcttagccaccgccctgtgccctgaaaagatggaatctgccctggtctgttaaagtgtcgaagcctggcccctgggggaggggaatcacgtacgcagcggctgtggctcgcctaaaagttgtgtttagtggtgacagagaaacctcatggccctgtgattccccaaatcagccacacatcagaatcctcctcccccaccgcctccccgcccccggccccgggaaggtaatgaaaactacagatacccaggcctcattcttcagagagatggcagctctgtaggtctagagtggagctcaggcatctgaatgcttaacaagagcccgcaagggattctggtgattagccagggttagacccaggagcatgggcagagtgtagggccagatgttacttagctcagtctagctactctccagaaagttctggagaattcctgaccacaggcctcctgagtcaagacctgtcccttcacacagcccccgagagcccacctggccccctgactccaacccctgcgggagtacacagcccctatccaagggttctcagcctcccttctgatctgtgctggaggaaaagaggttctaagttttgtggtcagggcattacttggggtgggggaggtgggcggtggagggaaagagaagagaagggtgaggttgtaaaccactaaataaaggaagtttctcatgagaattaaatgtcatgcactagtcctgctgccctccctaccttggaaatttctgaacttccacttctgccctgcactgaagaggagactcaaggaggtatcacagcagggatagaagctgcagggtggcaggaggtggcaagaggaagcccggggactggggagggcagatattcctgcagcaagtataaaggaagggacagggttggggtgggatgctgagagacttaagatgtcttaggtaacttgcctgcgcaagggaaagcaggtgagacccagtggaatcctcctttcccagctggacgtatcgcttgtcaagcttgactcttaactggcgcttcgagccccagccacgtggctggcctttcgtcatcactaaggcactttgacttcccagccacggttcttcctccaccacagaggcctaatgtccattgattacggaaggttcgttatttagcaaatactctacagctgacccagggctaagtgccttgggaggatgccgtggaaacagaacacaccgcctcccacttgaggtgctcagagtcctttggaatgcagacatccgtgtctgcgaatgtgagccatttccatcacagcaggggaggcagccccacccccagccaggaaaaatgcatgtggcttaaatttgtagaaagagccaatcgggatgggccgagtgtttggagaaaaaccttagaggaaatggaattggctctggttcagggaagaagatggagtccctctggcccagcaccggaaaacatgtccaggtgggactgtgcagtgtgtgtctgggaactgcccgggccgggcctggcctggcccatggagaggagataaggctgcaaactgttgaacggcaggctgcttccttcgagaagtgctgttaacaccaaaaaacattgtatttggcaaatgtataaaatgttcttacatttatccttgttactaaggatacttgtgcatttttttaaatgtcgtttatttctggcttgctaaagggtgattaaatacgaatgtaaacaaaggtacactctccacatctaactgttcctaggcattaacccactgatgagcattagtctgccatatgtaagtttaaacataaaataacaaggtatactgtgggtactgcacgtcgctgtgaatgtgcacgcgtgcgcgtgtgcagatgtgcattcgcgatggagagaggaggcggttttctgagttttgcatccaatcccaagtggagcaacgtgtattttcttgggcgtttcatgttgagtgttagaaaaccctgtctcctgccttactgctgtaaacagaaactttaattctttggaaagtacagtggattccacagaaagctaactgtcacttttgtgtcttttccaaggagactgtcggagagcccttctatttgctggtgacgactctgaaccagaaaattaacaagggtcccgtggatgtaatcacttgcaaagccctgtacacacttaatgaagactggctgttgtggcaggttccggaattcagtactgtggtatgttttcaataaagctcccagccagactcccaaataaatctggcggggaattagagggtgaggtgggtcatttacaatgaaacggtatcatctctactgcgggaggccctgtgtgtttagttaattaaaaacagtagttgataaaactgttaacacgtgttcacataatagattttaattactgagattgggggagaaaatattgtaatgatgcctggggtactcatcaatttccaaagattttaatatcaggattgcttataactttcagtgtcgtcaaaggaaatgcaaagtactccctattcagcacttataattgcaatcagaatttctcaaatggctctgctctgggaagacaatgtgtgaagatatatttcaatcaaattgaggccgtcttattttagaatgataacacaagacaaattccaccacgttccccatgcaacgtgacgccctttattttcatggattagttacaaatgtttggtgtcatgcacttaatgtactgtgatctcatagatatttttagaggaacgctgtaaatcactacaggaagatgattgcctagctgctggagggtttcacccgcttgagaacttctttctaattcatccccaccgcacccaccccatgctcttcctaaagaaagaaagaaagcccagtttggggcacatttgggaatttcagagagggagccaagcagggaaggtaactttagaattaggaattttctatgcttttctgttagtagagacttggagaagagattgctgtgttttggtttgatctttagctttatgaagattctgggcttcttcacgatctcgttagtggaggaggaaaagattacagtggggtttgggaattgctcattaagagagctgagtcttctgtggctttgctctggatggtggggactgcagtgtcatctgggaagaattcattccctaattggagaaggcaccactttgccgtggagcgtgttatggttatgtcctctggtgggagaatagtccgtaggtcagctgtttcaagttttctgccactgccagatgcggctcacttctccatcaaagatggcaccatgcacagctgccatccgagagcgggaagctgagctgaaagtcaacacttctcagcgttctgaattgtatcaatacacccatccacatctgagaggccggagagtgggctgcattggttctcaaacttgagcatctagcagaatcgcccagaaagctcactaaacaccagtcgctaggcagcatgctggagtttccgatgcagtaaatccaggctgtggcctgagaattcacttccctaaccagcttcctgatgctgcgggtgctgcttaacaactgttggtagagtggttaacagcatggactctggggccagacattttggaatcctgcctctgccactggttagctgtgtaatgttgggcaagtttctaaacctctctatgcctcattctcctcacatgtgaaatggaaatgatggtcatggttcctacccatctcatgaggtgttttgaggattaagagtcagtattataaaaagcacttagaacattgccaggcatgtgagtgctacctaaaactttattccatttgatccagatctcattgaacccttgtttaaaatgcaggtgcaaatataccagtgcccgggctttccctcgggactgactgaatcagaatctctggggagggagcccaggcgtggatgtattttgtaaaccttccagatatctctgatgtgtgttcagcctggacaccactgggtatcttggagaacaagagacaaactttgcacagggcctgttgactcacctttcgctgatcctgggcttgttattcctaacctagaagatgttcatgcctttactttaagacgttttagaagccccaaaggtctccaaagagaaatatttgcaaatgattatagtcgggaatcctccagcatttcagtcatgagacaacaccggacccaaacaggaaagacaggaaaggagaagatgggttggaatcaggaagaggtcagatgtctgaggcaacttttgaggttttgaagcctttttaatgctttacatctgaacgtgttttctccctttcatttcgaaacattatttatttcacagtcaattaagaccatgtgtttctgatttgttaacactcgactcatcatcataatgttacttgatgctgaaggaattcatgtcgactcttgaaatttttttttctttatagcccctggggaaaagggtaatggaaaatcatgatttcagaaatccacataaatcttccttttcaaattcagatttgccggtacataagatttgagccttgaaaaggaatgggccacttgtttttaggggccttgcctttaaaaatgattgttagtgcctcttatggggcctggcccagcccccctttcatggttggcagttgtacgagaagctgcagagaaggcacatgatccgttctatgcttgtgtgacaaactgttagcagaaggtcaatataaaaaatttaagtttttcatttcctttcaggcatttcccccagcctgaaccaccatatttctaattttctttcttcctcccttccctcctccccttctttttcacttcccccacctacccctcccaagcatgtacacccagccattttaggacttgatttcccaaatttgcctgaggtggtttatgtaattgaaaaccaaggtgcggtgaacaaactgattctgtgtgtccttgtgtgctggggaggtgggaggttgggggcagattctttcaaggaaaggaaagtcggaaatcaagagcatcctcacgaaccacttgaaatgacagaacctggtgccaaggcagggacacgtttggaaaaaaggcccccacactcgtgttcagctaaatgctcagaagcacagcacctcatatagcaatctaaaagttagctttcacacctctcagatgaggatgtgttctccctgaggtgtgggggattttctagaacataaaggcatcttgccaatttcttatacatgaaatcatgacactaacaaagaggccctgggaagtaatgttctcttcttgcatattgagaagaaaattcctctgtcttgccaaaaatccaagcaaagtcccctagagccatacttcctccaggaccataagaaaccatccttctctatcaagcattccaggctggtgtttaatgaggcaacagtgagacagaatgccctgatatctgcatcctccctaatgtcagcaccaggggtagggctgtgcacacacaggactttagtctttccttaatatctaggaattcagatcagacagctggaagagaataagaccttttttttttttttttttttttttaatttaaggaataccactctagtgcaggctggagtgcagtggcgcagtcttggctcactgcaacctccgcctctggggttcaagcgattctcctgcctcagcctcccaaatacctgggattataggcacctgccatcatgccaggctaatgcttgtatttttagtagaaacgggttttcgccgtgttggctagcctggtcttgaactcctggcctcaagtgatccacctgccttgtcctcccgaagtgctgggattacaggtgtgagcaactgcatccggccgataataagacctattgctctgctgggtttttttcccctttgcaaaattttgaacatgtttgattttgttgatggagtatctcagactcactcagcttacgttttgtcaagagtggaactttggaggagttagtgaaagtttgaggatttcacatgggagaagggacatttgcttcactttcaggaagagatgagaaaaaccaataactcgtagcaagcgtgctgaattagcaagagaaggttgacttgtaatcaaagttaagtgtgaaatggttttttgaactcttagaaaacgagcttgccaatctgctgtatctgagagagagcatcttggcaccctggaaaactgttccgacaaaaatattattgccttcattctcctatctataagaaagttttcaagattattagaaattcttgaaaaagcacaagtacatgcctgcagaaatattaatgcctccaatttgatttattgaaggtttatgccagcctaccccagtctgtctctttctctagcagttaccattttgggacaattacgtttaataaaatatctcatatacaacagagccctaggtgtctccaccaggagtttcttactagtatacttcctttaacagtgctctgcctaccagtgctggctgcttctgttccatttagtttgtccttgcagaagatccattagccccgtaattaaacaacccactgtcccgattaagtcattctctgttacttcaattacattccattgttcattaaatcctgatgtttgcacttcagcaatcttgtttttaatactcctaccatttgtggagaaacagtgaagttaattaacaattcttgagctttttatttttctctctaccatagtgcaaatcatttccattatgacttgcaatagtactgaaaccattactaacttcatagttagtgttctgagcttcctgatcaaagagtgaaaccactttttacaatcattttaggtaagtcattccctcgttgatggcaagtcatggaaaatgaaaaattaacatgtaatgggtgctttaaatgactttcctcttcatacactttcttctcatgcctgtaatcttggaattagaaaataatttagttatctaaatataaaagtatttactttttttctttatagctcaaatgtgactctattatgttattgttaggatcattatttatatttgtacccctcagagaatggtaaattttatcacaagtcatggcggagatagaaagcattttccagatttgtcttgttgctattgtcaaagttagcattccatttgaaggtactgttatctagagcagggaccagcaaacaacagcctgtgggccaaatgtggcccctctgcctatttttataaagttctattggaacacctgttcatttccttattgtctatagctgctttcctgctacagtgcagagtggagtagttgtcacagagatcatatgagttttaagtcttaaatactttctggccctttgcagaaagtttgttggcctttaatctagagcttgacatagtagagaataggaaccagaatcctccctcccacaaacccacaaacaggttggcctctttcctccccttctgggacacagcaatggaaatgccttgccactatttacaagtctgaaactcatggggctctttgccaacacacaacacccacccccacccccaaccctgcacccgcaaatactgtgaatactaaaatcagttatcttgggctaaatcagacagctcttcatacttgattctaggatggacaaaacgttagcaaatgctagcaagtatagaaaaattggtgagagaaacctaaatttgagaaaattatctccattacttttttttttttttaaatggaaaaaggctctcgttaccctgtcctccaccccttactcttctgttagagtagcagatcccttgatccaggaagctgtgatttatggatctttgtggggaaaggaaaaggggagcagagtgaagaggggaggctggatgggcaagcgcagctcaaaggggaacgtcaggcagaatgtcccagggctgctgactctggcttggaaagaagcttagatcagaagtttccctcagacttgcacttctaactggcctcatgctgcttctacggaacttctgaaactgaattttctttcttgtttcttctctctttaattcaggttggtataagaactaggcttttctcttgactttcattcggccctgaaataaaattagaaatatattttataggttttatttaatgaaagcaattattgctccaaggccttttatgataaagttgccagtttgtaataaattatcttacagttactttctaggcattataaggtatcacagaaaggaggcagcaacgttcctgcttttattagccaagaatatggttgaggagacagtgaggtagccagatcatcttcccatgtgggaaaagacctgttcccctgcccttgattcatcctgccagccccctgcagccttatcctctctgcctcctcaatacccaaaaccaccaaatcatgtgacgggacgatgggtaaaaccggtagtgaaaggggaatgcagttacatgttcccaggccgtgtgcagaagaggtggggtttggagtctgatagtcttgggtttgaatctgggctcagccactttactctgggcaagtctctcaacctctcaaaacctgtttcctcttctgtaaacaggcaatgaccaaaacctgccctcgcatatttgtggtgaggtcagaaaataatacatgtaccacgtctagccatctttcctggtgtgaagtaggtgctcattcttttttgattcagttttccttgtctgaggtgtgcttttctcttgtctcctgtaagcttcactaagcagaaagtgtcccgtcagtattctttttggttggttatttattgatgatgtgggatgtgggggagttgattagctgattccatcatcatgaaaagcatttcttgggtgcctgtgtgcttatgttcttgttaaaaatgttacatatgaccgctgtgatggggtgtttacaacctgtggcagacagtatcccattgggcagatgtgaacaggagacgaccgtgataacctgtgagaggctgatggctgacatgctacaaaggggccaggcctttccagcctggccctcttcccgggccttctggaccatacattttccaatagtcttttctttctcataaccctccttggtaataggcatcattcccaaatcaatcaggatgcagttcagttgtacagaacagagacccaagatgtctgtggcttcagcaacagagaagctgagttctctccctggtggcattctgggtgggcagtgcagggctggtagagcagctgctcctctcttgtcctcatattctaagtgtctgctcaccccagcctcattccccatcccagccagcaggatgtaagcagggctgtagaaaggagggcagatggtcaccagccatcttttaaggaagtgccacataacatatccacttaatgtcatcggccaggacttagtcataaccagaacatgtcctgactctgagctgcgaagccaagaggccagctctgggtcaccatctcccagtgcctcctggccctgccatcctagtcacaagatggctgccaccgctccaagcactactctcccttttgttcggatcgaagacttcccactgggcatggtggctcacacctgtaatcccagcactttggaggccaaggtgggaggatcatttgagcccactgaatctggagcatactggccacacctggcagcagcagaggctgggaaatgtcacctttattctgggtgaacagaagctctgtaaaaatgtccttgggtggcaccggaggcacagggtgctccagattcagtgggttctgtggggttcaatatcaagctggggtgaggaggtcaagcctcctctaccagatcgcctatgtccagcctgtctcctgggagggcattcattgaggccttcaagcagaggggaactgcccttgggaggctcatcaccttggctggcctcttcgcttcgcagcccagagtcaggacacgtcctagttatgactcccaccggctccatgattttggacatgcttctaaatctctctggtctcggtttcctcatccattaaatgaggctaataatggcacctacttcatagagcagttgtgaggattgaatgaacctataattgcattcccagtacgtgataagcactcaataaatgctggtccttattattacaaatctagaaccatattcttttctttaccatatttttttcctatgaatagtacagggactctctttcaggtggcaggaggtggttttgggaggcaggcctgggctacaagtcctccacccatacttccacccaaagaaggtgggatttttttctgtagacttcctgacctgatagcctgagtgagtgattgaagcttcctgctcaccagtctaattagagactggaagccaagtgtctccatggtctaggggcctccctcatgaactacagctctttgcgacccaattcaaatgctgcctcctccatgcagccttccttgatttctctgtttgaaaaccccctgccgacctaaaagaggtacctctctaaatccctaaaatgctccgtctgtacctcccacattctacctggcattagaatgtgttgtatatgccccacagttcttctactagtctgctagtacttcccaagcaggatgagtacaggttctgatttgtatcacctacagtgccctgcacacaataggtgcaaagtaaatggtcatcaatagacgaatctacctcagcatccacaaaatgagctctggcagtttggcacatgcagctataagtaagagaaaattgaactaaggatgcctgaaatagtaagagcatgacttgcctcttagagcagaaagtctggagggaaggagctccaagccggtccctacattccgtggtgtcagagctctgcgtcaccatctcccagtacctcctggccctgccatcctagtcacaagatggctgccaccgctccaagcgctactcccccttttgtttggatagaagacttccaacagggtgtggtggctcacacctgtaatcccagcactttgggaagccaaggtgggaggatcacttgagctcaggagttcaagactagcctgggcaacacagcaagaccctgtctctaaaaaaaaaaaaaaaaaaaaaaaaaaaaaaaatttagccaagcatggcagtgtgcacctgtagtctctgctatgtgggaggctgaggtgggaggattgcctgagcctgggaggtcgaggctgcagtaagccatgatcactgcacttcagcctgggcaacagagtgagaccctgtctattaaaaaagaaagaaagaaaacccttggttttatgtgttggccagagctgggttacatgaccagtccctggtgaaagagaagggagttgctgctgatcatgcctcccaacccaggctggacccactgctgtgcagacctggcctttgttagcagaggagggatggctgctggttggacgacaaaccagatctgccaccgcagcttactgacactttcctgccaaggaaataggaagaggcagggcagtccctctaaacagagggcagatttctggggaagggaccagtgtacatttcacagctctttagcctttcatgggtattttctgggtattatgccatcccatcgatttggaccatgcttactttacaaaacattcttgtacttccaaaggcaggatcaccgagtgtttaagaacacggagcttgagtacccggttctaccatcttcttgctggctgaccttgtgccatttatttaacctctctgtgcctcagtttctcatctgccacaaggggatgagtaaaagaatctacctcacagggttgtttctgagatttacatatacaaatacacacacgtcatttaaaacagtgtctggcacctataaagcactccttaatttgctattattatgtgtcattatttagtgatcctgtcactcctttgagataggaacagtgaggattttaaggctcagcgaagttagacgacttccctacattccctcagctggtgagcagcagagaatgggagggtccaggtggcccggtgctgggcctggaactcagggccctgacccccactgtcctccctactcagaatcctctgtggacacttgctgagggtgatagtcactgatgggtgactgttgtcccacagatgatgcttttgtctctgaaatttatcatgaattatctgagaacaaggactatgtcataacatctctctgacatcccagccctaatactaaatagggcaggagaacatgctggttaaatgggctttggtgggagtgtgggagccggagagatggcgcttccatcgaggtgtctcccccgatggggtacagtggctgagggcagacgctgtgatgtcacgctgtctgacatggcacaggcatctgctccccatcacagagcagaggcccgcgtgcactttcccagcctgggggtggaggtgttaagaggctgaccccaagggccttgactgtacttacgccttaagaaactgctgtttggccgggcgcggtggctcacgcctgtaatcccagcactttgggaggccgaggcgggcggatcacgaggtcaggagatcgagaccatcccggctaaaacggtgaaaccccgtctctactaaaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaagaaactgctgtttgagcactaagtgttagcagcatgaaaaatgaacacatatcaatttatgtctgaatttactctcagaattccctgtggactctgtaaaatgccattttacctcttttccacccatccagctgtggaggcagtggcagatttacattattttacatccagttaagggtgttttttcttttggttatgtttttaaaaagaacatttattgcccataaaaaagtgtttttgttaaagacaatagtgcctttaggtagtaatagaatgctgtttcacaaatatttataaaactattaaacaagctgagattgctgaagctccgattaaaaggtgcctcccattcatctttccctttagaaactgaagtagcttaactgcaattacccgccaccatgagaagatcaccttgcagagaaataaggcaagaccccaacaagatcgtaggtggtggcaccagcattgaccccttcacacccacccctcccactggtgtggggaatttagcttaggacattgcttacagcctgagctaagccagggtttctggagggtcaggagggctcctgggctataggtggaaccagaaggagggagggagggcgggtggtaaagcggggatggcatagccgaggggtttgtggcaccaattgtgcagttaggcaaatctggcttcaattcctggttctgccactggtgagctgttcctggagcaagttactcagcccctctgtgcctcagttccctcactctacaacagggatgggaataataatccaggaaacatttctagaaaagggaggtgaggagagggctcgggtgtgaggcttcacatgttggttccttctaggcactctgcccaccagctccctgccttctctcctgtctggtattttttgtttcttgtttgtgagcagacaggcctttgaaccccttcctagtcggtggctggcccagaacataaaggttctctgagagcaggcaagggagtgactctgttgtaggagggaaactcgtacaggccagacggagatcaccggcttacctcagagttcagattccactgattcggagttttaatcatttggttgagaccagaacaaaatttactcttgcgtaattatcaacaggattataagggcaagatttagtggtgtttgtctcagctctttataaacaccataaactgggtggcttataaataatagaaacttatttctcacagttctggaggatgagaagtccaagatcaagagttggtgtcctgtgagagccccctttctcatgatggcgccttcctgctgggtcctcacatggtggaaagggcagggcagctctctgaggcctcttttataagggcactaatcccatttatgaggactctgccctcatgatctaatcccctccaaaggccccacctccaagtaccatcaccttgggggttaggatttcaatacctggagttagggggacatcaatattcagatcatagcagcattaaagacaagaaacacccctgagaacctcccgaaatttcagaagccccacatccacgtcagtggtccataagtcacgggctcacatgccagatgctgttctaagaactgtgcggttactgttgttatgccctctttgcagatgagaaagcgacatacacagaggttacacagctggttagggatgggttcagaggtcacccagctggcttgcggtggactgggatgaaagccaggagtctactggcttccactgggttcattgctggcagcctcctccttattcagagatactgagcatggagtgggcgtcctagctgtccaatgtgggctgaatctgtttgcaaatgagtggatactaatgccaacaatagtaattgtacaggttttattgccgatactatcatcaagcctttcccagcagcctggccccgtgctaagcccttgaatgcatgatcacatttaatctccctaacaatgctagaaggccggtactgttattacacccatttttaagttgaggtaggcctgagggttcccatcttccatatgatttgtgttttcatctctcccctgagccctaggcaaatcagacattgcctcctgcagcctctgcatatatacctggctagtgtccacagtacttggggacctcctctttcggctttggagccccccctccctctgtctctgtatgggcgagcatcttccttctgtcttctcccttccttcttgcctgttagactctccgctccttaaaaccaaaaaaaacaaaacaaaattcccattacttgatcattttacattccctcgttaagccaggctcaaaacattaaataattgtgcatttcacaccatacccaagcctttctgactttgtgattaccaaggtgcattagaatctaaactgctatgttatgctatttgcaaaatactcttggctcttccctgaatcaattcccgtgagggtacgtatcaggtaaaactttgttgttttagatctatttgttcttagacaaagtaaacttggaattgcttttcagtttgttttgaaatattccctagttctgtgttttcacacgtgcacaaaggccttacttcccccattagtctgattctgaagttttgctgcactaggagaatgttcactgacaaaatgttaagtaatggtgctgaaatgtaaagtaattaatgcaagaatcatagtatggggtggggatctcagtgctttaatgagggctggggaaaccatctgactgaggatgttgaaagcggaggggtagatgaatgttcctgtaattaatgctgcatattaaaaaagtgacctctttgggccgggcacagtggctcacgcctgtaatcctagcactttgggaggctgaggtgggcagatcacaaggtcaggactttgagaccagcctggccaacatggtgaaaccccgtctctactaaaaaaatacaaaaattagccaggcatggtggcatgtgcctgtaatcccagctacttgggaggctgaggcaggagaattgcttgaacccaggaggcggaggttgcagtgagccaagatagcaccattgaactccagcctgggtgacagagcaagactccatctcaaaaaaaaaagtgacctctggcatggtcaatatggggacctcgtaaccttccctgtcacctagaactgcacttctgggactctgtggtcctattaataaaaaagataatcaccagtctgcctcatctactgtggaacccttccaattcttttttttctttttcttttgaggagaaattagaaatcaccaaattaccatttttagactatttatgtgtatatgtatattttactctcagatatatttattcaatgcttgctctataatgagagttttaactttctgttttcccttccattatccctgaaaagaatggattatggagaaaagatgaaagtagtctaatgcaatacagtgtttgctaatgtgctgtcagaggtattagtgggacttgctaaggtttgtgtcttttatgaaatgcctttcagattgcaattatctaatagacttggaaacctgtttgtactcttgcaggcattaaacgtcgtctttgaaaaaatcccggaaaacgagagtgcagatgtctgtcggaatatttcagtcaatgttctcgactgtgacaccattggccaagccaaagaaaagattttccaagcattcttaagcaaaaatggctctccttatggacttcagcttaatgaaattggtcttggtaaggcggtgcgggagctatgtggtcccaggccctgatgagtgtccctccctgcctgccctccctccctgtcccccctccctgcccccaccagcttccattcagtgacacttacacagccaggttgttcctggagggcatgtctaggggccaagagactgctttggtctctcatgggcatcctgattcttcgaaggaagcacggtccttcaaagatggcgtttgttgttgttgtctttaaatattacgtctgtaaatcagattgatgagattgcaggccctgagactgcacggaatcaccttgcatcatgaaatacagaaaggtgtcaacacagtgccctctgcgtgtgttgcatttcacattggcatttgatttgtttgttgtgatactgagcgtgtcattactgggtggctcagactctgggtgttaactctagcctgctagaaaggtcatcttcctctgctaatcacatcctgtattaagtatatgctccgtcctccctcagtgtgcagcagcatctgctatgaattcattttcgggctctactggtatactgcaaaggagagcatatgcgtgagcaagctaacagggccccacttccctcaaatgttcatcaacattttaaagttgagctccgtgcagtcctcccaggagactgtcgtgggattttatagcagataatgggacagaaatgaagaatagaatcatggtggtgacagacagtgtaacgaggttcacttccccttgatgtacagttataggccttgactaagcaggcaattaaaatcctcccactcggccctcccagtccagccccctgctaaaaggccattgataaagccttgaggcagggtcttggaagtttgagaccatgcaaatgtggggcaacttggtgatgtggctttaaagaaagcagggctgctaaggcacccctcttctgcttccttccttgggtgaccgttgagtcacttgaggaccattttagctcatttggttagatacaggatcaaagggggagccccagccaggacaccatgaccctgaccccagacccccagcttccttgctctgagcatacatcttgcaaatatgtggctgtcactacaaaggacatgggcataccccgcccgacagtcttggtcctgccgctgatgagtaggtagtagcatccttactcttttcctgagtttgggtgtcccttgcctcctaaagtaggaaggcaaggagcagagcaaggagggggcctggggacacagcctatcagctatgtcaggcttctgtgtgcctgctgatttcccagactacctccagaaaccagccatcaactgtactgaaatccaacaccaggctggacgtggtggctcacgcctgtaatcccagcactttgagaggccaaggctggtggatcacctgaagtcaggagtttgagaccagcctggccaacatggtgaaactctgtctctactacaaatacaaaaattagccaggcatggtggtgcacacctgtggtcccagctacttgggaggctgaggcagaagaactgcttgaacccgggaggcagaggttgcagtgagcccagattgcgccactgtactccagcctgggcaatggagggagaccctgtctccaaaaaaaacaaaaacaaaaccaaaaaaaagaaatccaacaccagaagcagctatgcttggagctcttacagcagagactcaaaaacgcagatgcccaaaggggcagaaaatacataaggggtgtcagccgcctgggactacagaaagcagtggagcttgacttaatgggaaaggactcgccatccaaggggacagtgccatttgcttcagtggttgccatgtggactacagattgtattactagactgttcgattttctttttttaaagaaatcagatatccagttttttatatgcaacttaaaaacttttaaaaaaaattttatagagacaagtctcactatgttgcccaggctggtcttgaactcctagcctcaagtaatccccctgcctccgcctcccaaagtattgggattataggtctgagctcctatgtccagcctatgtgcaatcttttaatctttaaatgttggcactgagttgacactaaaataataattaaacaccatgcaggttccaaaaaaagaaaaatcacatttgtgcaccacatgctcacctaggcataggttagcagccttggccagagagtctgcccactgtggtgctgggaccttcgcacactgatgcctccccctccaccccgaacaggagcctacagagatggttcatatcatgcctctctttgtgaacatgggcacacaagtgtgagcatatacaaatttgcttctggaatttttgttgaagagcttagtcgtccctcatagaatgcattattttgtcttcagtggctttacttccaggcttatcagggaagaagtggtttgaaacatcagagccctaaacaaacaaacaaagtaaaacagaactcagaattcaggctaccagtctggctgatgcatctctacaccttcaaacaaagatttaccactttattcaagttttagttatccataaatttgtgaaagtaaagtggtggcattttaaaactctctaaaaaggaacaaaatgctctttttcagagcttcaaatgggcacacgacagaaagaacttctggacatcgacagttcctccgtgattcttgaagatggaatcaccaagctaaacaccattggccactatgaggtaagagcaagacttgaccccgtgtctccttcctcatccccaatcctagtcccatggacattcttttaaaacatccaggactcccacccatttcctggaatgacttgcagatcgatcgtgtctggggctgaagttttctttcgttgcttgtgcagacaagcccatgaagggctctcacagtgtacttgtcacgtattcccttctcagaaggctatgattttctatctcctgaactctctccaccctgaggttcagcagaaaagaacccaggaaaaaagtctaggaaagccagagaagagttatcctttagccttcactgggtgacaagcgtgctgatgctaaacaaagcccgggaagtcccaagcctcgcctccctccacaacattcacagtagaccttgtaaccttttgtgtaggtccttgcttcctgaagaagttctaaatttcctgtttgtttgcaatattgagcgatacttcctttggcctcttaacccacatactgggtgagtgccgagggcggtgaggggtgcacgtgacttctcagagatctgagtgccagagaaacctgcacataacaagacagaggaggcagtgaaggttcctgaacacactgggatactggggttcacttgtttagcagtattatctgaatctttgttgaatatccactctgataagagctggggctgcatgggagaggagcaaagaccaggtccctgccctcacagagcctgcagccctggggaaggagtgcaaaaaaggacggagagacaagtagagtcaacaccttgcgtgtagtagtgctgtgtggcttggagaatccaagaggcttcctggaggaggttatgactgaactgagagctaaacaatgagaatttagccagactgggctagggtgcaggcacatccagcagggaagggagagcatgcgtgttagactagtcaaaacttgagaggggcaatggagagggggaaggagggcagtgacagctgattatagtcagtgcttatgaagtacttacaccacaccaggtactatttccagcatgtccctgtaatgtaactgcccaacaggttcaccttccccattgcctagacagagctgatttatcaagacaggaattgagataaagtaatttggctgtacgggagacgggagttttattattactcaaatcagtctccctgagcgttcagggatgagagtttttaaggacaacttggtgggttgggggaagccagtgagccaggagtgctgattggtcaggtcagagatgaaatcataggaagtcaaagctgtcttcttgcactgagtcagttcctggggtgggggccacaagatcagatgagccagtttattaatctgggtggtaccagctgatccatcaagagcagggtctgggccaggcgtggtggctcacgcctgtaatcccagcacttcgggaggctgaggtgggtggatcacctgaggtcaggagtccaacaccagcctggccaacacggtaaaacgctgtctctaaaaatacaaaaaaattagccgggcatggtggtgcacatctgtaatcccagctacttgggaggctgaggcaggagaattgcttgaacccgggaggcggaggttgcagtgagctgagatggtgccatggcactccagcctgtgcgacagagcaagactccatgtcaggggaaaaaaaaaaaaaaaaaaaaagcagggtttgcaaaatatctcaagcactggtcttaggttttacaatagtgattttatccccaggagcaatttggggagagtcagaatcttgtagcctccagctgcatgattcctaaaccacaatcccaatcttgtggctaatttgttagtcctatgaaggcaatctagtccccaggcaagaaggtggttttgggaaagggctgttgttgtctttgttttaaactgtaagttcctcccaaagttagttcagtctacatccagaaatgagcaagagcagcttggaggttagaagcaagatggagttggttaggtcagatctcttcactgtcttctaacacatctgcttcaccgtcttataacagtgaaaggcatctgaaaggtttgtttcagatgtttttcactgttcacctttcagatgtctttcactgttatagttttgcaatggcgatttcagtatttcgccccattctatcctatagcagtcctacgagataggtactattattaaccccactttatagatgggtacgatgaggctctgggaggtctggtaacagctagtcagtggcagggccagattcggacctggatagttggctgtagggtctgtggctgaaccagtccatgctgtggcctcttacaagatgtaggggtagggaggcaagcagggaagatgcagatcacacagatgggggcagcctcttcaggagttctgagtcttatcccaagaacagtgggaagccatgggaggtcctgaagcagggaggttagtatttcagaaaatgagtggggctgtgtgtgagatgtagatagaaggggtgcaaacctggaaatagccccattagaagctgtggatttctggtgaggattggtgctgtccagcaataatgcagtggctctggacagacacagagacacacaaatggaatcagatgctcaggaggaggacaccacaagtcacgtggatgggagggatagtaagatgagggtggggtcaaagatatcagttggggatgactgtgcagatgcctggaggcaggtgctttcctagagaagacaggaggaggagcagcttcccagcacaccgggagggtagggaccccctgtttttcatggctgtacagtcccagggtgacaggtctgcaccaggaaggacctaggactctgccagattctccccttgcccaggaagaagtgagactgttcccgagcagagcttcttagacaatggccagggacagagaacacccatccttgggctttttggctgagtgggtcacccagtttgaaagtggttgcgttgggtgatgactgaggtgctgcccctgtggcattgctgtagggagtctagcagagaaagctgcaggctagcaacttgccccgtgctcactctcctatagctcagacttgccaaccctggaatcatcttgccaagagcagtcgttcttagcttttggagtttgtaaaaatccccagggagttttctaaaagtgtgcattcttgggctcaggaataaggggcatctttggctgtatttggaaaaacacggccccagagggaaggtaatggccaggaggagatcggagtcagagatgctgccctgctgggtggaagtgcttatcatggcatcagttcagggttctagacctgcaagccagcacctctccctgtgtctgggtggcaggcttgtcttgatgagttaggaggggacacagactccaaggccctcctctggtgctgttgactggagttcttgtcttgctcagctgtgcctcccctgccaggcttctcagcatcccttggccactgtggggcatggggtgggccgcagaggcaggggatggggctacccactgccattaataggaggaggcagggcaagtctctccagcagggagaatgaagaaccaccacagctgtctgcaaggcaaggtgaaggcctgtcgggagagatagaacatcagtcttcactgcagacatcggccgtgctagacacctatctgcttaaggatgataatgaaattaatccggcctgtagtcacttcccgtccaaatgatttattggcctcataccccagtgttgctgcatggtggtaataaatgacaagcctaggacatgaaggcttaaaggattctccttatgtttaaaaagctaagccataaggcaaataaaccagagagcctgaaggaaacgggaggtcattgggctccatgttctctatgcctggaccatctcaaaagccctgttttttaaaggctgcttggagaaaatcatcccccaccaccctcagccacctacatctatatttgattaagcagcgcctccgcagactcaacatttgggagtaatttgacagggctgggctgaagtttgcttttacccttttgttaaagaaaaaattttctcttgagcactagcatttccctccaaagagacaagatgctaattatcactcttattcatttactaaagcaccctagtttgagtcactgtatgtgcttaaaagcaaaaaaaaaaaaaaaaaaaaaaaaaattcatttaaaaatagggtctaattcagagttttaagtgaatcagactcacctccctccaattagtccacattagttaggttttaaagttaatctgtagtgacggccagttcctcctactatctaaacaaagtccctgctgttggagagccagcctgtttcttctttccttgtctgtccttagggcaaacagagtgtagctggtctcgtctgaatgatttactctcagcacatttgaagaacaggtttctagaggggatttgagggcatgacaaaaatatagcatctcatggactagatgcagcccccagagccccacattgctggcagggccctgtcacctactggctgacacccttggcaacccccagcaccggggaattgctttccatgacaataaccatggcagccagtgcctggcactgctcacatgcattagttcaattaatgtccacaaaaaccctgggaggcaggtgctttccttactcccattttccatctgatgaacacagaggagggtgcatttctgttccagtgtcattctgtcctgtgcagacaaagggttaagcgtgtctttacacatgaagccagaggagtctttctcccctataattaaaccctcccggtgcgcttccttaactggatgtcattctgtgtgcgttgactatgaaggggactgtgctttgctctggtgccaacagggtctggggcatgtgcacctgcatgttcagggagtggggcacactcgtcccctaggactgtggcagggtggtttctctggagtccagccttcttcctctcactcgcaccctgctgtgacctttggctgggccgagttattgcacccgcaccctgctatggagtagtggcgagtgtgcaggacaggtgttgggcaggaaattttctctaaagattacacttcgagttctgagctgcaaggttttgagaggcagaaatgttgtttaaccgctttcattaacagatgtgtactaatgcagaagtggtcactgctaacaaatttgtaattcaaaagatatttaaagctcataggaatgccccaaagggtctgttaagtaaggtcagcaatgcttctggtcaagtccatcatctgtgacactaaaagggactggacaatcgctaaaggtctgttgcagtgtgaatgtctttagatattcatttaacaaacacgtataatgcttcttgtgtactgggtactgttctagggctttgaccaacagcagctctttccgtcttctttaccgctccatgaggtgaatactatcagccccattctgaggcccagggaggctaagaaacttggccagagtcacagagttccttcactgatgcctcaaggcttgaaagcaggcgaaataaccactctagagactgtggctctgcgcagggcctgagggataccttcccccagatccaggctttcagcccatgctcctaacctccgaggcagcctggctagagagctgggcctgattgaggagaaatcctggtagttacattctctgatgtcaaattcataaagggtaacttctcttaaaatcccagggtgaatctcgtgtctgtgagtttatcaaaatgcttccctacttctactttaaccctctttttggccagcagtccgtgaagatgacagttaccttcatccaaagggggcctctctcaggcatctgggctctgacaactccaacccaacaggatcactcttgagtcttaagtgttcaggtcttcgcagtttcccacacattcttggtggcccaactccctcaggaggaagacagtctcagggctatcactaataggccgcagaaggagctggctagtggcctggaggttaatttcaagtaaacaagagagaagcaggagccctgtggcattttctctggtttccagcatcctgtaagccctcccctggatgtccagaaccttctgtgtgatttgaccagcctgtggaggatgttctgacggccccttccaatgcactggtgaacccctgtgctgaaggactcagcaaggttatccctcaagccctgagaaacaagattttgttttcatcagtttccagccttggggcatcagtgagaagagctgagggagaagacgatactgacggagggagagcaatattggcacgtggctgctgggacagcatgtggaatagaattctgttttcacgtaatattgtttcagcagaaaaggtgatttcaggaatgagagatttcaatcagagtttctgtgtagtgatttgattctcatgttttcagatttttttctttaaattatcacaatattcagaacatattcataatttttcataaaatttatagctacaatgccagcatttctcttaggtggagccatatgaaattgtcaataggtgaccatttttacctacaaaagtggtagtttcataaggttaaacataagttcaaccttacatttctagaaaatctcttttcatggaattctaagctgtgccataaacatggtatcttataaagaaatcttaccttcacttgcaagtggtttggaggatgtgtagctcctgtttattttggaaatgacttaaagttgttgatatgggtctttttctccctgagtgattacaacttctcattctaatgatgggaaagtctacagtcatctctgccacttctaacgtggggtggccccaattcccctccattgatgattggaggggaatcgcttgttgtcacatcgaatcctagaaccctgtgagactggaaggaatttaatttgaaattgccgtgcgtaccagttctgctctgggctggagaaacaatcctgctgcagatccatctagtgacattaatctttctttgacttaatttggttttcatccctaaagtaggggcccagaggacgctccctgcctcacaggactaggggacgattaatgagtcactcttagaagagcatttggagctcctcagatggaacaaatggcatctttttaacactctgcattccagggcacttttcaaaaaggcatttctgtccttacctcagcagcagctgacttgtgctaaaaagaaaacggaaacctttcccccacaaacatctgtaaataaactatttttctgtctttataatcgtgttaaagtgtcacatgggggaaatgttccagctctagagcagctgtgaaagttagaaatgcactcacacatacgcgctcacacacacacacaactcatccactaataaaatgtttctacacttgctcttgggagataatttcagagtaaaatttccttggtacaagctgtgtctatgctatcttaatgcctgagcacagcactagcagcgggctgttgccagctcttgaggagacatttgaacttttggcagcgttccttatcagaaggcccatccgaggtatttgtgattatagagtaagggtgctcgcttttggcaaaacaaagcgtctgacagtagtgaagtactggctcaacactcaatgggagacatttgggattcattctttgacaattacccagaatgaatcatcagcttccttttataaaaagatatttattggcttagaaacagagcatatccagctcttcgtggggaggaattttgtaactatgttcaaagcttctcataaactcggtgtctgagtattgctaagggggtgcctgcacagagcatttagtttaattgcatcaaatatggaggagaattgaaaaatcagccagcaaacaatgaatagctcaaggggaaaaggagaggatgctcgttaataggagcagagtcgaagagctcagtaagagttaagaatccctgctggagtcactttgcagaggcctgatggccccagccggcccctgcccagtgctgcccccaccccaccaccaagatatcatgcacaccagcagttggaggcctctggcctaaacttagcggctggctggacagctgtgtttgaggacctcttgagggctggctcttgctctgtgttcctccctgtgggtgtaacctgaaggagattaggttttaatcctttggtgcttgctaggtgggctagtacattctgataaccaatgtgcagcaggccagaagagaaattctaggtttccactctttccaaactgggaaggcaaggtccaaattaatattagaattgagaatagctttggagcttcagaatggagggaaaagtcacttagctgataaggttcagaagtgacagggtcagtcctccagaaacagttccagaatgaaggagatttgtggatctctgacctgcctccttcttgccacccgtttgtcttgtaattttgtgaatgagcccctcctcccacagagccaggcctgcccccagcatcttggcatctttgtccccctttgcccgaagggcacttccttgcttggggatttgcgagtgcccatcagggtgtgggggaggggcactgtagggccacttgaccctggtttccatggtaccaaaaggtcttaggtgagaacgcttgattttaactccaaaagaggcaatatatacagaggcctgcctttgtcaaatgtatacatttaaaatctgtggcaattcttatcagttctattgaagcataatttttgagacagggtcttgctctgttgcccaggctggagtgcagtggcacaatcgtggctcactgcacccttgacctcccacgctcaagccatcctcctgcctcagctgggactacaggcgtgtgccacaatgctcagcgcttttttgtttgtttgtttgttttgaggagagatggggatctgagttctccgggctggtcttgaactcctaggatcaagcaatcctactgccttggcttcccaaagagctgggattacagtcatgaaccactgtgtccagccaaaatataattcatattaccataaagctaattcgtttaaagtatacaatacagtggttttaggtatacttatagaattgagcaaccattgccacaatctaattttagaacattttcatccctcccgaagaaaccttgaattcattaacagtcactccttatttcccccagccctgctttagccaactagtaatctacgatctgtctatataaatttgcccattttggacatttcgtatattctttttagattcgtgggtacatgtgcaggtttgctacaagggtatactgcatgatgctgaggtgtgggcttctattgatcccatcacccagtgaacgtagtacccaacaggaactttttcagcccttgccccagacccatccccgcttttggagtccctcatgtctactgctcccatctttatagacacttcatatcaataggaccatacaatatgtggtcttttgtgactggcttcttcgcgtgtttttgcagttcatccatgctgtagcatgtatcggtaattctttccttttattgtatggcaatttttggtagtatattcatactacatgaactaacacatagtaataatgaactacttgtagttgcaacatgaatacatgtcacagaccttatactgaccctcaaaatctagacacagtacatactgtatgattctatttatatgatacccaagaacaggcaaaattcataaatggtgatggaagacagaaaagtaattacctctggatgaagatggggtggtcattgtctcggaagggacaatgggagcacttttcaggaccttgcaatattttatatcttgataaaggtggtggttatgccagtatatatttaatgtgaatagtcattgagctgcacacttaatattagcaaaagttaagcatgtcccacattatgcttacatttcaaagcttttattaaaaagtatatgcaaattttgtgattttacaagcttttgaaaaaatgtcacaggttgaatatcccttatccaaaatgcttggaaccacaagtatttcagattttggaatttgcttggattctagaatatttgcatacacataatgaaatattttagtgacaggacccatgtttaaacacagaatttatttatgtttcatatacaccttgtacacagagcctgaaggtaattttatataatttgtgcacaaatcaaagtttttattgggttttgactgtcactcatgctatcatgagttcaggtgccgaattttccacttgtggcaccacgttagcacccacaacgtttcagattttggagcattttgaattttcggattagggatgctcaacctgtatatacctacagaaaaacaaataaattataagcgtactgctggatgaattatcatcaagtgagcatatcctgaaactaccacccatgtcaaaaaatagaagccctctcctggcctttcctaatcactaccgctgctctcttctccaaatatctaacatgatagttttgactgtttgggctttttcttttttcaagctctatgtaaatggaatcagtcagtatactttcttttctgtcgagcttcttctgctcaacattatgattgtaagatttacccatgtggcgtgtaacagtagtttgctcattttcattgttttataaactgttgtataaatatgccccaaattattcattctgatgatggatgtttgagttgtttccagtatgggacaattacaaatcgctccctatcaggatttatacttatttctgtggactaaggacctacatgtgaaatggctctgtcatagggtagataccaactttatataccacaatttctgaaaacccatttcagcatttcttaatagagtagtgtcatagtcagttcgggctgctataacagaataccattgactgggtggcttaaacatttgttccttatagttccagagactggaagttcactgtctgggcaaagtactagtagctcggtgaggaccctcctcctggtttgctgagagccgtcttcttgtatccttgtgtagtggaaagcagaggggaccagcaagctctgctgtctcttccttttcctcctctgtttagagacaaggtctcactctgtcgcccaggctggagtagagtggcacagtcagggctcactgcagccttggatgtctgggctcaagtgatcctctcacctcagcctcccaggtagctgggactacaggtgtgcaccaatgcgcccagataattaaaaaaattttttttatacagagggatctccctatgttgcccaggctggtctcaaaactcctggactcaaggatcctcctcttcttcctcccaaagtgctgggatcgcaggagtgaggcaccacgcccagccctggtgtctcttcttataagggcactattcccatcatgagggctccaacctcatgacttagtcacctcccaaaggccctacctcctaataccatcacactgggattaggatttaaacataggaatctggaggagacacaaacattcagtccatagcaagtaacaattttttaacctcaaaaaatgaaactggcctaggtcttgcctgacctctgcgaattggggggaatgtcctaacacagctcagtcttcccctcttccagggcttcccacctcccatctgtcccacagggtcctggcctccaccttctgcgtactaccccactgcctcccatggcctcatcagcctcctccacaggaccatgagccccttgaggacagagacactgccttgcttgtcatttagtcccagcctccagcacagtgcccagaacatagtaattcttgataaatatttgatttaataagtgacagcatgtaagatccatccagccatctaattcctgggtgaagttgagaaatccattaaattttgaacactcatatatcttttatctttggtttcagatatcaaatggatccactataaaagtctttaagaagatagcaaattttacttcaggtaaccaatataatattgttaaccttttgttctcacccagcttcataaagtattgctttttgcctctctcagctgtattgtcacaaaggtgagattgagttgttgctatgtaattctctgaaagttgagaaaagtcattttgatctctttgcagtcctaagaatgtgatccctgcaagaaggaaaggaaactatagatggtggttggcctggactgcccagcactgaggaagtggctgcctctttatagccctaaactcagggcagaatctcatagctttttttcaaccctttagaaggatggggcctaacagaggagatccccctggcaaactgagagggaagagtacagacaatcatcacagagccccgaagcaagcgctgaacaaacaagataatccacttagaaggtccaagtctcctgtgatagcacttgcaaaattcccagaaattggagagagacaaactaaagggggaacttttatgggaaagtcaataggctggtctctaaagtgatcttctgcttccctgatagccctggggcaggaaattcctgttccaggtttgtctccagagaaattataccccagtcaagacaatcagctctcagcccttggaaaggttctgagctcctcccaaacaggctcctttcacacacacagccagaggtagggcttcctgacttctggattcactattagaaggagcagggagcatctggccagtgcaaacagggaatgtggggttcttgattatacagacaggataattgggtaggactcctttggggaaacccaccttccatcactatatggggctgtggtgaagccatcttgcagagatcattccagcttaagggggatggtgtctttgtgttgaaaagtggaagagcatggtttttaggtttcaaagattgggccttttgaagagcctattatttggggattgaatagtagaatcttaggtttggatctcttcgtgggccctccagtcagtcaacactgctgctagtttccattcactgcaactgagagccaccgtcttacaccctgctaatactctaaacctcctgtacctctgtcctatcatcagcccctctgtcaaaatcccaacgctggatgaacccaacgattatcctttcctgaccctacagctagggagccacagaagaaaggcacataatggcacacagtgggtcactataagttcatggtacccaacttgaccagggccctccacacagcctgctctcattgggttcctctgggcaattcaactctgtgttgtccataatgtctgccttctctcctcaaagctttgacccacacagctctcctctcagcagatgacttcaccctgcactctttacagagaaaactaatcagaagtccttcaacagccagtagcaaacctaccaacctacctgcacctgccttcttccttgatgcttgtaggctgaccttcttccattcaaggccagtctctcacctgtgctttgggtccaccatcctttccaaccttcttggtatccttacaccaccagtaatctcttttctcacctgtactttcttttcctctccatctactccccattttccattagcatttcaagatgtgctcgtctctctcatctttatttttaagacagtgtctcgctgtcacccaggctgtagtgcagtggtacaatcatggctcactgaagcctcaacctgctgggctcaaatgatcctcccacctcagcctcccaagtagctgggattacaggagtgtgctaccatgctcagatactctttaaaattttttgtagaaatgaggtctcgctacattgtccaggctggtcttgaaatctggactcaggcagtcctcctgccttggcttcccaaagtgctgggattacagatgtgagccactgagcctctctcaactttaaaacaaacaaaccaaatgccttacttcctctcttccctccatttaccactcccttaccctttacagccacatttcctcactctgcgctactcttgacttgctctgtgagcaccacctcattgtcctttgagatcctagaaagggtcagctccttcctacctttggaccttcctgcaatttgcctagctgactctatctcttcattagattcagctcaagcatcccttcctcaaaaactcctggactagatttggtctcttgttaattctttagcatataattctccttcataacctttatcacagttataataattgtgtacctagaagtttgatgtctctcattggccagaatgcaaattccatcagggtgggaactgggtcttattcattgctatatgcccagtagtccctggcacataggaggtgttctaggtacatttgttaaatgaatgaggcttgagcctctcctaccagcaagagatcagagatcactagggaatctacttcctcctccaatccctcacccgtcccatcttcacgctgttcttaagatcttaagatgcagcagggggaaaaatgtagctatggagagctcaagtcaaaaagctcaagtaacttcagtatacagcacaaatggggccttttaagagaaggccgattagcccatggttgctttttttaatggactgctttctctccctctttctctggcattcagatgtggagtactcggatgaccactgccatttggtgagttcaggctttcttgtgctcaccactgaactgcatgccttctgtagcaagagtggtctccttgggtaacgcttctgctgtcttcccttcagattttaccagattcggaagcattccaagatgtgcaaggaaagagacatcgagggaagcacaagttcaaagtaaaagaaatgtatctgacaaagctgctgtcgaccaaggtacacttactgttctgggagcactttatggctacctagggggtgtatgatatgtttgacttaatttccactgaagtgtgaaaatgttacaaatcccttgtgccttctagcaaagcaaaatgaaagtttaaattgtaaacacttcctacccagttcctcttctttttatacactacaaagataacagcactttacagatttgtactgtagtatcttcagtcagggatttaatattgttcccagtctctttctccaccatttcactattattgttattttttaggttgacagcataattattccttttggtttacttgttattatagatgagcaataaaactccctttttgaattgcgaataaaatgaaggggatgggaagggtcaatgactataaacctagtaaatcttaatttttgtttttcattttaaaattaagaattctgctcacacataaaagtgtcagatgtgaaagccggtggaataccaaaccgagagcaaattttactttatctggcttttagtggaattaacagaagtctgtggtgatcttttttttcctccccctctggaatgatgagcactataaatgctatgatctacacttggccccaggaacttgatgggcatgcttcttcagattataacaaagaatctgcttagagcttaggagatttgtttagtgggcagaggacagcccaagcctcttgattttctcagctgtcccatagagcccagcctatttggcttttgtgaaatactcaaatgctttggaaagtacacaataaaactttatgatagaaatatatgcaacaggaaaaattctgggaacagagcagcatcacttgagcttttccaggctgaacataactaataaaagccaaatatccatggcttcctggtttatgtaaacagccctacaactgacatttcaactgctagagatttctgatatcctcccagttgactaaacaatgttatcagcaagaagcttatgaaccaaatctaaacctgggcatggattttcaagacttttgacctatactgtgagcactggccacatttgacaattttacatttttctcttcagtttgtttttccctgttttgaacattattttctctgaatgtggatttgcttttgctattatgttttcaaaaccactaccacagtttttaatctcccaaatctgatgttgtctatctttcaggtggcaattcattctgtgcttgaaaaactttttagaagcatttggagtttacccaacagcagagctccatttgctataaaatacttttttgactttttggacgcccaggctgaaaacaaaaaaatcacagatcctgacgtcgtacatatttggaaaacaaacaggtgggaatgtaggtgattagtgactgttttcaagaatctgggacagaatattaactaaaagaaagacatagatagttatagaaggattcatttatctctatatcagaatctttgggcttggtaagctatcatgtcaaagtagtttcttattctgttactatttttaaacaataaaggaaaccattcctatgccaagaatcctgttcttgaagataaactgttatctttggtgcatgatactttgtctagaatgttaaaagaaatttaagttgaccagtaaagaatgagaaattaacatttgtggttttatatcatttttgcattagagaaaattttatgataaaccattttttgttcctaatcggttactttgcagtctccaagctgtctatactctgattctgtacagaaatttatcaagtgcagtactcagatactatgagaattagccaaaagtttgtgttttgttttatattttaatattttaccttaaggacaggcaaggcatccaaattttgcctcctcagtaaagaaatgtagctcatgagctctctttgaaatgctgtgtgcatgggctggataagactcagagttatgatgaagtagaacttctcagtgcaagctcaaggctttccaggcactgagggcagccaggtcactttaaatgagtatcaaaagctgaagttcctctaggtctaatctcccatttaatccaggcctatcccaattctctacgctggcttgctcccttctcttcctgtgttctagcctctttttttttgagacagggtctcactcttgttgcccaggctgcagtgcagtggtgggatctcggttcactgcaacctctgcctactgggctcaagcaattctcccacctcagcttcccaagtagctggaattacacgagcatgccaccgcactcagctaacttttaaaactttttgtgagatgaggtctcactacactgcccaggctggtctcaaactcctggactcaagccatcctcctgcttcagcctaccaaagtagtgagattacaggtgtgagccactgcccctggcctgttctagcctcttatctccagtccctgccactcccacatcaagactgggagctgagggccaccattccaccttgaagattatggcatctgagcaggggcagcagccaggacagtagagctgttgggagacctagcagcatatgggggaggtaatgagctaggccagagttgaaaaggagataatggaaggactttgaaccagtcccaagttcatgttcgggtatttgagtacctactatgggccaagcagttagttgctggagatatagtaacaaaacagatgaaagtccaggtcccattctaatagttggggacagacactaaatgcaatatgcaaacagtagcacattagcagatgatgagtgcagtggagaaagtaggaaaggaggctagtatgtgtcaggactaggtgatctgagaaggcctcacagagatggtgacacttgaaccaagtcttgaaagaggagagggcataaaccatgagactacctgaggcaagaaagtttcaggcagacagacgccaagagcacaagttgtgaggcacgtgcttgcttggcccatatgaaaaatagcaaggagaacaggagagttggaatgagcgcggtgaggagcagtgggataggagggccaggtcatgcagggtgttatccagagggagatggagagcctcagagggttggagcagaggagagacatggtctgattctgtgttgagaggactgctgatagttatgtgagaacaaactgtcaggagatgggaaataatccaggtgagagagattataatcaagagctatctggagaaaattcttgcccatggccactttcaaacttaccctcctctatccttcttttacagtagctctgccagttaaccctttcttcttctctccaagtgacgcttctgtctgttgcttggtatgtttggctaagcagagttgtatacttcaataacaaggacaaaaacacccgtttacaaactgtgataaacagaccattggcttcatgaatggccctatttgaaaagagattattctctctttgaacagccttcctcttcgcttctgggtaaacatcctgaagaaccctcagtttgtctttgacattaagaagacaccacatatagacggctgtttgtcagtgattgcccaggcattcatggatgcattttctctcacagagcagcaactagggaaggtaaggcccagcttgagtatttcttgtatgcagtcttatgagtttgacatacttgtctttctgataagcattcaaataataaacaattggtctaaactacaccagctaaaaagagatagcaagggccactgtcaatttgctgttatttaaaatctgtctcattatttttaatctaatttttttaaagtgaaaaacaaaataattagccccacccaactgcagaattctgcctgtgaaaaactttatcacaaagtatgcgttttgtttcctagaaaaatattctatggacactgataaactattaacccaaaatatgcaaccattgaaatttgcctaaatcaattctatttgaatatacataaaatgcctatttgaatataacacattgcttatgggacacaaaatcttgctcaagatttctaacaataccagtttgtcagtttctaatcaaagcatgagtactgttttcctatggttttctttgctgatcaatagtcccaagaactcaaagaaagacaaaaatcagagcaaacttcgaaagagatgttttggtcttatttgagcgctccaaaatatactaaactgagcaatatctgtgcctaatggatctttgaacactgaggaggagttcttgggcaggactttaagagtacctggaatgaatggagactgatgttccacaggtgcctcagactcccagtcataatctaaactctttatcagcagtatttctgcaaaacaaacctgtttttacttttgtcttccctagcattgcctagtctctcaaggtagaatcctcaacgttatctttgactcctcttccttccaacctctatccccaaattattggttaccacttacttctgtctcaaatgtctgtcgctccctcctccttccttagccttatcacttagccttatcccttcatcccgtccctactgggataactgcttcctaattggtgtccttgcccctgctgtccacctttccttctaaacttttccttttcactgtctctcaggtaatctttctaaaacataaatctgatgatgtcagtctgcttcttaaaaattgcaactatttcccattacctaccagctaaagtcttcacagtgccacatagtgcttcctgatgggcttcagccctctttgctggcctcgttattttcttgcacgccccacatacccactgtgctacagcttttacttttcccaagttcacaccatgaacttgttctcacacccctttgctcatctttcctgtctcacagtccctctgtctagtaaaatcctacccattcattcatcataaacattttattcattcgacaaatatgatttcctaatgaggaccagaaactgtaggagactcagatcagtctacatatgcctactttgtgaactttccccaatatatttcctacagcactttcttcatttgactaataaagttcatcttagcatgcagcacactgaaaggcacttaaatgtttgttcacactaaaaacagttgtttatgaattatgttcttgacacacttcacttaatcctcacaagtaccaaataaggtagttattattaccctcattttatagatgagaaaattgatgttctgggaggttacaagtcttgcctgaaaccacacaaagtagcagaattatgatttctgatttgtccaactctttctgtcaactactgctgctaattatttgtatcatagtaagcacttcataaatctgtctttgcaactagattgtaagcttctcaagggcagccactagtctttatcattgtactctcaatgcctgctccagtgcttaataatgtttattgaatgaatgaatgatagcatgatttctgggttccacttaaatttgacaaatgagaaaatctcaataatatctcagtctctaggcatccttcagaatgattcatcaagccattgattcagcctcatgggctgggacattagccctatcattaacttacctatcttccctgagtagaattttttaaagttttgtgaaaaataatgatttttaaaaataaaatcatatttaatttttaaatatcactgttataattacgtagaatcattcaaattgccagagaacctctgcaaaatcacacatcagagccaccaatactaatgaccatgtgcttccctgaagaaactggatgatgtctataatctaatgaaataaaagggacaagctggaaaatctgcctctgccaattacttaccagtttcatggttatataaagggctcaatcagacctacaatcaagtcttttgtaaatgccaaattcactggtgggtgaggatgagagcaaatgttttaattcaggctttttacaaccattagtaatgaactatgattgaaataagttccattgttacagtaactcaaaatcatgcaaaaataataattttagttcttttatgagaggaaggcagaatatattagcatttaatctgcctgaaaataacagtgactcaccagaactatctagatagcagtcagtcattcagtcaacaacatttaaggcctactgcatgaagccttgttagcaagaggtaaaactggttggtggtgggggttcagctacattggaatattataaattcctccatctttttttttttttttttttactcttttggtgatggttgctttttttttttttttttccccaggaagcaccaactaataagcttctctatgccaaggatatcccaacctacaaagaagaagtaaaatcttattacaaagcaatcagggatttgcctccattgtcatcctcagaaatggaagaatttttaactcaggaatctaaggtatcattagaaagcagaaataagcttatatttggttactttacgtcatttcagaatctctcaacaagtctttcttttagaaacatgaaaatgaatttaatgaagaagtggccttgacagaaatttacaaatacatcgtaaaatattttgatgaggtaagattttaaataacattgtttttaacctttgaatcaggcacaaggatgtggttatagcattctgtcagtttcagaacagctctggcatcccaaaaggccagaaagggaagccaggaagcctgtctgagatgggggatcctggcactgagccagaccctgtacatggctgccccccttacagttttatcatgctgcccacatttggaccagcctgaatttacatttgagttcatggggcctacagccaccctgactcaagttaactttgatgagtaagtagtggccctattaaatggggtcagcttatgcttgattgtaatttgctaaaaatgaaagctaagcttgttaaattgcctagattctgtattcaatcgttatatgaaattatgacatatttctaacttaagcgactatttcaataaaccattctcctttatgattaattctccttaatctgggtttttttctttggaaattcaaacagacacattcatcagatgctttgtttccaaacaaatgttaactcccccttccctgattcccccccaatcatgctgggacaggctatccatgtcaatggtgagaatagctcaccaattccatttgctacttgaagatgaagtgaagctctaaggtagggtagaggcaatgagttcttaaacatgataagcatccctcgttccaggggtcaggggagagaagggaagcacgaggagggactacactgcccagatgggagggaagggaaggatctgtctctgaccaggatgtccctgcctgctgcatttaaggagaaatacttgcctgcatgttggctgcccaggaatgcttgctgtgcttggaatggctgtgacataatgcataaagcagggcctaggaagcctggccccatatttgtaagcaaatagttggtatttcttgcgagcttctattttaagccaaggtattgttgatcctgtgataaggacttagcaaaacaacttgcaaagtgagtatgtaaatgatggaagaaaatgttggcatctgtttcatacagattttaccactcacagcatcaggtatgcaaaaaacagaattgtaacgctaaaaccacaatatctaaaataactgttctaattgtcaacagattctaaataaactagaaagagaacgagggctggaagaagctcagaaacaactcttgcatgtaaaagtcttatttgatgaaaagaagaaatgcaagtggatgtaagcactctggggcctggcttaatctggcaaagttcttcagacgacttgggagcaaaatggctgcttgagctactctgtgtcgttaatttgttgtttgcacataggttccactttgggcactgtctttttaagagaccaaggcacatgcacagcttttagaaagcataccaacccttgtgcctgtgtgtataccgtgggaacccttctgtaaatagagttgaagtggttgttgcaaacagcctccttgtttacagagaatacaaggccagtaagcgaatgtcagtattgtaactacagtctccacttaagcacaatgatataagtggttttgtttgaaaactacagctatgtagcacttgtgctacactgcacctctgcattgtaaagggatactgccagtgctcaaaacaaaatgtgaaatgagtcatttggaaacaaggtgggggtgttagggcaacctcgaggatttgcagcattgaaactttccccagtagttcttggaaaagctgaccgcagaatttggtagtgtacacttagcatttgtgagtgtgtgtgtgtgtttaaaccaaaaactaacagtgttgcaacattgttgaaagggctcgtgtttttcagtggtcatcaactgcactccatcaaactcacctccatttcaccaaggagctctaaagtaaggagagtgggctttatttaaatgaacagcattttaaccagatactttgtcctaatgtatgttccttttcttcatctgttttttcatactaaatgtatttgatagtggacatgttggatattatacaaaaaaatcattaattcatttctgttccaaaacctttgatcagaacgatctgtggaagagtaactccatttctatatgagtgagtgtctccttgctttagatttctggtgaaccctgtggttatgaatacttgtgtgtgatttaaaaaaaaaaagatacattttacattttatcgaattgctgttcacactggagtattatatataaatatatatatttgaggcccaaggcctgaaaaatattagtatacaacttggtatcttagtcttactatgtactttttgaaagtattcctcgcaggagaaagaatttaaaatacccattttattcatgcctttctttttaaagaattctctatccagttatactgtagtctttttagtgctgattttttaattcctgaatttttgctgctcatgaccagttttaataccactgtgttttccttctattaaaccagaagaagtaaacagcataattggcaactcttgagcttttcttgtggcaggcaccttttacccttggtgctccaaatcccccatctaggaaagaaaattttttcaagtcaaataacattgatcacatattccttgaaatcatttaccaacactgtatggagcattaggatttaaatatgaatttgtcttaaaggcaattcctttttgcttctgtattatctggaaaagcatgagagaggtgacacctcaacaaactgatcagagaaaataagcagttactaccctgataggcaccttcccaatcctgttgcttttgaccattgtctgtccaacggacacacctcaaacaaacaaaactaccaaatagatgacagatcagaataaaggtgagaggtctggtccccattgaaggctgctacagtcttcaaagaggtgaaggagttcataagagaacaacagtaggaaagttgagagccaagggtaggagagttgcccaaaagacttcccctactactttagggtactgaaaactcaaaggatcagctacagctttatctaagtatttactaaatgctacatgagggtgtccctgtccagctttctggcacatgagtcctgtgtggagagttacctcctcttccagggactgtgctgttgggaactttgggcaagtcacttacctctttgtgcctcaatttctgtataatatttctaagctacctcactgaggtggtatgaagattcactaatgtatgtagcgtgtttgtcaatcctccagtgaaaagcactatctagatcacattttggatcacattagccaaatgcagtaaatggccaaattagatgtgtgctgaagacaatcagtcactgggtctatattaaacagcaaccagagcaacaaatggcaaacaatttctattttcaagtttctttgcatatttttttggtgcaaaaccatttataaacttttttttctaacactagtgtctacagcagcattcaaaaaaattctgttaccttttctgtattaggatttaaagtctatttcttattgtatacctgattgaagctgttcttggagatgaatgttttaaatgtctatatccaaaaaataaacattttgatgtaactgtg

SEQ ID NO: 323 - DNA, 151709 bp, Homo sapiens
  source 1..151709: mol_type = genomic DNA
ttaaaaaaaaattaagctctttaattatgtgcacacagattttagaaaaggtagccttttgtatatagatacctttacattctttaggctgacttttaaattgtcatcttttttcaactacagtttttgtatatagtaaaccagaagatgtgtatggaccctgttatggccaagcatctcaaagatgaagagagaattaatgatagttatatttcactcaaaatgccaaaaaaaaaaattcaacaaagtaaaaattttaaaacttgactctaactagttcctttttgttttacattctcaaaccattgtcaaatattctaaatatctctgagaatttctcttttaatgcttcacttgtataatcttaaaatcctgacagtcatacaatacagcatgtagtaggtaccttttcttgaggcacattcaagtgttttggcaaacagtaaaaagtatctaaatgccacaggttaaaatgtcaagttttactgagtcaccaacttcacctcttttgatctgcctgttctccaagaacatcattctccggaagatccaagttcctctagttgttttctttgtgttgtttccagttcttctagtcttttgcgaagtagagagagttccctttgatgttgttcctccttaaaatgatgtagagaaagcatagcaaaagaaactattagaaaaactgttaggtagcaaccttggactgcctcttttatatatgcctataacatctggcaaggaaatgctgaccactgtagcagtctaaaaacagtagcatgggctaaactaccatctagttttgcttctctcctgcctcaggctctagccttaagcaaaacccgtagtctgttcttctctaggtataaaattcaccagggagtgaattagaaaatactaatgcagggcccaggtatacttacatggtaactttccaacaacactggtgtttaacagcagtttattataaacaaagcacttggcctgagattcaattcagtgattaaaatcttctgtgcttatgttataaaacataattacttattaatactcccatcttctgaaaaagaatcaatctgattccttcaatacctcaggggcttgatacaatagaaagagcccgggttttggattcaacaggtttaggtttgaaactttgtcacttattagctatgaccttatgcaagtcacttcactctgaatcagtttccttatctatgaattaggaatagtaatatctgccctcaaagcatttttcgttagtattagacattgcacggaacatgcacagttcactgcgttagtaaattctcagtagtaattactattaacattatgaataagctacaaactctaggttactcaatgactcaatcaagtttcctcttttctatcgtccagtaagagatttcactctcagcaccaacactaaaggatcatgattcaaactgaattcagcaaatttctatgctaaatgaaagggaagaagttaaaagtagttttaaatgtttatgccatttttgtggtgaattttgagcactgaccaaagttataatttgagttttatcaccatatttaaacataaaaacctacaaaaatgtacgactttttttttccccctaaaataaatgctcatacctgcatatgaggaggaaatggtagttccatgcttggaaccatggctgatgactgaaagctaacaggattgatagatgctgttggaggcatgttaggaaccaaaattagacttcgaaattcattatgtcttctctgtatatcttttagtcttttttgaagccttgtatagtcttcaaaaggaacattttgtcttaaaaagaaaaagaaatgtttctttaacatggttataccctattgaagcacagtatgattcacagaatataattttaaactggaatttctaaattatgagatctatatataatatatagataaaaaatctgtttacctagaaagataaacagaaacatgacataacatcttaatcattagcaatcattagcattgcagactatcaactcattataaagttttatttgctaattaaagatctaaaatcttttgatactttggtactcactcctaccctcctactcacccccattcatgaatcctgaaactaaagggagactctaaaccaaaagagtgccttatcttacagaaagaatcaaataaaaatacagttcatccctcagtatacacatgggattagttccaggacatccctcatatatcaaagcctgtgcatacaagtcctgcagtcagccctgcagaaccctcataatggaaaagttggttctctgaactggtgggtttcacatcctgtgaatactatattttctatccatgtttgcccgaataaaaatctgtatataagtagacccatgcagttcaagcccatgttgtcaagggtcaagtgtaaagaaaatgctggattgaagcttacaaaattgccatttttaaataggtgaaatatggtcaaatatagagattttcatagttcaatctaattttcaaaatgtcagtgtaatattttagtaagaaatatatatttggtctttgcccttggttcctggcacacagctcctaaaactctgggaaactctgaagtgataagagtatcttttgtatattaataagataactggtggctgggggcccctgaatagcttcaggatggggcaggtcaccagaaagactgaggcatgattagagggttggaactttcagccccactctccaaccccaccccatgacatctgggaaggtaaaggactaaaggttgagttgatcaccaatggccaatgatgtaatcaatcatgcctatgtaatgaagcctccataaaaacccaaaagcatggggtcagagagcttctgggttgctgaacatgtgcaggtgtctgcagggaggcatgcccagagagggcatggaaactccacacccccttcctcataacttttcctatgtatctctttcatctgactgctcatctatatattttgtaatatcctttctagtaagctggttaacataagtttccctgagttctgtaagctgctctagcaaattaactgaacatgatgagcaggtcatgggaaccccaatttatggccatttttagccagtcagaagcacgggttacaacttggggcttatggctgcattctgaagtggggggcagtcttgtgggactgagccctctacctgtgggatctgatgctaaatccaggtagacaggatcagacctgaattacaggacacctagctcgtgtccactggaaaactgattactccatgtataggaaaaaaccccaaacatctggtgtcagaaatgttgtgttgactgtgtgagaataggaaaaacactggtttttcctattataaaaggtaatcacaaaggtgaagctacacaactttaggaaaaaatgacatggagaaaaaggctaactttccaggccttcacagatcatcatctttttggacacgacatccagtaatcaaatataatttcaaaatcactcaaaattctagatgatctgcaccacaactggccaatcttgaattgctaacatttcaatattaatgtttatggaagaggaagtaagttgaattctgttttagaaggactgagccaggaatggtggctcatgcttgtaatcccagtgctttgggaggctgaggcaggagaatagattaagcctaggggttcgaggctacagttagctatgatcgtgccactgcactccaccctgaaccatagacgaagaccccatgtttaaaaaaaaaaagaattgaaacaaaattcaaaattacaagcatgtttgtaatttacaaattactaccaaattaataaactaaaggcggcctcctactttggaatagagtattgtaaggctggcactaattctacagtctagaaacttctagaatgttctttaaaaaacaattgttcacctgttggtaataattgcacccaagaacaccagtgcacatcataaaacgtcactgcatgatattataggcagtttccattacagaaaaatctatacttgaatagccaaggcgctgaaggctaccactaattcactaaattaaaaagatttttcttaacttgaatcaaatgtgtcatataatgccactaccaacaacttaatatgacaaatctctgctttaaaaatgctgatgatcctgattatcagatgtgcttgaatgtgactgcaaaacccgaaactacagctcaataaaatctccacaccaggaaaccaaaactgacctttgattcaaagttgtaggcacaattttcagaactatgcaatagctacaactgtcttgtacagcagcaacaactaacaccactccttgctaccaaagccagtgacattttctgttagtcccaatcataaggcaaacacctggtatgtgacagagaccttttggtttaaagaaacattcagttagggggtaaaaaaaggatagtacattaggagttatcaagctgttttagaaatctttaaaatgtatattttaaaagaaaagaaggtacgttatacttagagacaaagttctatgacatcaaaataaccacatggggaagatacacatacaaacacattacctatttaagacctgattttctgtttccaattcttctttctttgcctccaagacttctactttctcttgtagtcttttcaatttgttttcatgaagagattttctctaaaaagagaaatatgaacaagtatgttaatacataatctcttatttgaacaaaactatatagaaaatattttactcaccaaaaactgtgtttagatatgaatgttttcagtgaatactagaaacaaaggttagtagacatggctcttactgaaaattgcaaagataataaaccacaaatctatctaatattctcaatgtgacaattaattatgaatgccaaacaaaaaaactgttatcaataattgctgcaaaaaaaaaatctacaaagggaaggagtcaaattttactactgagtctgcctgtacatctggtaagaaataatgagctctccattgttccagaagatagcatgtgtttaagagaactgagccaggtacagtggctcatgcctgtaatcccagtgctttgggaggctgaggcaggaggatggattaagcctaggagttcaaggctacagttagctatgactgtgccactccaccctggacaacagatcaagaacccattaaaaaaaaaaaaaaaaaaaaagggtggggagccaggcacagtggctcacgcctataatcccagcactttgggaggccgaggcggacagatcacaaggtcaagagattgagaccatcctgaccaacatggtaaaaccccatctctactaaaaatataaaaattagctgggcgtggtggcgggtgcctgtagttccagctactcaggaggctgaggcaggagaatcacttgaacctgggaggcggaggttgcagtgagccgagattgcaccactgcactccagcctggcaaaaaagcaagactctgtctcaaaaaaggaaaagaaaagaactgaagtaaaattcaaaattacaagcacgtttgtaagttataaagtactaccaaattaataaaactgaaggatcagaaagctaagataaatatggatgcatctgtttaaaagttgcctttctaaatcttaaaaggaaaaaatttaaactttacaatatacaaagggagaaattcctaagtaaatcttgtatggtttcattaaacaatacggaaaagtccaggtaaaatgcaaaaggagtgtatggaaaaaagtagtattttttttcagtttttatacacaggccttttgttttttaatagaaaaacacctaaaatgttaaaactcatttagtcgctacaaaccttttaggtattttctaactcttttttaactgaagtataatcttacagcaaaatgcatagaatagaaacgtaaagctcaaagaaaaaccacaaaacaaatgctggcatgatttccttgtaggtcaagagcactgccatgccagaagggcccctacctttcccccttccaatcactagccctgtcatcctctgaaagggtaaccaactaatttacttccaaaactatagtttacttttgcctatttttgaacctcatatacatacaatcatagtatgtagtcttttattaatgactttatttcactcaacattgttagtgagatttatgttacttacagatatacttcattcattcccacatattatattccacttacgattattgcataacctagtatattcactcagtacaccgttaagggttatctgcattatttccagttgggactattacaaataactctgctacgagcattcattctcatgctttgattgtcccacatcctccaacatctcagaaggcttccttatgctcctgtctaccctggcaaaggaaccactcttctggtttttatcaccataagtatttatttatgaatttataggcagttaaggagtccatctgtctatccatccacccattcatatgaaagaaatcataaatttatgctcttttgtatctggacttttttctcaacattttatctatatgactaagccatggttatgtattgtcacagtacttctttttcattgcaatgttgtcattcattgtacaaatataccacattttatacattttcctgttaatgaaaatttaaattctttccagtctggggatatcataaatattttacgaacattcctaaacatgtttttcgcagattaagtacctcattctcttcagtatatacctatgaatgggtcatagtgtatacatgttttagctttagtagatactgccagttttctaaagcagttttaccaattacatttccaccagcaatatgtgagagttctagctgttctacatttttgccagtacttggtatggtcggtcttttagcttttgcatcctgttttggtgaaatacagtatctcactgtagttttaatttacattttcctgatagctaaaggtattgagcatctttttttatgcatgttagtcatctggatatcccttctttgtgacgtgtccatcctagtcttttgtccattaaaacttttgagtaacctgattcctactgatttgtagttctttatatattcaagatatgaatcgtatgtcagatatatatgtattgcagattgaccttctccagcctgtggtgtcattttcttttgcttaagagtatcccttaataaaaagattttaatttaaataaaatcaattacatcaatcatgtattttatagtaggaactttttgcatcctgcttatctttattatcccaagatcctaaaattttctcccaagttttcatctagaagctttattttttttttttacctatcacacttaggtgtatggttcatttttatctatgttgtgaggttaggctgagtttaatctattgactcactactatttgaaggaacatcctttatcgaaatgcagtggtacctttagtgtaaacctatttctggactctatactgttccatttgcctgtttatccttatgccaataccacactgaattactgtagcttatatttagtgttgatacctggtagttttaagtcctctagttttattgttcttcaagattgctttgggtattctagtcctttgtactttcagatgaattttagaatctactttctaatttctacaaagaaacctgctgagattttgattagaactgcattcaacttatggataaatttgggaagaactgacaccttaatattgaatcttccaagtcatgaacatggtacagttttccctttaggcatttttccatttttcttagcagtatttgtatttcagtgtagaagtcataaacatctttcactagatttgttcctaggtattttaggtatttttatgctattgtaaatggcatttaaatattttctaattgtgtgtgtaaagaaaaataactagtatttgttacttgacttcgtacttagaaattttaaaaattcatattaattttaatagtttgataggtttgacttttatgcatgcacagtgacatctgtgaataattttaaattcctgtctactctttatgtccatttctttattcttaaaactttttttaggctcagaggtacatgtgcaggtttgttttataggtaaatagattatttcatcacccaggtactaagcctagtacccaagttattttttctgatcctctccttcctcccatgctccagtctcaagtaggccccagtatctgttgctcccctttgtgtccatgtgttctcatcatttagctcccacttatgacaatgaaaacatgcagtattcggttttccttttttgtgttagtttgctaaggataatggcctcttgctccatccatgtacctggcaaaggacattatctcattcttttttatggctatatagtattccatggtgtatatataccgcattttctttatccaatcttccattgatgggcatttaggttgattccatgtctttgctattgtgaatagtgttgcaatgaacatatgcatgtgtctttatggcagaaagatttatattcctttgagtatatttacccagtaatgggattgctgggtccaatggtagttgtttctagctctttgaggaattaccacactgctttccacaatggttgaactaatttacactcccaccaacagtgtatcaaagtattcccttttctccacaacctcgccagaatctgctatttttttattttttaatagccattctgactggtgtaagatggtatctcattgtggttttgatttgcatttctctaatgatcagtgacattgagctttatttcatatgcttgttggtcacatgtatgtcttttgaaaatgatctgttcatttcctttgcccacttttgatggggttgtttttatcctgtaaatttaagttctttatagatgctagatagacctttgtcagatgcagatgcatagcttctaaatatcttctcccattctgtaggttatctgtctactctgttgacagtttcttttgctgtgcagaagctcttaagtttaattagaacccatttatcaacttttgcttttgtcgtgattgcttttggcatcttcatcatgaaatctttgccagttcctatgtcctgaatggtattgcctaggttgtcctccagtgtttttatagttttggattttacatttaagtctttaatccttcttgagttgacttttgcatatggtgtaaggaagaggtctagtttcaatcttctgcatatggctagctgtttatcccagcaccatttaatgaatggggtgtcctttttcccattgcttgtttttgtcagctttgttgaagatcagatgattgtagctgtgaggccttaattctggttactctattctgttccattgatttatgtgtttgtttttgtatcaatatcatgctgttttggttattgttgctctatagtatagttttaagtcaggtagcatgatgactccacgttttttgttgttgttgtttggcataggattgctgtggctatttggactcttttttggttccacatgaattttaaaagtttttttctagttccatgaagaatgccattggtagtgtgatagaaatagcactgaatcaataaattgcttttgacagtatggccattttaatgatattgattcttcctatccatgagcatggaaagttttgccatttatttgtatcatctctgatttgtctaagcagtgttttataattatcattgtagagatcattcacccacatttagctgtattcctaggtattttattttgtgcaattgtgaatgggattgcattcctgatttggctctcagcttggctgttggtgtacaggaatgctagtgatttttgtacattgagtttgtatcttgaaactttgctaaagttatcagctgaaggagctttttggattgagactatgggggtttcctaaacataaaaccatgtcgactgcaaacatgaatagtttcacttcctctcctcctacttggatgccctttatttctttctttctcttgcctaactactctggccaggacttttaatactatgttgaatgggagtggtgagagagggtataattgtcttgtgctggttttcaaagagaatgcttccatattttgcccattcagtatgatgttagctgtgggtttgtcacagatggctctcacattttgtagtatgttccttcaatacttagtttattgagtttttaatagaaagggatggtgaattttatcaaaagccttttctacatctattgagataaccatgtggtttttgtctttagtcctgtttatgtgatgaatcacatttattgatttgcacatgttgaatcaaccttgcatcccaaagataaaacctacataatcatggtagattaggtttttgatgtgctactggattcggtttgtaagcattttgttaaggatttctgcatcaatattcgtcaaagatattggcctaaagttttcattgttgtgtctctgccaggttttgttatcaggacaatgctggcttcacagaatgatttgggaaggatttcctgctcctctattttttgttaacagtttcaggagaagcagtaccagctcttctttgaacatttggtagcatgtggctgtgaatccatctggccctgggctttttttggttggcaggtatttactactgcctcaatttcagaactcattattggtctgtacaggaaatcaacttcttcctggttctatcttgggaaggtgtatgtgtccagaaatttatctgtctcttctagctttgttagtttgtatgcagaaaggtgtttatagttgtctgtgacggttgtttgtatttctgtggggtcagtggtaacatcccctctgtcatttctaattgtgtttatttggatcttctcatttttcttcattaggctaactagtggcctaacaattttttcaaaaacgcaactcccgtattagttaatcttttgaatggctgttcatgttttgatctccttctgttcagctctaatgctagctttgggttggttttctcttggtcctctcattgttttagttgtgctgctaggttgctgatatcttttttaactgtttgatgtgggcatttggtgctataaatttccctcataacattgccttagctgtgtcccagagattctggtatgttgtatcttttttctcttagtttcaaataacttctcgatttctgccttaatttcattctttactcaaaagtcattcaggagcaggttaacttccatgtaaatggttttgagcaattatatttttagtcttgatttcaatttttattgtgctgtgtgtttggtatttcagttcttttgcatttgctgaggattgttttatgtctgattgtgtggtcaatttcagagtatgtgccatgcagcaatgagaagaatgtatattcctgttgtttttggatgtagagttctgtagaggtctatcagatctatctggtccaatgttaagttcacgtcctgaatatctttgttaactttcttcctcaaggatttaatactgtcagtggaatgtggaagtctcccactgttattgtgtgggagtataaatctctttgtaggtctctaagaacttgctttatgaatccgggtgctcctatgttgggtgcatatatatttaggatagttacgtcttcttattgaattgaaccctttaccattatgtaaacccgtgtcttttttgatttttgttggtttaaaatgttttgtctgaaactaggattgcaaccctggcatttttctgatttccatttgcttggcagatgttcctccatccatttattttgagcctatgggtgtcattgcatataagatgggtctcttgaagacagcatatcactgggtcttgcttttttatccagcttgccactctgtgccttttaaatgggggcacttagcccatttatattcaaggtcagtattaatatgtgtggatttgatcctgtcattgtgttgttagctggttattaggctggcttgtgtggttgctttatagtgtggctcatctgtgtacttaagtgtgtttctgtattggctggtaaccatcttttttttttaatgctctctctcagcagaatcatggtaaccatctttctatatttagtgttcctgtcaagatctcttgtgagatgggtctccatttaacaagcatttgcttatctaaaactccctcagtatttgcttatctaaaaaggatcttatttctcctttgtcgaggaaggttagtttggctggatatgaaattcttggttgaagatttttttaagaatgttgactataggtccccagtctctcctggcttgaagggctcctgctgagaagtcagctgttatcctgagggggtttcctttgtaggtgacctgccctttttctccaagtgcctttaatattctttcattttgaccttggaaaatctgatgattatgtgtcttggggattatcttcctgtgtagaattttgttctctatagttcctgttggtctctctagtgaggctgaggaagttttcttggacaatatcctgaaatatgtttcctaagttgtttgctttctccccaaccctttcagggatgccagtgatttgtagatttggtctctttacataatctcatatttcttggaggttttgttcattcttttctattcttcttttttatttttgtctgactgtcttactccaaagagccagtattcaagttctgaaattattcagcttggtctctctcttctgctgttaatacttgtgattgcattgtgacattcttgtgtttttcagctctatcagatcagttaggttcttttttatactggctatttcatctgtcagtgcctgtatcgttttattgtgattcttagattccttggattgggttttgccattctcctgaatcttgattatcttcatgcctattcatattctgaattctatttgtgtcacttcagccaactcagcctggttaagaacccttgttggagaactagtggccatttgacactccgaccatctgtgttgctagagttcttccgttgattccttctgtctgatggttccatctctgcgtgggggtgttcctttaactgctgggctgcctctgattgaagtggtcaggcaagctcagggtagttgtgctacagttccaggttgggtgaccctgcccagggaggagaagtgaggactgggacttgcatagagaacagtctggccacttttctgaggtaggtgctttgtgttgggcatccgtaccagcccctggtccccacagactctccagaacctggagacagtaagagtgagggctacaagacagcaaagatggcaacccatccctcccactaggagctctgtcccagacagtaacagagctgctactggctggatggccctggtggggatggctggagattcaggttgggaggacgtgctcagtgaggagatatagaatcaaggacccaaataacagtctggccacttttccatagggctgctacagtatgctgggggtccgctccaatcccttttcatcttaaattttccagtacctgaagatatcaacaaggaagtctgtgaaacagcaaagatggaggactgccttctctctgggaactctgtcccagggaggcacggacctgttgctggcagaacacactaacaggaggtggctagagacctcggttgggagatcctacctagtgaggagtaacaggatcagggacccacatacaaaagccgtctagctttttccatagggtagccatgctttgctaggggtccactccagccgctaatcacctcagactctctaaagcctgaagacaacagctaaggctgctaaacagcagaagtggtggtccacccctctctttgggagctctgttccagggaggtttgaaactgttgctagccaaaaaacactggtgcaggtggctggaaaccctggtcaaaaggtcctgtccactgaggaggaatgggattagggattcaagtaaaaaagcagtctggccactttttcatagagcagttgtgctgtgagggggtacctcgagaacagttgcttcagactctccaaatcccaaaggcaaagagataaggctgcaaaacagcaaagctggcaccctgcccctctctctgggagagccattccagggaggtttgaaactgctgctggccagaaaacactggttggggtatggttgtagacctcagtcgggagatcccacccagtgaggagaaatgagatccaggagccacatgaggaagcagcctgaccacttctccttagagctgctgctctgtaccaggggatcactccagtccctaaccaactcagactccctagagcccaaaggcaacaatggctaagaatgtgaaacatcaaagatgacagccccatccctccccctgggaactctgtcccagggtggcttggaaccactgccagctggaaaacaccaacaagggtgactagtgaccctggtcgggaggtcccccacccattgaaaagcagggtctgggacctgcataaaaaagcagtctggatgcttttccatagggtggctgcaatgaaggcaatagctaaggctacaaaacagcaaagatggcagcccacccctccctctgggagctccatctcagagaggtgtaacactgctaccagtggctggctagagttccaagccagtgggtcttatcctgcaaggtgccatggtagtggggcctgcagactgtcactgctctatcccctgtatacagcctctttcctaggggtatgtacaggggtctaacgtcctgcttggctggagttgcagttgcttttgatgggaaacctgggtatctaaagctcccagggctctacgtgtatctgagcggctgcattgctgagactccacataattctgtgtaacaggctgcagaccctggtggagtgggctcacaaggggatctcctgacctgtgggttgcaaagatccaagggagaagcgtgggtcgctggggtcactcactcactcaccacttccctgggaagaggaggctcctctggctctgtgtcactcccaagtggatgactgtcctgattgctcttctccattctttctgggtcaagttgttttcttgatgaatcccaatgcgtgtacctggatgcttcagttgaaggtgctgtatttacttactccttctatttctctccatgaaagtggcacacaccagctgcttctagttggccatcttgaccagcctccccctccatttctttttcttgccttattacactaactagaacctccgataaaatattaaacaaaatggtgatagtagacatctgttcctgaccttgggtaagtaaggggaagcagtcaatatttttaatcagtaagtatgatgttagctgcagaatttttatagataccatttataagattgaaaattcccttctgttcccagtttggcaaaagtttttatcatgaatgggtactgaatgttgtcaaattatgtttcacactagagatcacaatagttttccttctttgttctgttagggtgttgaattacactgaacaattttgcatgttaagccacctatattcccagaataaaacctaaatgctcatgctatattatcatttttctatatcactaaattcagtttgctaatatttaagatttttacatgtttataatgcaatttttcttatattgattctatcaggttctaatctcataagtggagatgtgtttcctccttttctatcatctggaagagtttgcgttaagattagtattaattcttccttaagtatttggaataatttaccagtgaagccaaatgaggcatttctttgtggaaggtttttaactaaagatttcatttcattaatagatacaggactatccaaatgacctaattcttcttgtattaggtttaagatgttcttaaagaaatgtattcatttattctaaattgcatgattaattagcataatagtttttatactattccttttgttttaatatctatatgcagatagttaatatctatagatagatatcccttttttcattcactacattgttcatttgtggctctaatctcatctcatctactttgtggggagtctgaggacaatcagtcttgccaaggctttatcaatttcgtaatctttttaaaaccaactcttggcatttctattttcctcactgtacatcttctgtctctgtcactgatttgtgctcatctcttgatgatggtgatgttgtttgctattaaatctatccattgagttaattattgttattgtatttttttagttctaaactcatcttttttagtgctgatctgtaacctggacaactaaaacatggtttccctgactcctattctgcccctctacacaacagccagagattcttcaaaaatgtaattcagatatcacttctcaattcaaaaacctccagtgtgttcctaccttaactgagaataaaagctgaagtcatggcataaatttggcctcctactatacctctttctattctagctccctgggcctcctgtgttccctcaacataccaagcagattcctgcctctcttgtacttgctattccctctggaacacccttaccttacatataacaacatggcatcctccctcctttccttcagtctctgctcaaatgttaccttaccagagaagccttgcctgaccacctacataaaacagcaccccctactcctgtcaattttctctcccttttttttttttgagatggagtcttgctgtgctgcccaggctggaatgtgctgccaccatctccgctcactgcaacctctgcctccagggttcaagcaattctccctgccttagccccctgactagctgggattacaggcacccgccaccatgcccggctaatttttgtagttttagtagagatggggtttccccatgttggccaggctggtctcaaactcctgacctcaggtgatctgtccgccttggcctcccaaagtgctgggattacaggcgtgagtcaccgcacccagcctactcctgtcaattttcctcttagtactcacctccacctgatagtatttctttctttattctatgtctcctaacaaactacaatgtaaactccatggtgcagggtctttgtttacttctgtattccagtgaatgagtaagtacctgatacataatagatgcttaacagatatgttgagtaaattggataaatgaatacagataaacctcgtagggaagacagtctgaccaaggatgttagtaataggaatgaaaagaaatatggggtgggggaaaatttgagaggcatcataaaggaagaattcataggctttatgagttcttattttaggttgaataatgtctcccaaaaattcatgggcacccagaatgtgactgtggtataagaagaaatatatttggtctttgtacccagatcctggtacaaagctgctaagacctatggaattgtataagtgataggagtggtttttgtataattcttagcaagtccccttcaatcatacctgagttgatgttaatgaggtaacttagagttgaggtccctagatagcctaaggatgggggctggtcaccagaaagaccaagtgattagatggtgaatgctttcaggttcactcccctgacccgtaagaaggggagggggctggaaactcttcaacaatgagattttgagagcttccgggctggtgaccacattgacttgctgggagggtggctcacacagagagggcatggaggctctgcaccacaatccccgacccccaacaccttgcccaatgcatttctcccatttggctattcctgacttttatcctttacaataaactggtaaatatagtgttttcctgaattttgtgagccattctagcaaattatcaaactggaggagggggtcatgggaacccctaagttagtcagtcagaatataggtgactcagacttgcaactggtgtctgcagttggggcagtcttgtgggactgagccgtttaacttgtgggatctgactctaactccaggtagatagtttcagaattgaatttttggacacctggttggtatccagagaacaaagaaatgattgctggtattggaaaacaccctagagtaaccttatttggaaatagggtctacaaatgtaatcaagttaagatgaagttagattggattcgagtgggccctaaatccactatgactggtgtccttacataacaggagtgaaatctggacacagagctacagatacacagggagaccatcatgtaaagacaaggcagagaccagagtgatgtgcctgtctaaaacccaagaactccaaggattaccagcaactaccagaagctacacaaggggcatgaaaaaagatcctcctccagagccttttgaagaaggatgctcctgctggcactctgactgtagatttctaggctccagaactgtgagagaataagcttttgttgttttaagccacaaggtttgtggtaatttgtcatagcagccctaggaaactaatatagtgcctgactaaatttggagataaggcagacctcaggatgaatcacaggtttgaagcctaagtgactggaagaataacttctactgaaagaaatgcaaagtccagaggtaaaattagtggaaaggaatgattctaatttttacttgagtggtccaacacaatcacaggatagtcaaatcgatgccttagtgttataaacaatatgacacaaaggactaatagaacaattaaaacaatatagatataagaattaaggctgggattccccttttaccaccctctagtcaaatccaattaactttttttcaatgatcatgttaatgaccatttatctttgataactttctttacctttggttcccataacatcacaatatagcttctacctctgttcaccaccacacctagctcctcgttctaagtaaacttagtattcttcagtgatctgcaaaatcctgagtttctaattatatttctctaatttgaattattcatctctgtacttcacattctattatttctagttacctatataatatctttacttaagagtctacgtcatgtctacatggatgcactgccatcatttcctatctgacatgtgttttttatctttctactcaactgacattcttcaatccattatcataactccacttacatcttctcacagctaaaatacttcatagttttctttcttatttaccaatatattctgcaattattttttcctttggaatacctctggcagtcacgctttaccttcattcctatattccaagccccaattctagacttcttacctcactttaagtttactataacagcttcctaactggtctccttgtcttcagacttttgtctgtctagcacagtggttctcaaactttagagtccacataaatcacccaggagtgactagtgggattatttaggtgtttcttgcatgttatcttatttctccagcaagattatatagttatcaaagccaaggagtaatcatggcttctatttctccccagtgtatagtgtaatctaggccacacaacatattcaatcagatattttgcaacttcaagactatgattcatctcttttttgaaaacattcataatagtatctgaccaagaattatttcagagacgtataccttagaataaaattaacaagttgtcatttcaggttcctcaagaaaaaagaaaaaaacccaactcactgtgttcacttcaagagatctctcttcaatgggggtggggggaatacactctctctgtatgtatcagtcacagaagggcatcccaactcaagatcctgttcaagcttttccaaacaaatcaacacaacaaaacatcatttacaccaaagactacttaaaaacagcagaaatgacaatctctgtgctcaggagcttggagctctgagtaaacacagacggcagcgagccatcttacccagcctcagggaaaaaagaacttttcacaggaaagcaactccaaaggattatttctgcactgggttcataatttgtgacttttgttacatcttacggcaaaaaatgctatgacttttggcattaaagaatctaagaagtctgttgcactcttatgaattatatttatgtaatctgatagccaaaatggtcaaatagaagcattatctttaacttgaatgggaaaagggtatgagttaaattaatttacagtgattattctgacataagaaacgactcatatggaccatagctatattaagcgaaaagttgtaaagtatttggaatcaaggaaagtaggaaattaaagcctaacagcgcagtggaaagagcaccagactgagaacagaaacatgtagattttagtcaacttttgattcttactagttaagtaatcttgggtacctcctactttaggttgctaacttgtaaaagctatttgaatgctaagatcccttccagtcctaaaattatacatacttatatactttttaattgtatttctaagttacacatgatgtttttctattttaattgatgtaaacttgtaagctcctagggcagtgtcccacatagtaggacaattctaggtcataatcattcactgaattgaccttaacaatttcactatgacttaaatcacaatccatagatcacattttaaaaagtaaaatgactatctactatcttcacactcatcatctggtagacatttcagtagaaaaaaaaattcatcctgtcacaatactaatgaaatgttactttgtagtgttttggggtttttttgtttaattattatttttttttgagatagggtcttgctgtgtcatccaggctggagggcagtggtgccatcacagctctttgcaatcttgaactcctgggctcaagcaatcctcccacctcagccttccaagtagctgggactacaagcatgtgccaccatgcacagttttttcatgttttatagagatggggtctggctatattttgtagatttttaaaaatataacctcctccactccttctggtatacttatgattagctgataatctcaccactgggtgtcacttttgcttcaaaagaattcaacccaaactaaccttaataattagaatttgatctgtaagatacttattcctaaagcctcaaaatttagctcttaaaatttcttgctgtaacacggcttcagatgtttctaggcttcaaacacagtgcaaacaaaaatcagtaggatttctgagttcataggtcataaaacaatcctctgaaatcccattaatattcatacacttttcagtacctacatcgacagaaaggaagaaaagtgacatatacagaaaaacaaacaagtgtgcatatttgggtataaaacactgggatccctatataataaatgctgtttttccaataatactacttctagcattatgagaagataaaagtaatattcagagaccaagaaagtagagaaggaatgacttttagactactcatgttgtcactccaaccatcagcaacatttggcagtgatatccaattacataaaaaggggtctaggaactgctgtgtggttttcaaattcagaataactgaacgatctacagttattttctcttatccaaatataaacagttaacctttccaataaacagatattaagataatggttcctgcacctagaagcattttcctctcacctcagatcttctctcctctccacaacaaatgctactattaggggaatttatcaaatgaagacaactcaaatcatttgtgggactttacatataacacgcacacacacacacacacactttatcatgtccctcctcttcctctaatcctgttgaaaagattaccatgtccttcccctcccttaatcaccaccataagtcatggttactaatgggacctgttatattattcttgggtttgctgaaatagaaaaaagttgtaagtcactgatttagaagatccatctagatacattatttccatgatgccctggattgtttccaagaaaacaaagttaggttctggagaaaagtatgcctgcaaaggtaaaacttaaaaaggatcacaatgctgtgggaactcctgtggcagtttcagaaaccaagggagtcccatttcctcctgctggagcaaagaaatacttgctcttgtatttctgaattggaaacaaaaaagccttttaaccacaaaagcaataaaacagatattaggtataaatgaaacaagcttaatcacactataatttaactggagaatgtgttaaatatgacttccatgggatggcctggaaactatcactctgaaaaacaccttctgtatggaaaaatgcatgtcagctcaaaacaactgacttacatacaaaatttagaaacaaacctgctggacagtttggattttcccaatttatttctgcaaggttgacagcaaaatgtcatgcttatatatcaaattaaacatatcactaaaatctcagattcaactatatactttattctcctataagagtttattaggatggacgcggtagctcacacctcttaatcccagcactttgggaggctgaggtgggaggatcacttgaggtcaggagtttgagaccagtctggcaaacatgggaaaccctgtctctactaaaaatacaaaaattagtcgggtgtggtggcatgtgcctataattccagctactcgaaaggctgaggtatgagaatcgcttgaacccaggggatggaggttgcagtgagccaagattgcaccactgcaatccaacctgggtgatgggagtcagactctcagaaaaaaaaaaaaaaaaaaaaaaaaaaagatttaattatattttactccatagaaatcaccttttttcctttttttttttttttttttttttttttgcgacagagtcttgctctgtcacccaggctggagtgcagtggcacgatctcggctcactataagctctgcctcccgggttcatgccattctcctgtctcagcctcccgagtagctggggctacaggcgcccgccactatgcctggctaatttttttgtattttttcagtagagatggggtttcactgtgttagccaggatggtctcaatgatctcctgacctcgtgatccacctgcctccgcctcccaaagtgctgggattacaggtgtgagccaccatgcctggccagagatcactttaataagaaccacttgcctttttctgggcaattgcagctcgctgcagtttctccttagcttgattgtacttttcttctctgtctgtgatacgctcatgaagcttatgcttttcttccaaccactgtatctgtttctcttccaatgtcctgtcagaagaatgtatgtaaaacatggaagttaaataagttcttaggattaaatagatattatcacaagtataagcaaactcactacctgtctgaccacattcttaattatccaactgcaggccctcctgtatggccacttgtttggaaatcccaccattactgagcacttcctatgaataaggcactggacttagaaaactatgtgttctttacaaaaatcctgagttaggtatttctgtcacctttatacttctgtccattttataaatgaggaaactgaggattagagcagttaacgaacttaagggctcacatctagttaatggcaagacaaacacttgataaccagatgtgaagtataataaccatcaaactacaaatatctgtcctcataaatttggtttaagaaaatcaagcctggtatcaaatcttaatgcagtatgtcttctgactagagtaaaatgcatataaatgatatcttaaaataacatcataacaacttatatttttaaagctattctgcatactttatatgatttttttagtattcttactataggcagtactaatgaaaataacaaaccctgagaagttagattacttgcctaaggtcatacaagattttaagtatcttagctggaactaaaatcacattccattgacccttagttcagctattttcttctatgaaattctatgaatattatttagaaaccaatgattaattacttaaatttgctagctatactgtcattagaattattaagctcatttcaatcaaacacttgagaaatccaagcacatgtttctgttttttacaaaataaaagaaaaataagttggatcaactgaaatgtcacatgctatggacatttatcttgcttacttccttttcttgaaattcaaccccatataaaaaagcatggacaaacctttgaatatgtaataatagaaaaactgaagaaatacagttttatgtggcatggtggccttcagaagaagaaatttgaaaagaataatgttttgtagattaaaataaaaacttacttacaaggccaacatgttataaagacaaagcaaatacaaaatagtacagtgttctaccacatctaaacaaatttttccagaggatataagatcttgaacatcaccacaatcattttatccctaccagttttactccatactgtctactagtaacaaattttaagaccaaaaaaaaaaaaaaaaaaaacaaataaattagcttttcaaagaaaatccaagatagttctaattcaaggaattaagttttgcacatcaaaaacaaaacaaaaaacccattctgttctctggcattcagaagaatagatttttgaagaaatgttttggtttaatcaatgaataaaaaaagttttctttgaggtttttcagaatactatactgtcagaattttaatgtcttaatttttttaaaaacaattcaagagtcagtatagttcattctataaaaacataaagtacattattacctcagtagaccattgtacactattaaagtgtatttgtaactagtttctaaaatataatcaacattggaatcattactaaaataagtacatgttatatagaaaaaagaaaaaatagtttgtacataaagagcaaactctacttttcagcttctagttgcgctttttcagcttggcttctaaaatttcggcattcttgttttaatctctccaccatttccttcagcatttggtttgaattcagcaagtcattctctgactgtgcaagtgaagtcacttggatctgcaaactactgatttgcttaaaagagaagaaagaagataaattaaagcccactaaataaatgcggtaaggtatgagagaagcagaagatactaagcatctccctttgcaaatgctccctcaagctggtgtgtccttggagatgacccctaaaggaaataacaaatagcagcacccaggagcatttcttattataatcagagactatcaagaactatattcctcagtcactgagtcccctccctcttctttccaaaatatgcaggccaggagaggtattgggaatggagagaagggttatcagggggattagcagtgagatgagaaaagggaatccagtgattagagtgagtctcctaccactctagccttctcctcacctcctaggaaaaaaaactgattttaaaagcaagtcagctgggaaagcagctaaaaaaaaaaatccatcctcctcttcccacataccctgagatcagcaaccttccagaagttctactctccgagcaatcaaaattgttcagtgtaaatgtgggaaggatcactcctcacattgtttttaaaaggtttccaaaccttctgtatgtccagtgctgggcagaagaaagatgctctgggaaatctaataaatgctatagattccttggcctctacagccatttaccaaactacataatgtcactcacagcttttttttccatcccaatttacctttatctgggagtactttttctcataagaagtctagttacagattaacaggctagaaagattcacactcttctaaattatatccaaatctctttatttgggacagttacacatacctcccccacaagctattttaccaattagtaaacaataaaagtccttattttcctttcacttccttttatctctcttagccattttctgaagacatttcaaagcaaagacagtcaagagacagggatcaaaagaacctattatgagattcaagggtaaaaagaaacaagattcttatataataaacaaaataaatgggtaataatctcattacttcctaatggtaacaaaacaattcagataggattctgaaggtccacagagcaatttttagcagaataaaactaaacggtatgtctcagatttctattttagaataaatttatccatgtagaactattcactctttatttttaactggagtggcaaatattaaatctgtattacagctgcttgaataagcaaccttcaaagagcttaatacctctccatatgcatagcatgacagaaagcccaaatgccaatgatactaaataacttctgagtatcaaacgttatgtccatctagttaagacttagaaaccataactgcacatgaaaagcagtaccaactcgcatatgagcatgaattctaaaaatggaatcctacttcataatttatagggaaaaaaacaacaacaaaaaagaaaatagaattcagaaaagatcactcttccatgttttacccaactttatacaaatctttcctgaacccaaataactttaattataaacacaaatttccttccataaatacaaatcttggatttcatagggatatagcaaaaaatacctcatgatataaagttacaagtcaatcacacaagtaacttaaaacctggatgatatttctattgagtttttaaaattctgaatattaaaatactgtccttataactgtaattaaaaattatcatgggccacagcatttaataaataaatatatatatcttaagaataatagcagttagccaaagaagcttattaaagtatagaagtttaaacattttaaaacattttatctttacatatcacctccaacaatatgttaccaattgtggttagattctaaaaatactgatggcaaaatttttttaaaatttgcaaaacataaatttaaagaagcacttgaaaaaataaaaggaaaatcttcgctaaaatcatacctgttttaggtcagaattttcatttttttccttctctgcattttcaatagtcacaatttgttgctgaagttttaacctaaaaatcacaacccaacaaaaggcattattaagaatccatgattcatttatttcactgaattaaagagtcattttattgaatgcctgtttgacaccagagcacaaacacaaccaaagattgagacttcaagaaactaggttgtgttcacgtataacaaaaatgtaaaacaaattactgctattgtgataggaaaatctacaaactaggggcatagagaggataagaaatcaagtctgtccaggggtactggggaacgctacatggataaaaacctgacaggtaggattttgatatacataaacaacagcctgaaaaagtggcctttcatggaaaattatagaatgtgttgctaaggtatcagaaagtagtctagtttaggagaggccaacttacatccatatagtattttacaatttgcaaaattctttcagacacacgctacttcattttccttctaacaaggctacagatttaaaagaaaactaatacaacacaccatcctgtattctataaaatatcttatggagcttttcatccctgagatgaatgaatacttacacatttgcagactcttcaaagggaataatacatctacagccagagccttaaaaagcagagcagctctagtgaccaaatgagtaacctcatgaggaagacattacactaattaggtttggcaggataggcccttcagcctcctccctttcaaaactcttcaaacgcctatctcaaatataattcacttggcacctatttatagcttggtattattagcatgtcttatctgcccaagtagaatgtgtttatctagacaacactctcaagaccctaggtctgtgctttaaacacaataaggactcaataaacatttgttggcagactgaacgaaccaacccaaatcatggattagctgtttaaatgtgtgagatgattggataatataacataaaaaacctgaagatatgacccattgcttcctgagacgtttacatacaaatgccagaaacgataaatctaaagagggccagtccttttccttttgctccaccgtcagtaccagtcacattcttatttcataattctagctacatgattactcattcaaactttctgtgcacttcctccattaaatgtttatgaatgttatcaactgggtgccttctttttttttttttaaataagagatgtggtctcactatattgcctaggctgggctcaaactctttggcttaagcaatcctcctgcctcagcctctcaggtagcagggtggctaacttggggcttttaggttactgacttataaaggtttctttccacaaaatcatgaagatgaaaatggaacagagaacactgtgggtcccagctcaggtccacagttagaaaacttaggccctaagtatatcctagctccagttgagaatctggatacaattggtaaattaacaagaaacatgacccagttaagaaagttatggcctaatgctttctatataggttacacagacatgaagagaaacaatagtgccctacatacaaaagctgaagccaaagaaaccaatggtagagtatctgaaaattcattaaaatatgaaaggatggggaaaacaactaaatgaaaatatgaactaagtaagagcaccattgtggtagactatagaagatgatatacaacaagaccttccttcaggtcattttgttgaagcagtactgggttagaatctaaaactcatttttttttggagaaaattagtccatgatttaagatcattacatttaggattctatgggataatgaatcttaagataaataagataggaataagactaatggtattaaagttcaaaaaggcagatagtttcaaaagacagtgctgtaaatttaggagtaaagtacagtatctctttttattaggttttgaatactcaaggtgtgtcacagtaagtcaaaagaaaatataccttataacagacgtacaaggaacagaaaaaactgcaattaactttcattagaggataagttaaggctacataaaagagatgcaatttgaactagatcttgaaggaaaaataagagtccgagatagagaaattaaagatacaggtgacgaagagtatagaggaagtagagagatgggattaaaagcactgttcacttaagaagtaaaggggaaaaggacattttcaaaatagaaagggaggagagaatggatgaaggtaccggaattataagatggcaagaagttgagaaaattcatatccttagcttatgtacaagtaagaacatcgaacagtttccaagctgaaaaggaagcaagggagccaggttaataggctggaagaaaaagagaagtccaaagactgctaatttcagtatcttcagtgacaggagcatggataagagaaagaaaagatatttatgtctttgaagtgatcagttctaggtgacgacaaggtccaagaagcgtctaggtgtacaagatgctaaagtagaataaagataaaagaatgccagagtgcagatagaataaactgtaaggctaaggtgttgggtagttcaacaatatgaatacatagtcaccaagaatgatggtaagagaaacagaaaacagaaaaaagttgagccagatatcaaagtcctcagcgactgttaaggaatacactgtaggtcattaactgcaagagataaaagacaggtataaaactggatgccacaaatatcaaagaaaaaaatcactttaaccatactcaaacaatgaactggaagcacaaacggggcttacaaatgctcatttctcttcttggtctcttgttgcaggagagaggaaggaaaagtaatttctacttaaaaggcattccaggttatatgccatgagaggaagaaagcagttttcagcagggggagaggcattaaaaaaatgttgagattgcaaaaaaagttattggtatcagaatagggattccagaggctacagtggaaactgttaaaagttttaatgagtaggtgatagggagaaatcagagggtgaaggatgagtaagttgggggaaaagttaactatgagatcaagtactttatacttttgaagtaattatgaaggcagaaatagtaggtgaactggagggccaagttacaacagaaaatgtagctataaataagtttaaatggaaactttggaataacattaagatggaactatttcaagttcccttcaaagtatagggaagtcaaccgtaaggatcatggtctaggtcttctgtggcaggcagctgatatactgatatatactatttctttttttttttttctttttttagagatggagtttcactcttgttgcccaggctggagtgcaatggtgtgatctcagctcaccgcaacctccgcctcctgggttcaagtgattctcctgcctcagcctctcaagtagctgggattacaggcatccaccaccacgcccggctaattttttgtatttttagtagagacggagtttctccatgttgggcaggctggtcttgaactcccgacctcaggtaatctgcccgccttggcctcccaatatatgctatttcgacattcaacaaatatttattgagtacctatacatgctaagcccattctaagtgttgtggatacatcagaaaataacaaggacagaatgcctacccttgagtttatactccaacagtgttgtctgatagaactttctttgatggtggaaatattctacaatctgtgccttccaatatgatagtcactagcaacatgttgctagtgcacacttgaaatgtacttcatgtgactgaagaaactgaattttaattttttaaaattctaatttaaatttaggtttcaacagtcatctgtgactagtaatatcatattgggcagcaaaggctctaatgtaacttcttggcttcatttaatgtgagtccctgctatcaaagggaagcaacatacagggcaaacaatagaagttgtatttttctactgtgatttctctactgtcaaagagtcctacaagtctcatgagaatggcagtagccttcttataccaaccttctgaaagcatggttcttgcttgtgagcactggaaattgacactggccattattagcaaaaataaactttcctgaaagaatataagaacccactcaaaagagaactagaaaactgaaaccaggatacaataattgataggaatcacaggcaaagacatgccacagccctgcctggtccttcaaacattgacacatatcctttcatcccttacttcacagtttaaattcttgggagaaaatgtgtccaatgggccaatataattcttttcaagatggagtctaagtagaaaggtggatatattaaatgatagttttttggtttgtttttaaaaaagcaaatatccaacactggcagcaaagaaatccaaactgatgaaatgtaaacgttcattaaaagctcaagaaaaaaacagaaagccccaaatgggaaataagagccctggctttaagccatgcaaaaaataaattaagggggtattgactacaggatatcataaatgttcagcttccctttcccttggttattgctattccccttggttatttgctattatatcaaactgcatatcatttacttcctcctccttcacccactccacacagagacatgggcatataaccttggctgagccagagtgcctgataccacggtcgcagtggtaggtccagggatgagcatgtgaactagacccaaacttgtctctagattttttttttttttttttaagacagagtctcactctgtcacccaggctggagtgcagtggcacaatcttggctcactgtaacctccgcctcccaggttcacgcaattctcctgcctcagcctcctgagtagctgggactataggtggctgccaccacaccccactaatttttgtattttcagtagagatggggtttaaccaagttggccaggctggtctcaaatgcctgacctcaggtgttccacccgcctcggcctcccaaagtgctgggatcacaggcgtgagccaccacgcccagcctcgactctagactttttaaacttgagtttgctaacaagaactttgtcctcttggcttcaacatatgttcccagcatcacagagataggacagcagacaaacgagagagataataagagaggagagagaaaataagagaggaggaataaaagaaaaggaggagaaaagtcactattatctaattgcatttgagttcctagatccaggtgtccctgaaaccagcaaaacccttatctttcccacaattgtgtaaaccaagaaagtcccttttgtttgcttgcattagttggagttgcgttgctgtcataaccaaaagttgactacatattctattatatttaaactcctttaatttttacatggttttaatttgcaaattgaataaatgtgcagcggagcagccttttgaaatacagtacttttataaaaataatttttattactcttggcactatgataagctagtggtaaaaaaaaaacactttcatcaaaagaaaagactggtatataattaataaaggatctgtcaaagcagtgattaatatgtaatagattaatatctacttatcacagatatatattatttgtaaataaatggatatttctgctttgcatgatttatactttccatttccttagtaagaccttttgcttcacagataagtctccaatctgtcacgggttatctaaataggaggtgctgcaattatgaccattttaatgaatgatcaaaatagacctggttgatgtagctggacttataaatcagtaaatcataactgtcaaggaaaaaataccacaattgttgaacattaaaaaaaaaaagccatgcaaatcgtgtgaatttaatcctgctagattttatgttggttactatgtctttattttaaaataagttgaggtcatttacacattgtaagtgaaactccagaggaatcaaagaaaaattatcaatgtgactaacagaatagaaaattattcacatttaagaaaagctaaaggaatgaaagctgttttatatagcaaaaaactaaaaaacaaaacaaaacaaaacctaagggtcaagttcattattgtgttcaagtaatgacagaatgctgaacattttatcactatggcaacagaaacccaaagcaggagaaacaggcttaaattctaacagaaaagattctaactggccaaactgtgggattatcataggataaaacattagagtaggatgcctggggagggtctacccctactttctggagactgtcaaagagagatttaaaaacgacctgtcttgaatatgtcctaaaaaatgtacccatctaaaagcaaaaggacagacaagattggttcttaaaatctattacagattcatgcttttagaatcacagccactaacaatttaaataaagttataaaacctaagtaagtaataagtatacctctgcctgaagtaattctttcctaagtaatgcagatcaagaactctgtctcaaaacatagcctaccacttaatgaacatgatttttaaaagccactcaaactttatataattagagacgtcactaagatattagaatttgaaaagcagacataaagcatttccaagtgttgaggataacagcagatgtctagctctgtgttatccatatattctgcaaaaacaatacagaaaaagcaaagagaacaaataaagccacacaaaaccatacccttagcataactggcagacagaaaatgcccaaaacctcaaagtaactaagtaaaatgaaggaaaaaataccaaatcccagcaagtgatctctcccattcccgcctgcacatctttgcaggcaagggctcactgcatgtgaatgtacttaattcgcccattaaaataaaatgtttaatttattaaaatttggcccacaaaacaagacccaactaaacgctacatataaaacacacatttaaaaagcaaaacgattcagaaaatttaaaaataagaggataaaagtataccaggcaaatggaaactatatgaaaacagaagtggtgatggtatcagacaagtcaagcaaaaaaaaaagacaaaaaaagcaatttttaatgctaaacgctacaattcacacttaaaatagaactgctatgaatatttatattctgtaccaaataccatgaaactcacctttatgaaacaaaaactacaagatatacaaagagtcacatacagaaacacagtaataataggagactttaatatatcattctttgtacaagacaaatcaagtggacaaaaaataagcaagtatacagaagacctaaacatcgcagttaacaaggcagatcctatgtgtacagacacatatgtgtgtatgtatgtctgtgtgtgtatgtatatatatatagaacttcatatatatatatatatatagaacttcatactcttataagactccatgtgtttacgtaacacaataactgacatatactatgggactaagtgactatagttctatagtcgctgggcatgtgacatgtccagaatgcgaacttaagaagacacccattctaagactcctgcaagtgcagggtcagcaccgtgagactgtcgccttaaattttttgcaccctgggtgcctcaattgctttaccctagtcctacccttgatagattaggttacaaagaaacatcagagtgttccacaaagcagaaagagtacaaacaatattgtgatcacaatgcaataaagctagaaattaacttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttttttagtagagacggggtttcaccttgttagccaggatggtctcgatctcctgacctcatgatccacccgcctcggcctcccaaagtgctgggattacaggcgtgagccaccgcgcccagccgaaattaactttttaaaaaggttctcctacctggaaattaaaaaaccttctgttatagactgaaacatgttccttcaagatatgactacatttcgagatagggcctttaaagagacaattaaggttaaagtcatatgggtgggccctaatccaatatgactagtgtccttacaaaaaggatagacaagaggggatgcaaaggcacagagaaaaggccatgtgaggacaaagtgggaagaaggtggctacctgcaagtcaagaagagaggtcttaggagaaaccaagccaggcaataccttaatctatgacttctagtctccaaaactgtaagaaaattaattcctgttgtttgatcacccagtctgtggtattttattatggcagacttagcaaactactacatcttctgttaaacaactctttggcagaaagaaaaatgcaaattaaaattagtgaatttctttaaaaataataattaaaacactatataatttatgggatacacgtaaagcagtgatgagaagaaaattattagcactaaatactcttaccaataagaatgaaagaataaactgtagtaaaattaaattctcaactcaaaaacaaccaaatgaacaaagtaaactaaaagaaagcccaaggtatacaacatgaccttagaaaactctaagaaatcaacaaagcagctattagaaaatatgtgactttagtaaagtcacaggattcaagatcaatacataaaagtaaactatatttctatatgcaacgaacaattaagaagtcaaatgaactccatttataccatatttagaaataaaattgaatcaaagatgaacatgatatatacaatgaaaactgcaacacactgatgaaagaaatgaaacctaaataaatggagagatgtatgatattcatggattggaagactcaatattgttaaggtaacaattctcctcaaattgacctaaaaatccaatacaatcccaattaaaattttaacaagaatttaaaaagataaaaaactgattaaaaaattaatatttgaaaggcaaaggacctagaaaagccaaaagaatttagacaaaaaagaaccaggtagaggacgtgcactacctgaaccaaacttactataaagctacagtaatcaaaatggtatgatactggtgtaaagacaagatcagtaaaatagaatagagtccagaaatagactcacacctgtaattcagtgagggaaaagatagtcttcaaaaaatggtgctggaacaactggatacctacatgaaaataaaaagcatatgtgtgccattaccttacaccacataaaagttaagatgaattagaccttaaaacctaaaggtaaaaaccaaatattaatcttttagaagaaaacaaatatctttttaacacagaattaggcaaagacttcttgaagagaacacaaaaaatacaaacaagaaaaaaattgataaagtggtgtagtattatgatgtatatatattggtttacatatacatatgggtttacattcatggttcctggctcgtaacttccatagcccttgtccacatttcctaagtgactaaaacaatacatgtatctttgttaccgtattaggccctttgtttatggctcgggaggcagcttcagaacagcttcagagtgataaaggcgaaagacagtctttggttataatactggggtgctctgggcctcagaaaacagaatctctctctgaccttctgtcctccttttacctgcgcctttttctctccaaggcaggccacacacactaaaaatatactccaatcttcccccatctttctgtcttggaactggtcataaaaaaatcctctgaattaccttacccgacagcaggtcataagacccgcatttctgaaggggtcctgccccttccttatccaggaggaaataatgctacacagaggggccaagaagaatctaaatgcacaggacttgttacaattctctgcacagtctattagtattagatcatgccctttttgtccaataagatttccatacgattgtccattcttcaatcatgtttatccaatgaagtctccaaaaaagactcaagaggacagggtaccgcaagcctccagacagctgaactcatggaggattacatgaaggtaaacaagaactcacccatgtgctaggagaatggcacactccaacttcacaggaacagaagctcctgagctctggacccttgagatctcaccctattatttctctttcttattgtttttttgagacggggtcttgctctgctgcccaggctggagtgcaatggccaatctcggctcactgcaacctctgcctcccaggttcaagcaagtctcctgcctcagcctcccgagtagctgggattacaggcacctgccaccacgcccaactaattttttttgtatttttagtagagacggggtttcactatgttggtcaggctggtctcaaactcctgacctcaggtgatccacccacctcagcttcccaaaatgctgggattataggcgtgggccaccgcacctggcctattatttcttcatctagctgtttatttgtatccgcagtgagctgagatcacaccattgcactccagcctgggtgacagagcgagacgccgtctcaaaaaaaaaaaaaaaatcctcttcaataacctgggaaacataaagtgtttccttaagcttgtgaaccactctagtaaatttagctgaaagagaaggttatggaaaccccaacttaaaaacctggtcgatcagaagttccagagtcctgaaagtgagactggtgtctgaaatggtggcaatcttgtgggaccaagccttcaacccgcaggatctgatgctatctccatatagagagcagtagaatcaaattagattagaagatgtcagactgctgtccactgcagaactgaatgcttgcttgttgatgggtagaaatccatacatttggtcacagaagttttctgtgttgtggtgtgaaaacacaggaaaaaacaccactcaggagttcaagaccagtctgggaaacatggagaaaccttgtctctgctaaaaatataaaacttagccaggcacggtgccatgcacctgtagtcccagctactcaggaggctgaggtgggaggatcgcttgagcccaagaggcagaggttgcagtgagctgagatggcaccacggcactccagcctgggcaacagagcaagatcctgtatcaaaaaataaacaaatatatatatatatatatacacatacacacacacacacacacatacacacacacacacatacacacacaagtaaatgaaaaggaaagtcatagataaggagaaaatatctgtaaaatatgtatctaagaaagagcttttatgcgtaacacataaataactattataaatcaataagataacttctgaatgtaaaaagtggccaaaatatttgaacagaaacttcacaaaagtagcttataagcacacaaaaagatgctaaccaccactagtcacagagacaataaaattaagaccacaggtgacatgttacaacatatccaattagaattattattaagactgaaaataacaagtgtcagtagggatgtaaaacaaacaaaatcctcatatattgctagttggaatgaaaaaacttctcaagtgtttccacattggaaaacagtatttctgtatgttataaaattaaatatatacttaacatatgacttagtaatcccatttctaggtatttaacaaggagaaataaaaacatatttccacacaaagacttgtaaatgaatgttcacagcagcattattcataatagcccccaactaaaaacaacccaacatttgtccaacaaaagaataaataaatcatattacgtttatacaatgaatactaatcagcaataaaaagacatgggctactgatacactcagagcatggataagtcacgggttgcctaatgttgggactcaggaaaggaggtcaactataaagagacataaagaaacttttggggtgatgaaactattccatatttttattatggtgaggattgtacaactgtatacaaaatggatgaattttattttaggtacattaaatgataacaataaaactatagaaactttttaagggcaaagaaccagaagataaaagcagaaattaatgagttagaaaatgggaaaccagtcgatctaataaataaaccaaaatcctaatttaaatgaatgtactgaactgtatgttttaaaatagttaaaatggtaaattttatgtatattttaccacaaaaaaaatatatatatatacacaaagcagtggctgacttgaccaagaaagaaagaaagcacacgtatagaacaaaaaataacaaaggggaaataagcattgaaacagaaaaaaaatttaaaaaaaagaggtctacttttcaaaaggaggagcatagtggccagccgtcagaagttgacaatgaccagttgagagcaatcattggagctgatcctctacaactacacaagaagctgccaaagaactcaatgtcaaccattttatggtcatttggcatttgaagcaattcggaaaggtgaaaaagctagataagtgggtgtctcatgaactgagtgaaaatttaaaatatcgtcattttgaagtgtagtcttctcttattctatgcaacaacaaactatttctcaagcagattgtgacatgcgacaaaaagtggatttcatacgactaccggcaatgaccacctcagtggctggatggagaagaagctccagagcacttcccgaagccaaacttgtgccaaaaaggctcatggtcactgtttggtggtctgctgccggtctgatctactacagctttctgaatcccagggaaaccattacatttgataagtatgctcagcaaatcgatgagatgcattgaaaactgcaatgcccgcagccggcactgatcaacagaaagggtccaattcttctctacgacaatgtccaactgtatgccacacaaccaatgcgtcaaaagtggaacgaactgcactacaaagttttgcctcatctgccatagtcacctgacctcttgccaactgactatgacttctttaagcatctcaacaactttttgcagggaaaatgcttccacaacgagcaggatgcagaaaatgctaagtgtttgtctaatcccaccaggtgtggtggctcacacttgtaatcccagcactttgggaggccgaggtgggtggatcacctgagatcaggagttcaagaccagcctggccaacatagtgaaacaccgtctctactaaaaatacaaaaattagctaggtgtggtggtgggtgcctataatcccagctactcgggaggctgaggcaggagaatcgctgaacccaggaggtggaacttgcagtgagccaagattgcgccactgcactccagcctgggtgacaagagcaagactctgtctcaaaaaaaaaaaaaaaaagaaaaaaagtttgtagaatcccgaagcatggatttttatactacaagaataaacttatttctcattggcaaaaatgtgttgactgtaatggttcctattttgattaataaagatgtgtttgagcctagttacactgatttaaaattcatggtccaaaaccacaattacttttgcaccaacctaataatacaccatattaaaagaatgaagaaaaaaatgcatgatcatctcaactgatgcagaaaaagcatttgacaaaattcaacaccctttcatgataaaacaaactaacaaactcggaatagaaggacactacctcaacataataaagccatatatgaaaaagccacagtgagtatcataagcaatggtgagagactgaaatgttttcctttaagatcaggaataaaccaagtactcccacttttgccacttccatttgacatgaaactggaagttctagccagagctattaggcaagagaaagacaatgaattcagcaaagtagctgaatacaaagccaacaaacaaaaattagctgcatctctatacactaacaatgaatactatgaaaaggaaaatgaagaaaataattccatttacaatagcatcaaaaagaatacataaaaattaactgaaccaaggaggtgaaatacttagaaaactaaaagacgctgctaacagaaattaaagaagatataaataaatggaaacacatcccatgttcataaattgaaagattcaatattgttgagatgtcaatactaccaaaaataatctacagaatcaatgcaattgctatcaaaatcccaatattttgcacagaaatagaaaaatctatcctaaaattcgtatggaatctcaaggcaacccaagtagatgaaataatcctgaagaacaaaactagagaactcatacttccttatttcaaaatttattgcaaagttataataatcaaaatagtgtgacactgacataaagaccaacatataagcaactggaatagaatacagaatgagtaaataaaccctcccatatacggtcaaatgatttttgacaagagtaccaaggtcattcaatgaagaaagggcaatgttgtcaacaaacagtgttgggaaaactggatacatacatataaaagaatgaacttggacctctctttatataggaaaattaatttaaaatagatcaaaggactaaatgtgcaacctaaaactataaactcttagaagatgggggaaaggcttcatggaatttgatttgataatgatttcttggatatgacacgaaaggcatagggcaataacaacaacaacaaaaaaaaacagacaaaatgaactccatgaaaataaatttttctgcaacaaaagatacttatcaacagagtaaaaccctacagaataggagaaaatatttgcaaatcatgtatctgataaggcattaatatccagaatatacagagaaaaactaaacaagaataaaaaataaaatttttaaatggacaaaaaacttgactagctgtttttcaaaaaagatgcatattaaaagatgctcgacatcactaatcattagaaagatgcaaatcaaaactacaatgagatacttactacctcacacctatcaggatggttactatcaaaaaaacatgaggaagacatcattaagatgactgactagaggaccaacactcttccacaaaggcccaaaataacaagtaaataactgcacttcaggtaagagtttctaagggagaacaacagaattcacatgaaagagaaaaaaaaaatccacttaatcatggagacttgagatggcagcatagagaagaaagcaaagcacccagccaggattggctcagaaccaagagagactccccattgtgtgagaaatggtaggtaggagttccttagcaatccctaataccactgtggacatgtgtaaacctagctacagaagagccctagagtcctaacaggccctgaatccggtacagggagctgcttggagtccacatggttacattgctccagagaaggaacacacactgggtccccccactccctgtgacccaagctgctacagcatggcaccattttgagaaccgagccaatgctgaaatacatgctgccatggggttcaacagacctggtatttccatatctgaagggtcccactgtaatcatgccacaatcaaataaaagggtccaacaccacaacctcagctacacagagcagtaaagccaaaactccagaacctgagctgatatagtagacctaaaggaacaagcaatctagcacagcagggaggccacctccaagaccaagggcactggtgcatgcagtccctagggtttaagaactagctgccagccactgccagcaatcccattcccataactggtgaagcagaaatgcaccccacatacctgtagggaccaatgatgggcccatatggcaacagccaccactggcaattccaccccacaactggcaaagccaccatacccaatgagcacccaacacccaaggcctgagaactgttccacctagaggcccctatcaacaccaaagacatgagattcattctacaaaaactcacagcagagaccactgaggtacttgcagacactgctgacacgaattacagccaaagatcatatggagactacattactgtactaatatagaaacaaagccaaagcaactacccaaacaatactgcaggacaaatatacaggaaaaagtccttctttacaaaagctactccataaaatagaaagagacaactattctaccagatgcacccataacatagggacacaagaaacatgaaaaaagttgggcgtggtggttcacgcctgtaattccagcactttgggaggccaaggcaggcagatcacgaggtcaggagtttgagaacagcctggccaacatactgaaaccccgtctctactaaaaatacaaaaaattacctgggcttggtggtgggtgcctgcaatcccagctacttgggaggctgtggcaggaaaatcgcttaaacctgggaggcagaggttgcagtgagccaagattgtgccactgcactccaacctgggtgacagtgtgagactttgtctcaaaaaaaaaaaaaaaagaaacatgaaaaagaaaacatgacacctcaaatggaacccaataatactccagtaatagaccctaacgaaaaagaaatctaaaaaatgcctgaaaagaaattaaaaataacaatgttaaggaaacttggaaagatacaagagaatacagatagaaaattcaacgaaatcaggaaaaaatgatatgaatgagaaatctgagagacacagatatcataaaaaagaaccaaacagaatccttggagctgaagaattccatgaacaaaattaaaaatacaatcaagaatttcaggaacagtctagatcaagcaggaaaaagaatttttgaacattaagacaggtcttttaaaataatccagtcagacaaataataataaagaataaaagggatgaagaaagcctatgagacttatgtgacaccattaagtgaacacatattcacattataaaaattccagaagaataagagatgggaaatggtatcaaaaacgttgtaaacaaaatcataactgtagagttcccaagtcttaggagagagatgaacatccaaatccaaaaagctcaaagaccccaaactgattcaacccaaaaaggtcctctccaaggcatactatactcaaacatcaaaaatcaaatcaaagagagaattctataaacaacaagaaaaaagcatcaagtcatatataagaaaatccccgtgagacaaacagcagatttctcaagagaaaccttacaggcaagaagagaacagaatgttatactcaaaagtagtgaaagaaaaataacttccattccaaaatactatacccagcaaaactatcttcagaaatgaagaagaaacaaagtctttctcagacaagcaaaaactgagacaattcatcaccactaaacctactcaacaagaaattcttaagggagtcctacaactgaaaatgaaaagacaatgactaacatcatgaaaacatgctagtataaaactcactagtagagcagatagatatacaaatgagaaagaaatcaaactttgtcactacagaaatccaccaaaccacaaagataaacaattaagagagcaagaaagaaacagaagatctacagtacaaccagaaaacaattaacaaaatgacaggactaagtccttctctaccaagaataactttgaatgtaaacagattacatcccccaattaagacatatagactgggtaaaggcataaaaactcaaagcccaaatataagctgcctaaacacaactcacttcacccataaagacatacatagtctgaaaacgaagtgggggaaaaaaaaaaaaacactccatgcaaagagaaaccaaaaatgaacagaagcaacttacttatatcagataaaataaactttaagtcaaaaactgtgaaaagtttgtcacactgtaaaaagaactgtaaaaaaaaaaagtttttaagctgtaaagagacaaggaagttcattatataatggaaaaaaaaacccaattcagcaagaggattagcaatagtaaatatgtatgcatcaaacaccagagaaccaagatatattaaagcaaatataattattatctaaggggaaagatagacaccaatgcaataatagtagaggatttcaataccccactctctgcattagagagatcacctagaaagaaacatagatttaaactacactgtagaccaaatggacttcacagacacttgtaaaacatttcatccagtagctggagaatgcagagtactcattcttcttcttctttttttttttgagatggagtcttgctctggcacccaggctggagggcagtggcacaatctcggctcactgtaacctctgcctcctgggttcttgtgcctcagcctctcgagtagcggggattactgtcacgcaccaccaaacccaatcaatttttttctgtatttttagtagggacaaggtttcaccattttggccaggctgctctccaactcctgacctcaagtgatctgcccaccttggtctcccaaagtgctgggattacaggtatgagccaccatgcttggccagaatattcactctttttatcagaacatggagcattccacaggacagaccatatgttaggccacaaaacaagtctcaataaatttttaaaaatcaatatatcaagtatattttctgacaacagcagtataaaactagaaatcagtaacaagaagaactctgaaaggtgtacaaatacatgaaaattaaataacatgctcctgaatgaccaatgagtcaaggaggaaattaaaaaattaactgaaggccgggtgtggtggctcacacctgtaatcccaacacttcagcaggctgaggcaggaggatcacaaggtcaagagatcgaaaccatcctggccatcatggtgaaaccctgtctgtactaaaaatataaaaattatatgggcgtggtggcacacgccttgctactcgggaggctgaagcaggagaactgcttgaatctgggaggtggaggttgcagttagctgagatcgtgccactgcactccagcctggctacagagtgagactccgtctcaaaaacacaaaacaaaaaaaaacagaaaaatttcttaaaaacaaataaataaaaataaaaatgcaacatacccaaaacctatgcaatgaataccacaaaagcagaattaagagtgaaagtttatagcaataaatgcctacatcaaaaaagtacagaaacttcaaatcaacaacataatcatgttccccagggaactagaaaaacaagaacaggccgggcacagtggctcacacctgtaatctcagcactttgggaggccaaggcgggtggatcacgaggtcaggagatcgagactatcctggctaacaccgtgaaaccccatctctactaaaaatacaaaaaattagccaggcatggtggcaggtgcctgtagtcctggctactcaggaggctgaggcgggagaatggcgtgaacccaggaggcagagcttgcagtgagcagatcgcaccactgcactccagcctgggcaacagagcgagactccgtctcaaaaaaaaagaaaagaaaaacaagaacaaacaaagcccaaagttagtagagagaactaaaacgtaaaaatcagtacagaaacttacaaaaagatgttgggagcaagccccccaaagtctggccataaactggccccaaaactggccataaataaaatctctgcagcaatgtaacatgtccataatggccataatgtccaagctggaaggttgtgggtttacaggaacgagggcaaggaacacctggcccgcccagggtggaaaaccgcttaaaagcattcttaagccacaaacaaaagcctgagcatctgtgtcttaagggcgtattcctgctgcaattaattcggcccatcctttcgtttcccttaaggggtacttttagttaatttaatatctatagaaacaatgctaatgactggtttgctgttaataaatatgtgggtaaatctctgttcagggctctcagctctgaaggctgtgagacccctgatttcccacttcacacctctatatttctgcgtgtgtgtctttaattcctctagtgccgctgggttagggtctcccctaccaagcctgtctcggcaagtggcgcccattcatgggggctcgaatccaggtcgaagggtcgccagagcgacggctgggaacagaaaactagctggaggacacccgagtactcttaaagcaatccctgtggtgagtaagaaggggagctctgaagcatcagggtaacaatgggataggtatggggtctggttcgtttcatcttagaactttttcacactgataacaaggaggaacaagagtatagtgaagtaacagaagaggttacagagcatgtttatttgccagctaaagctaaagcggcaaaggaaggacaggttcatccctacccttctgcaccccctcattattttttgaggaaaatgaccccccagatctttcttttccagaggacactgggtgaaaaatagctgccccagtgactgttcgagcagcgcctcgagcgatggctcttagttctattaggcaggaattcggcaagctagacaagagggtgatttagaggcttggcagttccctgttagaatacatcccccagatcaagagggaaatattacagctatatttgagccttttccttttaaattacttaaagaactaaaacaagcaataagtcaatatggaccaggttctccttttgtaatgggactgttaaggaatgttactgtttccagtcggatgattcctactgactgggacgctcttactcgagcttgtctaactcctgctcagttcttacaatttaaaatttggtgggcagatgaagcttccatttgggctgctcgcaatgcccaggcccaacctcaaattaatataactgcagaccaacttttgggggttggcggctgggctggtttagatgcacaactggtcatgcaggatgatgccatagaacaacttagaggtgtgcacattagagcttggggaaaaaaaatcacttaatgtggggaacaatacccttcctttagtgctataaaacagggaccaagggaaccatatgttgattttatagctcggttacaggagtctcttaaaaagatgattgcagatttggctgctcaggatatagtgttgcagttattagctttccacaatgctaatcccgattgccaggctgctctgtgacctatcagagggaaaacacatttagttgattatatcaaggcctgtgatggtatcggaggtaatctgcataaagctaccttgttggcacaggcaatggcaggactgagagtggataaaggaaatactccatttcctggagcttgttttaactgtgggaagcatggtcatactaaaaaagaatgtagaaaaaatcagcgagtcaggccaccagataggggaaaaaagaaaactgttgagccagaaatatgtccaaaatgtaaaaaaggaagacactgggctagtcagtgtcactctaagtttgataaagaagggaatccgatttcgggaaatgccatgagggagccgtctcgggccctgttctaaaccggggcatttccagcacaggccattccctcacccctgtacaatgtctgtcccctgccacagcaagtagttccacagtagatttatgctgcacaaaagctgtgagccttctgcctggggaacccctgcaaaaggtcccaacaggagtctgtggacccttgccagcagggactataggattacttttaggaaggtctagtgtaagtttaaaaggtgtacaaatacatacaggagtcattgattcagattataatgggtatattcaaattgttatatctacttctgttccctggaaagcagagccaggaaagcacatagcacagctcctgattgtgccgtatgtgggaatgggaaaaagtgaaattaaacgaacaggaggatttggaagcacaaataaacaaggcaaagcagcttactgggtaaatcaaattactgataaatgtcctacctgtgaaataactattgaaggaaagaaatgtaaaggtttggtagatacaggagcagacatttcaatcatttctctacagtactggccatccacgtggccaattcaacctgctcaatttaacatagttgaagttggtaaagtcactgaagtatatcaaagtagttatattttgcattgtgaggggcccgatggacaacctgggactattcaagcaattataacttctgtacctataaactgatggggaagagatttattacaacaatggggagcacaagttctaattccagaacaattatatagccctcaaagtcaatatacaatgcatgaaatgaggtatgtccctggtacgggactagaaaaaaaaattgcaaggtttgaaagaaccacttcaagtggaaaaaacaaagttcccgccaaacattagggaaaaatttttgatggcagccattgttaagcctccagaacctatacctttcaaatggttaacagatacccaatttggatagaacaatggctgctaagtaaagagaaactggaggctttagagaaattagttgctgaacaattagaaaatgggcacatagctccaacattttcttcttggaattctccaattttcgtaattaagaaaaaatcaggaaaatggaaaatgttcactgacttaagagccaccaattcagttatacaacctatgggagcattacagccaggattgccttctcctgctataattccaaaaaactggcctgattcctgcaagaagtagctcaccatgacaaagctgcccttgcttttatctctttgcaaatctaagaagggagacatgttgggagcaaccccccaaagtctggccataaactggccccaaaactggccataaataaaatctctgcagcaatgtaacatgtccataatggccataaagtccaagctggaaggttgtgagtttatgggaatgaggacaaggaatacctggcccgcccagggcagaaaactgcttaaaggcattcttaagccacaaacaaaagcctgagcatctgtgtcttaagggtgtgttcctgctgcaattaatttggcccatcccttcatttcccttaagggatacttttagttaatttaatatctatagaaacaatgctaatgactggtttgctgttaataaatatgtgggtaaatctctgttcagggctctcagctctgaaggttgtgagaaatcaggggatttcccacttcacacttctatatttctgtgtgtgtgtctctaatccctctagtgccgctgggttagggtctccccaactgagctggtctcggcaaaaaggagactaaaaaactataaaatatcaacaaaacaaaatgttggttttttgaaaaaacaaaattgacaaaacattagctagactaactaaaagtgagaagacccaaataaataaaatcaaaaatgaaaaagcagacattacagctgatgccacagaaatactaaagatcattagagactattatgagcaactgtaggacaacaaataggaaaacctagagaaaatggataaattgctaaacacacaaaacctatcaagactgaaccaaacagaaggaaatacaaaacctgaacagatcaataatgagtaacaagactgcatcatcaataaaaagtctcccaagaaaaaaagcccaggaccagatggcttcactgctgaattctaccaaacttttaaaaaagaactaatactaattcttctcaaactattccaaaaaattgaaagggagaggattcttccaaactctacgaggccagcattaccctgacaccaaaaccagacagggacacaacaaaaaaaagagcactatggccagtatccctaataaatacagatgcaaaaaccctcaacaaaaacaccagcaaaccaaatccagcaacacgttaaaaagattattcaccatgatcaagttagatttatcacaggtatgcaaggatggttcaatatatgcaaatcaataaatgtgatacatcgtatcaactgaatgaagaaaaaacgataatttcaatacatgcagaaaaagcgtctgacaaaaattcagctttccttcatgacaaaaactttaaaaaaaattaggtataaaagaaacatacctcaatacaatgaataccatatatgacaaaaccacaactaacatcatactgaacaaaaaaacattgaaagcttttcccctaagaactagaacaatacaaggatgttcacccttgtcaatcttattcaacacagcactggaaatctcagccaaagcaattaggcatgagagagaaataaatggcttcaaaataaaaaaggagaaagtcaaaactgtccacttgcagatgacattatcttatatatagaaaaacctaaagatcccaccaaaaagctcttagaacttttaattcattaaagtttcaggataaaaaaactcaacatacaaaaatcagtagcatttctacatacttaaactaactggaaaagaaagaaatcttctttattataattataaaaattaaaatacctatgaataaatttaacaaaggaggtaaaagatctctaaaaggaaaactataaaatactgattaaagaaattgaagacaccaaaaaatgaaaagaaatctcatgcttatggattgggagattaatattgttaacatgaccatactaccaaaagtgatctacagtcaatgcaatttctaccatattaccaatgaatttcttcacagaaattgaaaaaaaaaatcttaaaatttgcatggagtcacaagactccaaagagtcaaagcaatcctgtgtaaaaagaacaaagttggagctatctatcacactatctgacttcaaaatatgctacaaagctgtagtaaccaaaacaccatagtactggcataaaaacacatacacccacaaatgaaacagaagagagaagtcaaaaataattccacatatttacagataactgattttcaacaaaagcaccaagaaaatacattggggaaaggacagcctcttcaataaatgattatgggaaaactgcatatccaaatgcagaagaataaaactagatccatctctcatcatatataaaaatcaaaaacttaagtatgagaccccaaactatgaaactactacaggaaaacacaaggaaaagacttcaggacattgccctaggggaagattttacgggtgagacctcaataacacaggcaacaagttgggcatggtggcacgtgcctatagtctcagctacttgggaagctgaggcaagaggatcacctgagtccagaaattttgtgctgtagatgctgtagtgcgctactgcaattgggcattcacattaagtttcgcatcaggataatgacctcccaagagtagaggaccaccagaatgcctaaggaggggtgacctgacccaggtcagaaatagagtgggtcaaaactctacgctgaacaatagtagcattgcacctgtgaatacccactgcaatccagcctgggcaacacagcaaaatcccatcccttatataaatacaaaaacaaaataaatgaaacaactataacaacagaaaacgcaggcaacaaaagcaaacatagataaatgagatcgtatcaaaccaagtttctgcacaacaaggaaacaatcaacagagtgaagagacaacctatacaatgggagaaaatattaatacctgcaaactaatttttttttttttgagacagagtttcgctctttttgcccaggctggggtgcaatggcatggtctcggctcaccacaacctccgcctcctgagttcaagcaattctcctgcctcagcctccagtgtagctgggattactggcgcacactaccaggcccagctaattttgtatttttagtagaggcagggtttcaccatgttggtcaggctggtcttgtactcctgacctcaggtgatccacccgccttggcctctcaaagtgctgggattacaggtgtgaaccatcatacctggcccacctgcaaactatttatctgacaagggattaaaatttagaataaacaagaaactcaaacaactgcaaaaagccccaagtaatttcatttaaaaatgggcaaatgatctgaatggatcattcatgaaaaattgttcaacataactatttatcagggaaatgcaaatcaaaccacaatgagatttcatctcaccagctagaatgcctgtcaaaaagacaaaacaaatgttgtcaagaatgaggagaaaagggactctaatacactgttagtggggatgtaaattagtatagccattaagaaaaatagtatggaagctctacaaaaaaaactaacaacaggccaagtgcggtggctcacgcttataatctcagtactttgggaggccaaggcaggtggatcacttgaggtcaagagttggagaccagcctggccaacacagtgaaaccccgtctctactaaaaataacagtcaatcaattaatcaataaattagccaggcatggtggcacacacctgtaatccagctgctcaggaggctgaggcaagagaatcacttgaacctgggaggcagaggttacagtgagccgagatcacaccactgcactccagcctaggtgacagagtgagaccctgtctcaaaaaaaactgaaacagaactaccacaggacccagaaattccacaactgggtatatacccaaagcaaaggaaattagtatgtcaaagtgatatctgcactcctatgtttactgtagaactattcacagtaagcaagatatggaatcaacctacgtgcccatcaacggatggataaagaaaatgtggcatatataaacaatggaatactattcagccataaaaaaggatgaaatcctgtcattcatggcaacatggacaagtatggaggacaattgttaattaaataagtcaggcacacaaagatatatactgcatgttctcactcacatgtgtaagctaaaaagtttatttcatagaactagagagtagaatagtggttactagaggctggaagggtagtgaggagggaagacagaggttggttaacaaatacaaaattactattggataggaagaataatttctggtgttctacagcactacagactgactacagttagcactaatttattgtatatttgagctagaagagacgattttgaatgttcccaaatcaaagaacatatgaaatgtttgaggtgattgaatatgctaattaccctgatttgatcattacacattgtatacgtgaatcaaaatatcacactgtaccctgtaaacatgtacaattgtgtgtcaattaagttttttaaaaacatgaaataagtgctggtgaagatatggagaaattagaagtcttttgcatttttggtgggaatttaaaatggtgcagccactgaagaaaatagaatggcagttcctcaaaaaattaaaaacagaattacaatataagccagtaattcttcttctggatatacacccaaaataactgaaaccaaggtcgtaaggagatgtttgtacacacatgttcataacagcattattaatagctaaaatgtggaagaaatccaggtgtccataaacaaatcgataaatatagtatatatgtagaactgaaatattattaagccttagaaagtaatgaacattagggcaggtgcggtggctcacgcttgtaatctcagcactttgggaggctgaggtgggcaaatcacctgaggtcatgagttcgagaccagcctggccaacatggtgaaacggcatctctacaaaaatacaaaaattagccaggtatggtagcaggcgcctttaatcccagctacttgggagactaaggcaggagaatggcttgaacctgggagacagaggttgcagtgagctgagatcatgccactgcactccagcctgggcaacagagtgagacgctgtctcaaaaaaaaaaaaaaaaaagtaattacatcatgctaagtaaaataacccagtcaaaaaaaaaagacaaatactgtttgattccacttacaaaggtatgtagagcagtcaaaaatcctaaaagacagaaagtgaaatggtgattaccagggtttgggaggatgggctaaaggggagttattgtttaatgggtacagagtttgttttacaagctaaaaagaactctggagatagatggtaatgatggttccacaatatgaatgtattcaataccactgaattgtacacttaaaaatagttaagatggtagattttatttttacatgtattttaacaattttcaaatattggaaaaaaattaatggaatcccaataaaactgcaaacaaactttttaatggagctagacattaatattcaagttgatatgaaaaaacaaacatataattatagctaggaaaatactgagagaaaaactataaggactgagtaccacaaccagacattaaagcatactataaagcctctataattaaagtatcataataatggtacaggcgcctaaagttccaactacttgggaggctgaggcaggaggattgcttgagctcaggagttcagtgttacagtgagccatgatcgctcactccagcctgggcaacaaagaaagactctgtctctaaataaaaattaaaacaaaaaaaatttttttaatgtaaaatggcacatgaacagacaaccagatgagtgaaacagaatagaaagtccagaaatatacccaagtatatatggaaatttaaaatacaataaaagcatcatcatgaatcactggggcaaagacaggtttttaataaaagtgtgggacaatcaattagccatttagaaaaaactgatcaaatccatacctcacagcatacaaaagaatacacttcaaatagatcagagaactaaatgtaaaaaatgaaaccatacaagcaaaaagaagtgaattcctctttaacctcagttcagggagagagtactaactctgacttaatacccagaggcaataacagattaaatttgattacataataaaaatttttgcatggcaaaaaaataacggaagcaaaatcaaaggactgctgacacacactggcagaaaatatctgcagcataatcctaatatataaagaactcttaaaaagtaaggtaatttaaaaaaaatttttaagcaagggaaaaaaggccaaaaaaaccaagtataatagggaaagacaagaacaaacaatacatacaaaaatgatataaaaatggcccttaaacacatggaacattgttcaatctcatttgtaatatgagaaatgcaaattaaactacactaagatgcaaagtgatataattctcttggatggaaatttggcaatatctaacaaaactgcgtatgatttaccttttgacccacctatttacttcaggaattcaccctgaagatacacctccagaaaatgaaaatatttacatgtacaacattattgattagttgtaatcacaaaatactggaggccaggtgcagtggctcaacacctataatcccagtactctgggaggccgaggtgggcagatcacccgaagccagaagtttgacagcagcctggccaacatggtgaaaccccacccctactaaaaatacaaaatttagccagttgtggtgacatacacctgtaatctcagctactcaggaggcaggagaatcacttgaatcccagaggcagaggcggaggctgcagtgagccaagatcgccccactgccctccagcctgggcaacagagcaagactgtgtttgaaaaaaaaaaaaaaaaaaagacaaaatattggaaattaaatgaacataggagactatttcactaaacactgatagatacacatagtggagtgctatgcagccataaaaaagaatgaggctaatccctatgaactaatctgaagcagtttccagggtgcactgataagaaagaaggaaaaatacaatgacatctggtatttgtgaggaacaaaaacaaacaaacaaaaaatgtaggaagtctaaaccagaaactaatgagattaatctcacatggggcaggatagatgagaaaagatgagggaaatgggaacagggtagaggagatgtgggaagtggcatttttttgaaggttttgtttttttgtttttgtttttttttggtgtattatagttctgtcctttagaaccatgtagacattccaaatgcccaacatattaataaataaataaacaaggatgaggtatggactcaaaacagaatagaatagaaagaataaacctgctttataagtgaataacaaaccacattaaaggagaatttggtgagaaaaatcctaagtaactttggaaaataatattttgactatatactctaaggctaaagataaaaacaactatacacaaatattacatgtaagttaataggtttgtttttcattgagtgatgagttagcaattctaaaacaactttatattttaggactgaggaaataagtaaatatggtaggaataatgaatgccagttttctcactgtcaaaagaattgcaagtatgaaaagaggaagaccagaatgaactccacggtgctggaacagaactggaaatatcaatgtaaactcaagattattaatatagagaaaaaataaagaaatagatgtaaatgtgtaattttcagttcactgggaggacctagaagcaatgactctctagtaccaataagcatacctagagttgagattttggtttctaaatgccattctccaattaaaaaggaatcaaagcacctcagataaatgtttaattccagggctggggcagggaaagtgaaagagaatcacagaacatcctgtaatgacagaaaaaagtcacaataaatggtgggattatgtcaaaaggacatgggattcaacttgaaagatcttccaatagccaaatctgagaaaagttaagcaacaaaaaaaataacaaaatcttataatctatagaaaaaatatgaatgtataaatccataatgatataaatatatttagaggagaagggaaagcacttactttcaggagaattccaactaataaatgaggaaggatcatagaaatggaaagatcaccatttggcaaatgctagagttataactgtttcagataagaattatcaatggatactaaaattaatggaagattatataaaggcaaaatatgagaatatttacacagacttgaaatatcatatgggcaaccacagataattatatattacaaagggaaaaaatagtaattttataggggaaaaatgtggcagataccaccttaaccaagtgatcaaggttaaaatcaccagttaaggggccaaatcatggaaattcactgaggacacatgactttgatgttttgctaaaaatgcctaacctgaatttaaccatgaaaaatgcaatacaaaaccaaaatgagagaggatatacaaaatactgacaagtatttgtcaaagtgttcataagttccagattaaaagtaactaaatgcaacatgtgatcctgaattgggttttagaccagaagaaagacatcagtgggacaactggtaaaatttaagtacagttaatagattttataatagtaatgcctgatttcctgattatattcatgttaatttcttaatcttgattattataatatggttacataggtatttgtatttgggagatcagggtgaagagcacatgggaattctttgtactagttgtacatcattttgttaactctgaccttatttcaacatgaaaaactttaaatatatatgtatatataacctaacactctgaagctccttcctggtgatctcttctgccatctgtgaagcccgcaatttctcttcatactgatccttttcagattgcctccagacatcatgttccactttcattttctccaaatctgctaatctgttctcgagttctaacctaaaacaagagatcataattatgttacaagaactataataaagatgatatgacagcaaaatgttttcatttgcaaggatatttaagtcaaactaaggtaattaagtacttacttttcatcttgtaataccacaagtttttgataaccttcttctttggcagcttgtactttacgtattaattcacgatccttttctactaagagcactttgtgatgttcaacagctgctttgagaatttcattgtctgactgtaatcctagtgtttttcaaggagaaaagtgtactatattcaatgttattaagatgaaaaatcacatttaacagcaagcattcataagctggtaagacaaatgaatgtagaaagtctctacaaatatatattctcaacaatactcacatcattaataaacactcttaaaataagaatgaaacaggctaaaactcagagcaaattttcctgtcactgtttatttagtgcatacacatataaaaactttaataaaagctgtatacatttactcattcgaacattgagagttgagatcaaactggatgataaccagaggtttacttacttcacctctaaagaggttctgtgacctaagcctcatagaaaaagctggctgatagcagagtgaaataaatcacaaaacccttcaaaacctattgattctagcagaattgctagatctctagcagaagtataaataacatggacactttcaagtttgtacaatgaattcagaaatctttgcaatgaaatggcaaatactttgcagatggaataactaaagcaaattcacatctaactcaaagtgaaaacaaaatgcagcattctttaagttcctaaaaaaatttacttcttaactctatggaaatccatgagtcaataaatagaaattaacaattggaaaaaatcattcatagcagccagacacggtgttagcacctgtagtcccagctactgaggaggcttaggcaggaggaccatttgagcccaggagttcaaggctagcctgggcaacatggtgagaccccatttcaaaacatgaaaggcattcatcataaactctgtctgaaatgagttcaactacagatcaactcaagcatagctacaggccaaaggtaagcttatttaaatacttcaagttagaaacaacataaataatgaggaaatctgatgagacagatgttccaagattaaactggaacttaaaaataagcctactcggctgggcgtggctcatgcctgtaatcccagtactttgggaggccgaggcaggcagatcacgaggtcaggagatcaagaccatcctggctaacacggtgaaacgctgtctctacttaaaaatacaaaaaaatagccagcctggtggtgggcgcctgtagtcccagctatttgggaggctgaggcaggagaatggcgtgaacctgggaggcagagcttccagtgagccgagatcacgccactgcactccagccagggggacagagcgagactccatctcaaaaataaaaaataaaaataaaaaataaataaataagcctactctgcactaggctacaatgaactggcctgaggtctacataaaaaaatctttttaattgaaaaaaattaagcctggaacccaattatcttcctcacattctccagacttaaaatgtcctgggactaataactacaccataaatagatttaaaatttataaatcaggaagtatggcatcccatttacaaaattcatttatgtatccaataactatgataaaaacataagactgatttttttaaagttattaaatcttacaatgaacaaaacactcaacatataataaacatttcatatgtactccaaaattaaaactaaattaagttgaaaatttggaaataaaaattcagattcaactattttaataatttgagttcatatctgaaaataagcagcagcagcagcagcaagggaaatcacatattaccatccagttcactttgaatcttattcctttctctttctagctcactcttagctcttgctgtctccagtttgatgtctgttatttccagtttgtttgaatgtttaagttcttttacctgttgataattaaaaactgaaattactattggtcattttcttgccattcaatacttaccccaaaacataagtggaaacaagaaaacgctctggtagtaaagtagagtctaagtatcttccaagaagaaagaagtgtcagtgcctgcaacagtacttcaagtaaggagacattaagaaaatactgttctttcctaacagaacagaggcatttctttacgaatatctgtgtatggtcctttggcttaatcttgccttaaagacttaattacaagtatctaaaatcaactactcaatgattggaaaatctgcaggggaaaaaaccctgaaacttttaaaatttgttaatatttctaaaagacagggtcttgctatgtcatccaggctggagtgcagtggcacgatcatagctcatttcaacttcaaactcctgggctcaagtgatcctctctcctcagcattccaagtagctgtcaggactataggtgcacaccaccacactcagataatttttcaatttttttgtagcaatagggtcttgctatgttgaccaggctggtctcaaactcctggcctcaagcaatccacctgctttggcctcctaaagtgctaggattatagttgtaatccactgcacttggcctgaaaccttccttttaaaaagtgtccacagctggatacagtaacttgcacctaaaatcccagctactcaagaggctgtggcagaaggaagtgtttgaggcctggtgttggagaccagcctgggcaacatagtgagatcctttctctaaaaaaaaatttaaaaattagccagacatgacatgccccttagtcccagccactggggagactgaggtaagaggatcacttgagtctaggggtttgaggctgcagtgctatgattgtgccaatgtattccagcctgggcaacagagtgagaccttgtctctaaaaaaaaattaaaattaaatttaagaataaaaaatgtgctggggacaaagaaggtattctaggtagaaggaacagcatacaaaatgttattatatgtataacatcacatggtctgctcttaaaacaagctaagcattacatgtagagcaccggaagatgtgaaatctgtggaggaatggcagggaataaactttatataccatacaaaagggttgtttttcaggttagctgttgaaggtggcacaattaactaatgcgaatctgttggcttaagaaactgaaggtaaataaatcaattaagaggcaagaaatgaataaacggaggggggaaggaagaatcaattgaatctggtgacaaaatagtgtaatgtgtatagactgtgtctgtgtgcgcatgtgcacaagtattaggtaggggattgggggcaggaacaagtataaatcatataaattcattttccatagcccttctctttggtaaggagcttctaaaattagatatagtcatataataaggatttaatcaatacaaacacaaaggttagattaacccattttctgatatattatccaaatatataaaagtatggaatcagagtaggaaactacaaatacatacacatcaaatacagaaaatgtgagatggcagaaacaggaaaataaaagacaatttacttaagagtccaataaaaccccataaatactggagttgggagtcagacacaaatcaaaaaaaggtcctagagccaaagagggcaaggataagaaatagaagtgtcttattggaagatattccatcaacaaaaggtcctgaaaacgtttcaaggaatagtttcatgcaaaatcctcatccaaaggaaataaacagaaaagtgagtactgccttatgtactggtaactacaataagacatccctccaaattaactcgtagatttttaaatgaccgtacataaaatggtgaccctgtgctgacatcagttttgcatttttatttatttattttctgagacagagtctcgctctgtcgcccaggctggagtacagtggcttaatctcagcttactgcaacctctgtctcctgggttcaagcaaattctctgcctcagcctcctgagtagctaggattacaggcatgcaccaccacacctggctaaattttgtatttttagtagagatggggtttcaccatcttggccaggctggtcttgaactcctgacctcgtgatccatccgcctcggccttccaaagtgctgggattacaggcgttaagccaccacacctggcctgtggttttaatttccttttggaagttattttctataaaagcaagttttataaaatgatgtttacatgacaacagctgataatttgttttaatacttaaactttctgtagattggattttactacattataatttcatggacagatagaatttaaattataaatactttaaaattttgaagaaatatgattacaaagaaaatccaatcactatgacaaatgtaattataacctgctattatatactaactgtaaaaggttaagaatgacacagcatttcattaacaaacatactatagctgcatgaggtggaaaattagagccatcttatttcataggaagttgattcatctcatggtaaaagatctacaaaaacttatttcttattcatttcaccctgaaatttactgaaatgagacgacatttttaactaaactacaattattgaaactgaaagaacaccgaataggaagtcaagcaacaagtgaggtctgtcttcaggcctacttttgctgttaaaccagtggtatatgctcaagcaatttacctgtcctctctgcattcaaatgtactcatttatggatctaaagtttttctttattgccttatttctattatcctaacatcactgatgcatcacttatatgaacactgttaatttcctaaaaatatactaaaaggaattttacttaacgtatgaaaatgtattacccagtaatgacaaataatagcacttttctatgagtaatctgaaccaaattccaaatgttacagtaaagtttctttctgcccctagatccttggttcttaatcttctttgtgatcaagtcccaaatcctaggaaaattagggattttttttttaaataaaatgctcatgttaaaatgttgcataaaatttcaagcaattcatggtctcctaaagctccactggaccaagtcaccctgttcttcacagaatgtttgccatatagattctggcctttatgttgtgaatttgctttatgttttgacacaatggaagtattcagatattactaacaaaactttaataaatgtcaaaactggcaaaactgggcattttacagggggtcagtatctgttaaagtacacatactcacagaaagacacacaagagcacagcataaataagcaagaaatggaaatataattgacaatatgtattacctaagaagctctggatacagattccaaagagatggtacttaaatcttgatctttttcaaagttctgagatgtaattacccaattaatttaggtaaataaggacaactctgttgggtggctttcttaaaactaccttttattggcattctgaaaatgaaaaaccttatgagggaactagaagaatttacctcactgaatgtgaaatctctttaaggtcatcattttcaggccatctttggtaataccttttaatccaagacactgatactcacactgacataactttgttctaaaatctgacaaacatttatgaatttgagtaactaagacaaacacaccccaggtgttcctttgcactgcaaacaaccatttgctagaattgcaaaatgttgatgaaaacttcaagttgcaaagaaaactgtggcagtcatgtttgaaatattattttaaaatctacccttccaatggaatctttacatacaagacttcaaatgaaacttggtttgtttaaagttgaaggatggtatttaatactccatttatatgcaaaataaggcaagtgtgcctttaaaaagacaggcaactcttagcaatgtgtattaataaacaagcacagagaaataaatactatactagattgctgttctttcttcagcggagtaggagaaatcacctaggctctaactctaagaggaaagagcaatagggaagagtatatatatatggaaaaaaagaagaaaaatcagggtcagcacacaggtgagctagggagctcaggtaaaatgtactgcatgaaaagtattatacttggtggcccccccaagagagaagccacagcagaagccagcacatcccatgtcctattgcgacatctgtggttccaattattccagcagtgtagtctggctactcaggtcaagaacaatgtgctgcaaatactacgtactcaatattatttcacaaaattgaaaataatttatactggaattggaagaaaagcatggaaactccccatatcctgaatttacttgtgttttgtatctatttttttgtatactctatagttataagctttcaatgtgtatctgttgaatatataatctacttacagttaatcaggaggcaatcaaattatttcctagtagttcttacacagtcttagtaggctggaagggttcttacagatataaggaaattggatcctaatgatattaggtaacttgccttaggttacacatagttattgagacagtgagacacagactagtcaatggactaaaaattctgtattctttatgttacaatattttcttatttaaggatatcaccagtgtataatcactgctattatcattttcatcatcagctacatttaatttttgccacaactctgtaatgtaggtattagtcccattgcatagacaaaggcacttaagtttcagagagacagtgaactgcccaaggtcacacagctttttttagtaatgaaaaaatcagaatttgaatccagtctgttaaggagaatataaatgtagatcatgctgctactactaatttattcattgaagaaatatttgagtacctactatgtgccggcaccattctagaagctggaaaagcagtagtgatgaaaacaatgtccctgctctcttggagcttacattgggttgaggggaaggtggtgggaaagaaaaggagagaccaaaaaataaaaaccaaataactatatcagatagtattaagagctatgaagcaggtaaggaagacagagagaaagacagaggaagaaggaagatgctgttttacaatgtgaagacaaggaaagcctccctggttaggcaacatctaggtggtgaagaagcaagttatgtggatacgtgagggaagactgagccaaactcagacaagtgcagaaaccctgagcaagatgtgagtttgctcaaagagtgagaaggccaaagggagcaaagtgaacaggaggaaaaatacaggtcatggctgtgaaaagactgcaggatccagatcatacagagctctgaatgggtagaaagcagaaagaccagttagcaacctagcacagaaatggagcctagaaaaatcatggcttggactggaatagtcacagtggatgtcataagaattgatcagattctgcatgtatttggaaggtagaatgataaaggattaaaaatatttcaatacagagaactaaacacaaaatttgtcactgtacagtatcaagcattctaaagaatgaaatagaggcataagataacatactctactgatcaatgtatttatttcttagaaggcagaatgatataataaaacatttcagtataaagaaatcaattattaaaaataaaatttatcattatatactaacaaacattctaaagaatgaaacagaaacataaaacaacttactttactggacaatgtatttatttctcgttcagctttatgcaatttattaattaaaaaggtattttgttcactgcttgattgtagctctttttccaaacgttctgcccgtaaattagctgattgtttttcagcctttcatacaaacaaaatagtttaaaattcatcatttttcaagtatttcaaaatcaaataagcactatttaaaatacatttataattatactaaaattattcaaaacctcaacttaacatataccaatgtaacaaaaattttctcaaactaattggcagaattcaaacgaaagatagtgttccaggaaatatgcaacaaaggcatctagacaaacaacatatgaatgaccatcaataaaataaagtttatacacttctctcacgacagaaagtacctaaggcattcatttgatgtctatttactcttaacactgacttatttcaaacattttggaagtttccagtctataacagataagaaaaagcatattagaaactagaagacagggctcattgatagtaacaagtaaaaattgaaaatctaaaatcaatgattttaaaaaaagaaacagggaaagatatgatttcaaaatcctcagctcatctgcagactttttaagtacgagcaaagaggctcttgatctcatgacacaattaagattgttaatgaagtctgcaggttgtcaaaaaagtttctggatggtaatatcgatagtactctttcatgaggggagggaaactaaaatcttttttgaaaaaacatgtctattcaacataatatatatacatatatacacacacacacacacacacacacacacacacacacacacacatatatatatatatattttttttttgagacaaggtcttgctctgtctcccaggctgcagtgcaatggcacgatcttggctcaccacaacctccgcctcccaagctcaaacaattctcctgcctcagcctcccgagtagctaggacttcaggtgcacaccatggcacctggctaatttttgtactttttgtagagacagggtttcacccgtgttgttcaggctcatctcaaactcctgagctcaggtgatccagctacctcagcctcccaaactgctgggattacaggcataagcgaccacacctgacctcaacataattaaaatgaagacattttggcatttaaaggataaatttcagttttataacatctcatttcgtacatatagatgctgttcgacttatgatggggttacatcctgataaacccatcacaaattgaaaatacctaagtccataacttagactagcctaacttaagcatcctcaacacacgtgcattagcctacagttggaaaaaatcatttggcgacacagtactctgtaaagaggttatttaccctcatgaccacatgactgactgggaactgtggctcagtgcagctacccagcattaagagtatcacaccacatatcagtaacccaggaaaagatcaaaattcaaagtacataaatgcatatatggctttcacaccatcggacagtcaaaaaatagtaagtcaaaccaccttaagttggggaacatctagcttaaatgtggtaaggactatattcgacaaacaattagggaaaaaaactattttcttcatatatgaaataatactctctgggcacaatgatagccaagaaagttaaagaagaaagaaatgcttgctgtcatacgcttattttcatttcatctgacaaataataaaattaaatataggctcttctgaaaatgtcacaaataaatcttctgtcatcattcaacttgccctgaaaataatcactctaaaggacctcaatggaaagtttcacatcaggactgtatgctatattcaactgcaatcatctcacttattctgtcactgtgtaaaatacattaaggatggaaggatggcaacataaatagtctcacaatgaactgcttcatgtttaaggtacaatgatactgacaacttttaattcagaaaaccagtaaatactgacagagcgtcatgtaacaaaataaaaagtaacttctactcttcaaaacataccattgtactcctgtaccactggctggggaaaaaaaaaatcaccatcttggatttggatattgattttaactacaaattaaatgcccgctaatgtcccccccacccaaatcattttataactattccaaaggaaaaagaaacactttgaactatacaaaataaataaaaacaattaaacaggtatgtttgctacaagttaggcactaagaactaagaagaataagtgtatctgaataaaatggaaaccaagaattttcataaggcaatacccgtaggagtaccagtcaggtctgccaacacttatctttctctaatgaacccagggaaataattctgtaaaggcatgtatacctttacagttggattttactactctggcaagaagctgtcgtaagatacatcagtatggtatttctgttcaaacaggatttgtgactttaagacctcaaatcccagtgtaaggaatgtactatcttgaaagaaattattctttctggtttgagatgactttacgctcagaaactcaaatacatatatttttattttgcatattctattatgtggcattttaagagttaagacatttcagataggtgacttgactcccaaagaataaatacccctttgtaaatgtggtagcatacgtattgcttatgaatcaatagctttcttctttactaaaagaataaatactcttgggattacacaaatgcatcagcattagcttggggggcatacatttatgctctaaaaatcaaaggcttgtcaactgcactttaaaaaagtatgccatactctactgggaagtaattagaatcttacctccagggatctgactgtagcctgcatctcagccaactgccgcacctgtattctttgggcattttccacctgagcctcagaattctccttttcagcctttaattccgctacttcagcctctaaaccttttaatttttgacacaaatagactttttctcgagcaagttgttccactcgtttgctgtcttttgtgagatcaacattaagcagctggttacgtagttcttctttatcttcctccagtcttgcaatctaataataattttaaagaaagcatacaaggttaaattattaaattttcagtcatgaacatgctttacaagtcagtaaaattaaaaaatgcacaaaatcaaagctcaggtgctgaaacaaagtacaaaggaaaaaattttaagtatcactatctttttgttcttagtgggactcaaatgtgaggtcaaggactgtgtcctgttttccctgtatctccacgtggtgtctagaacagggcttaatcagttgctgactaaaatttaaaattataatactgtaagtactaaacatacatcaagtattttaaaattcatcataacattataggggttcatgaccaaaactctgactactccaaagcttttcctcacatgactgtaattcttgagctagtctatactaataaaattatctatgtcagggcaacttaattcacacaaaaactgcctgtctgtgtacataaaagcaaatgtgattgatgagagtttttaaatgatagctgagagtttattaaagtcctaattgtaatgatggcctagttcttagttcttagattcaagaagaattgaaaaatcattactccagggcaggtgttaaagtcactggggaacttgcagagcagagacaccagtggtcttgtcattcatgccaattatcactgctggacttcgtgggcctccaaatcagtgggtttcaaactgtttcctaacctctgaggcatttcagaagctcctcacctctggagaccaggggcaagcaatcagggtctagaactcattctttccctttcctgatctccccaactatctatcccctaccaccacccccaccaaatttctggcattaaccatacgcttctatttttagtctctttctggggtttcttcaaatgattcaacttaagtaaatgattcagctgggttttttgtttgttaagaagaagttgaaaaccactgctcaaaacaggacaagaggttgtttgtagccaggatgaacatcaaagactcactgtaagctccccggccctgcaaaaaaaaaaaaaaaaaaacaaaaaacaaaaacagaaaaaactaaagaaatgctccaaaaccttaggcaaaagtggtccaagaaacaactgtttgatcacagcactatcaatgaatctaaaaagtttaagacctccaccccagggcaggatctgttctccacacctgtaaaatgggaaactgaattacatgcactctaacaacctttttagttttaacacatagtgattccagtttgtttttggacatgctgaatttaaatgccaatgagaaatataggtagagctatccagcagacaaatattattttgcagagaataaaatttatccttgaaggcagctgtggcatttagagttaagtcctcaaaagcccaactaattagtatttctctcctatttttcctcccacgctttacaaataactattacttcctggtttggtcccggattacttttttatccactgtattctgtcctcagtttaaatgaagaacttgggctagctgatctttaagatactgtttaccttttacatgaggtaacctgatatggttttaatgtgctatattagaggtgtgatggctcatctaaggtcaggagtcaatgtgtaactcaagttcagacaatggtgccctttactgagtacttactatggatcaaatactgagctaagtgctctacatgtaaaatcaacattaacaataatttctcttgtagtccccattttacacatagggtcacacagttcacaatgttcttgacctgcatacttcccatattattgctttctttccacgttttgggaggcatctgtgtgatagctgaagtgatagttgaagctatgagactggatgacagctagctgatgactgaaaattagattccatgtttataactcctaaaccagacatatcaaatcattcttacaaaactgccatctaattttgctattcatttatttattcaggcaacaaatatttactgagtacttactaagtacccaaaactgttttaggtagtaaggatacaacccagcagataagcaaacacaaaacctctgctgatgcagagcttattacattcaatcactgccataacaccacttgtgtcccagacatttggcacagatcttggatacagcctcagctctttctttttccgccattctcaatcagacttacatgtcatcttccttgatgtcctcaatttcttgtgctctcaatctttcctctaaatttccaaagggctttgtttaaatttctcttttatgaactttatttaaatctgcctgtattgcagctacctctacatttactctattctattctaaatacaaacttacttgacagataagacaatgtgttaactaatattactttttaaaaagttattgaagtaaaggaaactaaacagaaacaatagggactaggaatagtgactgatttccttttcaaaaaatgatagcacttcaattccccaaggcacacaagagggaaaggtagtgttacctaattactccatccttctttgttgttattacctttacgatataacatagggatatgggtaagagaaaaggctctggaatcaaactgcctaggtttcttttttcttttggtattttaaagatattgctttactgtcttctggcttttattacttgtaaaaataagtctgtcgtcattatctgttcctctgtataagatgtcttttctttcttcagttacttcttttaaaattaaactttttcagataatggcaggttcacaaggaattattataaggattaatatagcgggatcctgtatatcctttaaccaagattcccctattggtaacattcctcttccctttttggggaagacattatgtagaattggtactgatacttctttaaacacctggtaaaattctctagttaactattcattttgggagttttaaaattacagattgaatttccctaacagtaataggtctatacaaactgccaatttcacattaaatgagttgtggtcgtttgtgccttttaagaaattgattcatttcatctgcattgtcaaatttattagagtagagttgttcaaaggattatctgatttcccttctaatgtctgcaaggtcatgagtgatactctttcattcctgagataggtaaaatttttatcttccatcttttttgttagttttgctaaaagttggtcaattttattgtcttttcaaagaaccagctctttgtttcactgattttctctattatttttgttttcaatttctgctatgtttattatttccctccttctgcttgctttacttttattttgatactctttttctaggttcttgaggtgggagcttacattactgacttgttccctcatttctaatgcatgtatttagtgctataaatgtttcttggcactgctttagctgtgtcctaaaatttttgatatgctgcattttcattttcatccaatgtattttttgaaatgtaatctcattgaaatgtttttctttgaaatttccaccttgacccataaatttttttaagtatgtcatttcatttccaagtgtttgaagatttccctgttattttctgttattaatttctagtttgattctattgtggtcagaaaactcactcattatgatttcaagttgtataagtttgttgaggtttatttcatagcccaggatatggtctatcttgtatatgttcagtgagcatttatatacattcagcgaatacttcaaaagaacatgtctgggtgttctccttgggtggcatgttttataaatgttatttaggttctgatggttgatggtgttattgcgttcttatttatccttgctgatttttaattgttctatcacttgttgagagaggggtatgaagtcaccaactataattatagatttgtctatttcaccttttagttctttcaatttttgcttcaaacattttgcacctctggtgcacatacatttagtattcctgtgtcttcttgctgggttgacctcttttgtcactatataatctctttctatataaatctggtatttttctttgttattttcctttgccctgaagtctgctctatctgatattaatactgatgctcctgcttttaattaatgattccatgatatagctttgtatatccttttatttacaaactgcctatactgttatacttggagtttcttatagacatcatacagttaccccttgacttatgatgcaattacatcccaataaactcatgaaaagtgaaaaatgcagtttatgccggcaacacagcatatggaccctgacttatgatggttcaagttacaacttttcaactttacaatggtataaaatgacatgcattcagtagaaaccatatgtcataaggagcaccctgacttacaatggagttacatcccaataaacccattgttaagttgaaaaatcatccaagttcaaacactgtaatctggggactgtcagtacagttaggtcatttttaaaaatctacactgtaaatatctgtattttaattcatgtattcagaccatttacatttattatgattgatacgttaagccattttggtctgtttcttctcttagtttctctgttttctttttcttgcctgttacatgaacatatttcaggattccattttatctataatgttttaaatgtatctccttgtatagctttcttagtggttgttctagttattatatttatgtaacttatcatggtctactgaattcattttgtcagtttgagtgatatgtagaaacttcacctccttttatatccctttgtccttgctcatttataatataattacctaaaatattttctctatatatttagaaccacatcagagttaaaatttttacttcaaccaccaaacaaaatttagaaaattcatgaagcaaaaggaagtctattacatatacccacagttctgtttaccatgtacatttatccttcctaatactttgagattccttctttttactgttttcttcctatttagacaaacttctcttttggataggtctactggcaaaaagttccttcattttccttcatttgagaatgtcttgatttcccctacattcctgaaggatatttttgctggatatagaattatgagttgacagtccttatctttcagcacttgataatgtgccacttccttctggcctctgatttctgatgagaaatgagctagttttctaattgttttccccaatgggtaagatataatttcttgggctgctttcaagattttcctatagtttttttttaaacctgactatggtatctcttgctgtgaatgtgttcagcttcttgaagctacatgtttgtgcctttaccaaacttggaaagtttttagtcattatttcttccattaccttctcaccctgccctcttttctcctttcagggacagaaatcttagatcttttgttatagtcctacaggatactgagaatctgtttatttgctttttaaatctattttctctagtctgttcagattgggtaatttctaatgttctacctttaagctcagtagttttttcctctatcccttccattctgcagttgagcctggcaactcaggctttcttagtcactctttcagttctaaaatttccaattttcttctctttattctctgtttctttgctaagtcttttgggttttgtttgtttgtttgtttcaaccacgtttataattcctcattgaatcattcttaccatggctgctttgaaatgtttgtcaaataattctaacacctctgcatctcagtgttggcatctattagtgtgttttacattcagtttcagaccttcctagttcgtggtgtgacaagcaattttcaatggaaacttggacatttggggaattaagttatgagactccagatcttaaacaaagtttgtattagctggctttttgtgatattgctatggtaggggatgggtggtgttgccacctcattactaccacgaggaggtagtagtcccgattctccactctacttctgttgatacccaaggtgggagggcttctcatgatacccataatgaacaggggtgggagttctggttccccattaggcctcaactgacacctccctggatgggaagcgtaggagtaatttattattgctcctcatgttacctccatcgataccacagggccagatgtggcctccattgataacacgcagctgggtagtggttaaagtcctgaccctgtactaggcctcctctgacatgacccaggatgtcatgtcagagcaggatgagggcagggtacctcattactgccagttgagagtggatgtccaagctcctcatactgtctctagtgacagcatggcagaggatgggagcccttgttattacccaggtgaagatgtctttgtctggttttggtattaggataatgctggccttgtagaatgagttaggaggcatttcctctgattctgtcttctggaagagattatagagaattaacataaattctcccttaaatggctgatagagttcaccaatgaacccacctgggctgcccagtcatttctgattggatgtcagacattgtgaatttaatgtttttttcagagctggattctttgttttcctttacttatttctgaatcttcattctggaatgcagctaagatatagtaatgagccacataatgaagtttcagtcaacaacagtccacatacatatgacaggggtcccatgagtataatattgtatttttactgtttaaaccttttctatgtttagatatgtttaggtacacaaatattaaccattatgttacaatgcctacagtattcagtacagtgatatgctttacaggtttgtagcctaggagtaataggctgtaccatataggataggtatgtagtatactgtgccatctaggtgcatatatgtatagtccatgatgtttgcacatgacaaaatcgcctaatgacacatttctcagaacatatccctgtcattaagctacacgttactgtacttagaaacagtctgatcttttcaaatcttacttttattcttgttaaccagaaccagaatagcctttagtctatggctaatttggccctgctactgaggcaaaatccttctgagatttctactcaaagtactatgcattaagagtatctttccactctgtctaacggaaaaataaattttcccagtcccatgtgaactctagagactgtcccacctaaataattttctttctctggccttgtatagtttcctccacacatgcgctaatcaatactgcaaagttaccctctgcagaactctggagctctgcaatactctgcttttcaaattctagtttccttggcctctcaaattctgaactccaactcctcagctcaaagatcatgtagctcaatttaggttttttatctctgcacagtggcctggaaactctccagaacctaagatggggcaatcatagagctcttatcatttgttttccttccctcagatctgccctgtgctgcctattttccaatgtctgaaaactgtggtttcctatttttgtcccagttttcagtaaacgccttaaagtaaattccatccctattccatcctagccagaagcagaaatccccagactacttagatttgaatcctgaccatatactagttgtgcaaccttgggccagtctctcagtgtttttatcttctcatttataaaatgaagatgattatctaactcctagcattgttgagatgattttttaaaagtatatataaagatactggtacaaaaacagacacacagccaaatggaacagaatacagtaaccagaaataaagctgcatatctacaacaatctgatgctcaacaaagttgacaaaaacaaacaatggggaaaggactccctatttaataactggtgttgggaaaactggctagccatatgcaaaggaatgaaactggatctctacttttaaccacacccaaaagataactcaagataaattaggaaataccattctggacattagccttggcaaaaaatttatgactaaatttatgaccctctaaagcaagggtccccaaaccctaggccatggaccattaccagtccatggcctgtcaggaatggggccacacagcaggaagtgagcagcaggtgagcgaccattactgcctgagctctacctcctgtcagatcagtgggagcattagattctcatagtggtgtgaaccctattgcgaactgcacatctgagggatctaggttgcatgctccttatgagaatttaatgccctaatgcctgatgatctaaggtggaacaatttcatcctgaaaccattcctcccagagccttggttcatggagtaattgtcttccacgaaaccagtccccagtgtcaaatggcaccagggactttggggaccactgctctaaagcaattacaacaaagacaaaaagtgataactgggacctaattaaactaatgagctttggtttggcaaaagaaactatcaacagagtaaacagacaacccacagaatgggagaaaatacctgcaaactatgcatctgacaaagttctaatatctagaatctataaggaatttacataactcaacaaggaaaaaacaaccccataataaagtaggcaaagtacataaacagacacttctcaaaagaagacatataagcagccaacaaacatgaaaaaaatgcttaacatcactaatcatcagagaaatgcaaattaaaaaacacaatgagataccatctcacaccagtcagaatagctattactaaaaggaaaaaaaaaataacagatgctagcaaggctgcagaaaaaagggaacattatacactattgatggctacgtaaattagttcagccactgtggaaaacagtttggagatttctcaaataactaaaaatagaactaccattccagcaatcccattactgggtatatactgaaaggagagtaaatcattctattaaattgacacacacactcatatgttcatcacagcactattcacaatagcaaaaacatggaatcaacctgggttcccatcaatggtgaactggataaagaaaatatggtacatatacaccacggaatactatacagccataaaaatgaatgaaatcttgtcctttgcagcaacacagatacagctggagactatcatccaaagcaaattaacaaaggaacagaaaaccaaataccaataccacatgttctcacttgtaagtgggagctaaacactgactacatatggacataaagatgggaacaatagaactggggactaccagagaggggagaggatgagggggaaagggctcaaaaacttcctattaggcactatgctcagtatctaggtgacggaatctttattaccccaaagttctgcctcagcatcatgcaatacacctgtgtaacaaatctacacatgtaacccctgaatctaaaataaaacttgaaattattttttaaaaaaagaaaagttaagtagaataaagtattacaagtagtgaaaagagaaaataatttggaaacttttttttacactgactttaatttgtgcttttgatgaaaatacatttcactttttacattttgaatacaattgcattttaattctgtgtgttattattaatggaaaacaaacatgtaaaaagcttctttacaagagtatagtgattttgctaaattgaaaaaaaatgtggctgggtgcagtggctcatgcctgtaatcccagtactttgggagtctgaggtaggtagatcacttgaggtcaggagttcaagatcagcctagcccacatgacgaaaccccacctctactaaaaatagaaaaattagctgggtgtggtgatgcacacctatactcccagctattcaggaggctgaggcaggagaattgcttaaaccaaggaggcagaggttgcagtgagccaagatcgcgccactgcactccagcctggggaacagagtaagactttgtcttaaaaaagaaagaaagaaaatgccatgaaataaatatgtaataatctttaaactatatataaagtgtttcactgaataaattaaaggtaaatgggtctcctgtctctatttctttctttcacttcttcaacttctgtaaattctgatttacaaatctgaaatcaacttaaaagtatctgtatatttattatgttaattggtaccatgataataactgtgaggtatgaatgatactaataccattaattaagtatctactatgtgtcaggcattatggtaagtattttgcacattaagtttcaagttcccagatcttagtttttaaattattacattaactttttatattacttaagaaaacaataggagacggttggtccaagatggccaactaggaacagctccggtctgcagctcccagtgtgatggacgcagaagatgggtgatttctgcatttccaactgaggtacctggttcatctcactgggactggtggacagtgagtgcagcccacagagggtgagctgaagcagggcggggcatcacctcacccgggaagtgcaaggggtcggggtatttccctttcctggccaagggaagctgtaacagactacctggaaaaacaggacactcctgcccaaatactgcattttcccaaggtcttagcaaccagcaaacaaggagattctctcccatgcctggctcggtgggtcccacgcccacggagccttgctcactgctagcacagcagtctgagatcgaactgcgaggcggcaccctggcagggggaggggtgtcccccattgctgaggcttgagtaggtaaacaaaacggccaggaagctcgaactgggcggagcccactgcagctcaacaggacctactgcctctagacaccacctctgtgggtggggcatagctgaacaaaaggcagcagacaacttccgcaaacttaaacatccctgtctgacagctctgaagagagcagtggttctcccagcatagcatttgagctctgagaatggacagactgcctcctcaagtgggtccctggcacccgtgtagcataactgggagacacctctcagtaggggccaacagacacctcacataggcaagctgaccctctgggacgaagcctccagaggaaggattaggcaacaacatttgctgttctgtgacgtctgctggtgatacccaggcaaacagggtctggagtggaactcccgcaagctccaacagacctgcagctgagggaactgactgttaggaggaaaactaacaaacagaaagaaatagcagcaggatcaacaaaaaggtcacctacaccaaaaccccatctttaggtcaacaacatcaaagaccaaaggtagataaaaccaaaaagatggggagaaaccagagcagaaaagctgaaaactctaaaaatcaaagcgcctcttctcctccaaaggatggcagctcctcgccagcaatggaataaagctggacagtgaatgactctgacaagttgacagaagtaggcttcagaaggtcagtaataacaaacttctccaagctaagggatgatgttcgaacccatcgcaaggaagctaagaaccttgaaaaaagattagatgaatggctaactagaataaacagtgtagagaagaccttcaatgacctgatggagtgcaaaccatggcacgagaacttcgtgatgcatgcagaagcttcaatagctgattcaatcaagtggaagaaagggcatcagtgattgaagatcaaatgaatgaaataaaccgagaagacaaagttagagaaaaaagagcaaaaagaaacgaacaaagcctctaagaaatatgggactatgtgaaaagaccaaatctacgtctgactggtgtatctgaaagtgacagggagaatggaaccaagcaggaaaacattcttcaggatattatccagaagaacttccccaacttagcaaggcaggccaacattcaaattcaggaaatacagagaatgccacaaagacactcctcgagaagagcaactccaagacacataattttcagatgcaccaaggttgaaatgaaggaaaaagtgttaagggcaggcagagagaaaggttgagttacccacaaagggaagcccatcaaactaacagcggatctctcggcagaaaccctacaagccagaagagagagggggccaatattcaacattcttatagaaaagaattttccatccagaatttcatatccagccaaactaagcttcgtaagtgaaggagaaataaaatcctttacagacaagcaaatgctcagagatttttgtcaccaccaagcctcccttacaagagctcctgaaggaagcactaaacatggaaagaaacaaccggtatcagccactgcaaaaacaggccaaattgtaaagaccatcgatgctatgaagacactgcatcaattaacaggcaaaataaccagcgaacatcgtaatgacaggatcaaattcacacacaacaatattaaccttaaatgtaaatgagctaaatgcaccaattaaaagacacagactggcaaattggataaagagtcaagacccatcagtgtgctgtattcaggagacccatctcacgtgcaaagacgcacataggctcaaaataaacagaaggaggaagatctaccaagcaaaggtagatcaagcaaaaaaaaaaagcaggggttgaaatcctagtctctgataaaacaaactttaaaacaaagatcaaaggagacaaagaaggccatggtaaatggatcaatggcaaagggatcaattcaacaagaagacctaactaacctaaatacatatgcacccaatataggagcacccagattcataaagtaagtccttagagacctacaaagagacttagactcccacacaataatgatgggagactttaacactccactgtcaatattagacagatcaacgagacagaaggttaacaaagatatacaggacttgaactcagctctgcaacaagcagacctaatagacatctacagaactgtccaccccacatcaacagaacatacattcttctcagcaccacattgcacttattctaaaattgaccatataattgaactaaagcactcctcagcaaatgcaaaagaacagaaatcacaacaaattgtctctcagaccacagtgcaataaaattagacctcatgattaacaaactcactcaaaaccacgcaactacatggaaactgaacaacttgctcctgaatgactactgggtaaataacgaaatgaaggcagaaataaagatgttctttgaaaccaatgagaagaaagacacaatgtaccagaatctctgggacacatttacagcagtgtgtaaagggaaatttatagcactaaatgcccacaagacaaagcaggaaagatctaaaattgacaccctaacatcacaattaaaagaactagagaagcaagagcaaacacattcaaaagctagcagaaggcaagaaataactaagatcagagcagaattgaaagagatagagacacaaagaacccttcaaaaaaatcaatgaatccaggagctggttttttgaaaagatcaacaaaattgataaactgctagcaagactaataaagaatcaaatagatacaataaaaaatgataaaggggatatcgccaccgatcccacagaaatacaaactaccatcagagaatactatagacagctctatgcaaataaactgcaaaatctaggagaaatggataaattcctggacaaatacaccctcccaagactaaaccaggaagaagttgaatctctgaatagaccaataacaggttctgaaattgaggcaataattaatagcctaccaaccaaaaaaagtccaggaccagatggattcacagctgaattctaccagaggtacaaagaggaactggtaccattccttctgaaactattccaatcaatagaaaaagagggaatcctccctaactcattttatgaggccagcatcatcctgataccaaagcctggaagagacacaacaaaaaagagaattttagaccaatatccctgatgaacattgatgcgaaaatcctcaataaaatactggcaaaccaaatccagcagcacatcaaaaagcttatccaccatgatcaagcgggcttcatccctgggatgcaaggctggttcaacatatgcaaatcaataaacataatccagcatataaacagaaccaaagacaaaaaccacatgattatctcaatagatgcagaaaagacctttgacaaaattcaacagaacttcatgctaaaagctctcaataaactaggtattgatggaacgtatctcaaaataataaaagctatttatgacaaacccacagccaatatcatactgaatgggcaaaaactggaagcatttcctttaaaaaccagcacaagacaaggatgccctttctcaccactcatattcaacagtgttggacgttctggccagggcaaccagacaagagaaagaaataaagggtattcaattaggaaatgaggaagtcaaattgtccctgtttgcagatgatatgattgtatatttagaaaactccatcatctcagccccaaatctccttaagctgataagcaacttcagcaaagtctcaggatacaaaatcaatgggcaaaaatcacaagcattcctatacaccattaacggacaaacagagagccaaatcatgagtgaactcccattcacaattgctacaaagagaataaaatacttaggaatccaacttacaagggatgtgaaggacctcttcaaggagaactacaaaccactgctcaacgaaataaaagaggacacaaacaaatggaaaaacattccatgcttatggataggaagaatcaatatcgtgaaaatggccatactgcccaaggtaatttagattcaatgccatccccatcaagctaccaatgactttcttcacagaattggaaaaaactactttaaagttcatatggaaccaaaaaagagcctgcattgccaagacaatcctaagccaaaagaacaaagctggaggcatcacgctacctgacttctaactatactacaaggctacagcaactaaaacagcttttggtactggtaccaaaacagagatatagaccaatggaacagaacagaggcctcagaaataataccacacatctacaaccatctgatatttgatacacctgataaaaacaagcaatggagaaaggattccctatttaataaatggtgctgggaaaactggctagccatatgtagaaagctgaaactggatcccttccttacaccttgtaaaaaaattaattcaagatggattaaagacttaaatgttagacctaaaaccataaaaaccctagaagaaaacctaggcaataccattcaggacataggcatgggcaaggacttcatgactaaaacaccaaaagcaatggcaacaaaagccaaaattgacaaatgggatctaatttaactaaagagcttctgcatggcaaaagaaattaccatcagagtgaacacgcaacctacagaatggaagaaaatttttacaatctactcatctgacaaagggctaatatccagaatctacaaagaactcaaagttacaagaaaaaaacaaacaactccatcaaaaagtgggcaaaggatatgaacagacacttctcaaaagaagacatctatgcagacaacagccacatgtaaaaatgctcatcatcactggtcatcagagaaatgcaaatcaaaaccacaatgagataccatctcacgccagttagaatagcaatcattaaaaagtcaggaaacaacagatgctggagaggatgtagagaaataggaatgctttacactgttggtgggagtgtaaattagttcaaccactgtggaagacagtgtggcaatccctcaaggatctagaactagaaataccatttgatccagcaatcccattattgggtacatacccaaaggattataaattatgctactataaagacacatcacacactggggcctgtcagggggtgggggcctgggggagggatagcattaggagaaatacctaatgtaaatgatgagttgatgggtgcagcaacccgacatggcacatgtatacctatgtatcaaacctacacgttgtgcacatgtaccctagaacttaaagtataataaaaaaaaatcagacatatgaaaaagtaacaaattaaaaaaaaaaataatcactattatgatgagtttcctctttttcccttttatgtactataatttatttttcctaaattaatgatggcatgttttatacaaaaatattttgtcattccttacatgaagaaaatatcacttaaattacttacatacttaaagttcatattttggctgggtgtggtgactcgggacgcctgtaatcccaacactgtgggaggccaaggtgggcagatcatgaggtcaggagatcaagaccatcctgcctaacacagtgaaaccccgtctctactaaaaacacaaaaaaattagccaggcatggtgggtgcctgtagtcccagctactcgggaggctgaggcaggagaatggcatgaacccagaaggcagagcttgcagtgagccaagatggcgccgctgcgctccagcctggaggacagagtgagattctgtctcaagaaaaaaaaagaagaaataaaccccagcatttccagggaaccaggggagttctctttttgccataggaactttggctcctcacctgacacataaagccaaggaagagcacaaccagtttgcgaagcatgatggaagaaactcagtgacctgtcattatggactgtcactttgatggtttttcacaggatgtagtgctcctcgtccctccctctctcctgagatcttagtattttgtctccactgaattaccattgattatttcactcagtctaccattataattacctgcgcctacaactctgtattgtcattactatttccagaaaatatgagtcctaatataataaaaacaaaatagtcccacttttgaataatgactatatatgcaacttcagcatttcacctgtatgaagtcccagacttaatatgttcttacagtcacatgaaaaagcatgacttttttttttttttttttttttttttgagacagagcctcattctgtcacccaggctggagtgcggtggcacaatcttggctcactgcaacctccacctcctgggttcaagcgattctcctgcctcagcctccagagtagctgggactacaggtgcgtgccaccacaccaggctaattttttgtatttttagtagagacggggtttcactgtgttagccaggatggtctcgatctcctgaccccgtgatccacccgcctcagcctccccaagtgctgggattacaaatatgaggcaccacacctggccaacactgtatttattcgtaagatgagatatgttctttcacatattatttcatatattctttttagtttataatatcatcagggacatgtgtattcctggagtccctctcaggaaaaactttaaaaatcttcctaaagtattcccctaagaaccaacacactaaataatattgttactttcatctgtgtaagtaaaaatgtgcaagtactgtgtaagtcctaattaacacaagaaaatccaattatttttattacatgaatcccttttacactagtttaaattgtaaaattggaagatgacaagattcagctctactttgaagttttcaaactaaatttgttgtttctataaagtatatttgaaactatttgctgtttcatgatccacaatcatctcaccaggttttactgtttttgtatatagaaaatgaagtatgaaggtgattgaacaaaagtaaatccacaattatacactcagtaatactgctcctacataatcaattgggaagtaaaatgaaagaaacttcagtcttatttttccaccctctactaattatggcttcttaacttgcagtttatcttcagattcttaagactatcataaaacatcacatatgaaaattaatgatggccagatgtggtagctcaccacctgtaatccctgaactttgagaggttgaggtgggaggatcacttgaggtcaggaatttgagaccagcctggccaacatggtgaaaccccatctctactaaaaatacaataattagccaggcatggtggcacctgcctgaatcccagctactcgggaaactgaggcaggagaatcacttgaacctgggaggcagaggctgcagtaagccgagattgcatcactgcaccccagcctgggcgacagagcaagactccatctcaaaaataataataataataatgataaattaatgactataccaaccccttaaaaattttaatgagaatcacttagtccttcataagtgaaaaatagattagtcatcagatttcgaatgcaggtttcactatttcaaaaacaacaaaactaagaaactagagaatacaaataatccttaccagataagtatcatcattagattttaaaaggaaagtacaaaataaagcaccactatatgaaaccttagggttttctcttcaatatactaaatcttcgttttaggctagaaatctttatcattcctattttccacaaatttttacatgcaattcctttaagtctatcataattatggattcaaaacccttcataccacatgtagtgtatatattaccagctatttaacaaaattgcagttgctggatggcccataatcagagtggcaacttcaaactgccggtcaccttcgaatgggtaaggtccaggttttgtgttgaccacacactgtcgagactcaggtatagggcatatagaatacgagtggtggactggtttgtgggtttgagggtctgggtggaagattacaaattcttctttgtgcaaagtgtaggagtacaacattgaacatggacttagcatatgtatggtctcccccactccttcttaagccgaagctggagagaatgggcattttgtaaatgttatggcatatgcaaatataatataatggcattaaataaaaacaataagggaactgactaaaacaaaacaggctgtgggctgggagttggtatatctgagttctactataacctggctgctgacattctctgagactttgaacaattcatgttgtgggaagtcagggaccccaaatggagggaccggctggagtcatggcagaggaacataaattatgaagatttcattttaatatggacatttatcagttcccaaattaatacttttatcatttcttatgcctgtcttacttcaatctcttaatcctgttatcttcataagctgaggatgtacatcacctcaggaccactataactgtgttaactgtacaaatttgattgtaaaacgtgtgtttgaacaatatgaaatcagtgcaccttgaaaaagaatagaataacagcgattttcagggaacaagggaagacaaccataaggtctgactgcctgcggggtcagacaaaatagagccatatttttcttcttgcagagagcctataaacagacatgcaataaggaagatatcgctaaattcttttcctggcaaggaatattaataattaataccctggggaaggaatgcattcctggggggaggtctataaacggctgctctgggagtgtctgtcttatgcggttgagataaggactgaaatacaccctggtctcctgcagtaccctcaggcttattaagattgggaaaccccaccctggtaaatttggggtcagaccagttctctgctctcgaactctgttttctgttgtttaagatgtttatcaagacaatacatgcaccactgaacatagagccttatcagtaattctgcttttgccctttgccttgtgatctttgtttctgccctttgccttttgatctttgttctcctttttgccctttgaagcatgtgatctttttgtgacctactccctgttcttatgccccctccccttttgaaatccttaataaatcttgctggctttgaggctcaggtgggcatcacagtcctaccaatatgtgacggcacccccaggggccgagctgtaaaattcctctctttgtactctttatttctcagccggccaacacttacagaaaatagaaagaacctacattgaaatattgggggtgggttcccccaataaattcacttatcttgtgccttagtttattcatttaaaatgaagaaaataagggctgggcacgatagtctatgcctctaattccagcactttgagaggctgaggcaggaggatcacttgaggccagtagtccgagatcagctggggcaacatagcaaggccccatctctacaagagtttttgtattttttgtttatttgtttgttttattagccaggtgaggtagtacatgcctgtggtcctagctacttgggtacctgaggcaggaggatcacttgagctgaagttatagtgagttattattgcgccactgcattccagcctgggccacagagcaagacctcctcttgatcaatcaatcaaagaaaataagacagtctagccccatctcactgactattgtaatagaagtgagataatatgtgaataaagcacttaaagccttaaagctataaagagttttttttaatgtgaaaaactattataaatatttatagtgttctggtactacactgtcaatggacacaaatgttccaaggttcatatagcttcttacagatgaaacactcatggcactttgctcactaataagaataaatcagtccgatccaaatagaacagttttagtttttattagatgcctagaacactgtaaatatttagtaattggtaaaggaaggtaagtatattttaactcttaattctaaataaagacaatgcaataaatttaaaatgtagatatgtttgtaaacagaatatttcacataactatagataccaacctattttttatgaatatggcaggataaaattagtattcctctctttcaatttgaaaaatattccaaaagcaacacgaccaatgaaaaacagaaaccccattttgggcaaaactaggagacaaaccacaaaacgagtagaaaggctgccaaaagcaatggagatgaagtgggaatgtatgctgtaggcagcataaagagaacattccagttgcaaatggcagaaaaaaacaaagtctatttcttgaagttgatgggtacactttaaggtataaaccccttgtttatatcaaagtgcacaggctgacagctagtgctttcccatatgtggtttggttccaagaagcagaaagaacaatgctaagtaaggaatcacactaactatatttgcagagagaagtccatctctgtggctacataagacaaaagactttgtacaatgaaactccccaaagttgtctatctccattggctggacaaaataaaggataaatagaatttaaaagatctacacccaaaacagaactttcacaaaaaaactgttgatacgaagctgatgaaaatcatgatgaatactccaccattaatgaataaaactatacaatcgactctaatttgaaatttttaaaaatatataattataaaattgtgttgaccagaacaataacaaagaaactcgtataatcaatcacttacctctgattcatattttatttttccttcatctaaaatacgtgcatactcttccttctggtgttcaaattctgacttgagaaatgtatgttcatagcgaagcttattatatacagctctatacttttctacctcctaaagggagaatgcatttatcatagatttataaacaaaattcgtactcactccaatagtcacttttacaaatataattttaaattacattataatgatagccactctaaaagtaaaaaataaatttaacagaaatacaaatgaatttggaaaggtcttcataacaagtatcctacatacagaagtagtacattcctgaaaagatatccaaaaagtaaattaccattcaattaatcttatttcttcactggttctcattatgataaagtgtatagtatgaggaaagtgttgatctctggacttaaataaaataacatgtaagaatgtagcacacctttcaaaatatagattttttaaatgtataatttagtataagtaaaacaaattcaaaagagatgtaaggttattgtaatatttagtacagcattttaacatctaattaaatattacaatgatagtttaactcaacagaccaacctgaagaatacgtgcagcatcatctctactgactaaccaggaacacatgcaattccctggagtgttctcatcctgcttcctaacagtactctatgaaagctgctggcattctgaatacccaacaagaaactcaggccacaaagcagaaagatacaggagacactaacaggaaattcgataacaaggaaagcatgtctcctaaaatacccagctcaccataaatctttagttcaaagatttctaagccagtttgtaaaccaagaaaatgggtttcattattttactgcagatatactttgctttgatttaaaaaaaaaagtttttattgaacttggtcacttatcttgggtctgatcttgtttatttacaaaaattaaacctactcccaaaccataatggcttgccattaggactgtattagaaagatcatattatcaagccagtaagccattataaaagacgattctacaactgttttgggcaattaccgcatcactagactacagctctccaaaggggcccattttgaaggggacaataatcatttgtatgtataaggccaggtatatttgttaaataaggtaacatatataaaatgtctaccaagtatctaatatacttgttatctgcagtcttatcctgtcccctttattaagcatttagtcatattatatcaacacttcaccaaaggagactagtctcaacctgaagtaaaactgtaacagatttttacttttatgaagtggcatgaaactcattctctctttcaacaaatattaattgagcacctactgtataccaaaatctgttctaggaacttggaatataacaatgaacaaaacaggtaaaggttcctcctctcatgcaacttccattctagaggtggtaaaacagaaaataaacacaataaataagcaaattatacagcacagtagaaggtatgtataccagaaaaaaaaataaaaaacagagcaaggtaagggggtctaaaggtctaagcagtaatgggaaaggcaggttgcagtattaaataggtagatgggagcagtcaaagtaggccccattgagaaagtgacattttagcagacttacaagagatgaagtttgccacgacgtatctggagggagagtattcaaggcaaaagagatgtgccaattaggctgggcatggtggctcaggcctgtaatcccaacactttgggaggccgaggcgggcagatcacttgagatcaggagttcaaaaccagctggccaatatggtgaaaccccgtttctactaaaaatacaaaaattagccaggtacggtggtgcgtgcctgtaatcccagctacttgggaggctgaagcaagagaatcgcttgaacccgagaggcggaggttgaagtgagccgagatcacgccactgcactccaggctgggcaacagagccagactctgtcgcaaaaaaattaaaaaagaaataaaattaaaaataaaaataaagaaacgcaccaattctggaatgccaaagaaacatcagtaggccaatgtggaaaaaggaaaggagatcagagaggtaatgggagttcaatcctgtgaagccttagaggccactgcaatgactgagtaaaagggggaactactgcagggttttggggtaggggaatgatgcttttcatcaagactttgatcccatgaggataaatgcatagtaaacaacataagttacttacttcatctagattcctaaaacgttctctcattggagtttctaattcttgttgtatttgggctcttagcaattccaatttttgtggagttaatatctaatatgtagagaaatgcaaacaatataaaatcacattaaaatcaagaattctccatatttcaaagcctctctcctaattatgacaatggaattcatgaaagtttttgcaatatagtttttttacagtgatcactatacaaatagaatcatcatttgaaataatactttaagaatctcaatttcaggctcttggagatgtcaaaaattccattaacatgaagtaaagacaattactgattattattgctattgttaggaataactatgttggcagctaagactatcatgttgtatacaatggctaatagtctagttattttccaaagcaggcaaaataaaggtgtaacaatttgttataccaaagagaacctttcagacttattttcaattagaaaaggctcatttttactctcacactgtacctaatttaggcttctccttgtcacactcttttatagaactcgtattttaataagtaattaaatatttatgtaagtcccatgtgggaaaacacagtctttattcaccgttgtattcccaatacctcccaccaatgtctggcacataggaaccactcaactatttcatgaatgaaggaggaacaaatactagttgtaaaaaaaaaaaaaaaaaatctaaagtttgcatgtatattaatttctataaaaatgataatgttcagtttccttttttatgaagagtccaaatattgtattcaaaatattacattttactgaatggagagcttactatatataaagcattgtacaatgcactgtaacctacataccatcctgttctaagcacattatatgcattactttatttaattcctacaacaatgccacagtatagctatgctgaggcacacaaggtatctaaataactttataaagatcacaaaaactcacatgaagcacatatctccccataaaaacttcaaactctggtgttaaaaataactcatacacacaaataactataaaagtaggcaatacaggcttaccagacaggtaaaaaagagaaaacacatttaggatagaaggcatgacacgtcaaaggaatgggaaaactaaagcttatatagaacccttatatagaaagcttatagaacccaaactcaagccaggtaacattttaatttgcctgggtgtcagagactgtatgggagaaaagtgattctcaaaggtgagttaaagccattttgaatgggaccacattaagtactacagaaaatttaaaattgtgggaccctatatgcacactggtagaaatatctaaacactgtaacatttccaaatgccaccttggagggctgcactctggctggaaacaaaaggaaaattaggttgcagccaaagagtgaaaggttcctgaataccaggtttagactcttattatttattcagtattcaatagtatttactttaaaaatttattttatttaaaatgaatatatacaattacataaataaaataattcaaacaaaagactaaaaagtcttctcacttcagtaatccaatttccttttattgaagcaatcattgtcaataacttatgtacccttcctaaaacaatctacagatacacaagcatgtatatcacttttgatttctatacaaaaaggatattgtacatatatttttctgtaccttatttattgaaggtttttaagcttaagagtgacactaccatatctatattttacgaagaagcaagatgaatcaaaagctttagtgggagagtagctgtagctgtgggaagaagaggcagtaaatggagccaaagaaaccagacagaaagctcatgtcataatctggtttacggtatcaagtatcaagtctgggtgacaacatcaagagtccaaactaagatgaggtagcaattaaaaggaagagattaataggtaaagcttacatggctcctgtttcaaatgatctaacttcaaaactaggcaagcaaaaccatgggaaaattaagaaaatctgaacaaaggtgggatattaaaaggtattaatgaataagtattttaaatatggcaaaggtattgtgattatgcttttaagacagactgcactgatttgttatagagatatatactcaattatttgttgaaagaatattatttgattcaaaataatccagaaacattgaggaaaaaagtggaagtgggtgggagaaagtagtagataaaacaagcctggctcagaatgaataattattaatgctggatgatgggtacatgggaatgcattacatgtttgagatttccaaaaccaaaagttaaactgaaagtaaaaagccttccactttcagccaagatagaataagagcccagattcgctctcttgcctgaaacaaacaaaagaacagacaaaaattaaacagtttgcaagacactagacataagaaagcaaaaggcagatccctgagagacacaaaacatagaagataagctttgagagttttcaggacctggcaccggaaaggatacctatgcagtcatgagggactccctgagttgaggagatgaaactgagcatccaaggacagtggggtggttagagtcctaagacagggtagcagagaaaagagggcacagaaagacaactatgaagacctacaaaaagtcttgactcattcagtagagtactgattaacacatgtgtgcaaggaaactacctaaggctaggcaaatacacacctgaaaggattagaaggatgaatacgcagagctcacaaagacctaagaatagtttctgttccccaaaaacagattaaaatcctttgtttcataaagaaattgttatactactcagaagagtcttgcctcagtggtgggaaataattagcactacactaaatactactctgctcccacttaaatcttaaaagcaagacccagaaagataaaactgtttccaaataatttaactgtgtcccaaaataaagctcaagaacatgtatcagaatataaaaatattgggaggtggagattgcagtgagctgagatcactccattgcactccagcctgtgcaacaagagtaaaactccgtctcaaaaacaaaacaaaacaaaacaaaaacaacaacaacaacaacaacaacaaaaatccagcattttaaaaacaaagttcacagtatctaacatccaataaaaatttaccaggcatgcagagaagcatgagagagagagagagagtgagagtgagtgtgtgtgtgtgtggtgggggcaggggggataaacttaaaacaggcccagaaatgacacagatgtcattaaaactttattgtacagttattgtaactgaattccatatgttcaaagaactagagaaaagactgaacatgttggatagagataaaaagaccaaggccgggcaaggtggctcacgcctgtaatcccagcactttgggaggccgaggcaggcagatcacgagctcaggagattgagaccatcctggctaacatggtgaaaccccatgtctactaacaataaaaaatttaaaaattaaccaggcgtggtggcgggcacctatagtcccagctactcaggaggctaaggcagtagaatggtatgaacacaggaggcggagcttgcagtgagccaagatcgcgccactgcactccagcctgggcgacacagagagactctgtctcaaaacaaaaaaaaaaaaacaaaattgagcttccagagacgaaaactacaatttctgagatgaaaattacactgcatggaattaatggcaggttagatactgcagaagaaaaaatcaatcaatctgaaaacatggcaacagaaactaaccaaaatgaagcacagagacaaaaaatactaaaaataaattaataaacaacatcagcaagctatggcagaactttaagtggtctaatattagaatgtaattaagagtctccaaaggaggtgaaagaggagaaagaaaatatttttagaagtaatctccaaaaattttcagtttgataaaaactgtaaacccatagacctatggaactcaataaaccccaagcactacagatataaaaaaaactgcaaagtatgtcaatcaaattgcttaaaaccagcaataaagagaacagcagccaaaaaaccagacaaagtgcactgcaaagaacaaagataacctgtgctcactaccctgtagagtgatgtagctgcacaatatccatgcagcttctagcattatatgttcaattacatcacagatgcctcttggaaacaacagtgctttaaatcctgtaatggtgtgcacctcaccactggcctgtgcaatctaatagcatacaacagtttaggggtcttctgatctgaggtctctgacaaagcatctctaactttttcttacctcctaggaatcttattaaaaacaaatacacacataataaattctctcttcctctgtctctccccatctctccctctcctatcccctatacctccaaagcacacataaaccaagacaccgactgaattagaggatttttcccatcccattttaggaaaaaatattctctcttaggctactttttgtttgtttgtttgttttggagagagaaagagtctcgctctgtcgcccaggctggggtgcagtggcacgatcttggctcactgcaacctccgcctccaggttcaaacaattctcatgcctcaccctcctgagcagctgggaagacaagcatgtaccactacacccagctaatatttgtattttcaatggagacagggtttcaccatgttggccaggctggtctcgaactcctgacctcaggtgatccacacaactcggcctcccaaagatctgggattagtcatgagccactgcacccagcagtgtcttagacttctaatggaatattgccactacttgtctccaaagaaacataagaatgctttatcatacaacagtctaggtgtcattacctattttaaatctataaaaacaaatctttaacactgcagtacttgccatttaataatctaaaataggccaatcttttacaaagaatactttaaggcggcaaatactgctatgccaaaaattcttaataaattaatgactgaaactgagtattatactttgatctgagcttcccagcagccaaaacaaaatgggaacctgtatactaggttatacagttttcattagcacaaaaagagtatattaatcattggtaaagtaatttccgttttattagaatatatcaaatgatccccatatttaaaaaggttttgctaacatggtacatagtaacacaataacaacatgtactgaccacttactagatcaaagtaccatactaatacttttttttgagtcagggtctcgcgctgttgcccagggtaaagtgtggtggtgtaaccatggctccctgaagcctcaaactcctaggctcaaacaagtctcctgactcagcctctctagtagctgggactacaggtgcatgccactatgtcaggctaacttattttactttactttttagagacagagttacccagttacgttacccaggctggtttcaaactcctagcctcaagtgatcctcctgcctcctgaagttctcaaggtgggagccaccatgctcagcctgaactaacactttctatgcactgtctcatttcatccttacagtcatcctatgagctaggcactattatcattaccattcactactgatgcagaaatgttctttaaatgaatatctcttatatctttttcctataaaagccaaagagatgacattaaatcttagaaaaagcatttttgtaggcagactagataatgcacgtatattttaaaaataatcatctttcataaaccttcattgaaatatttcttgatctttgttgaatttacttttctaaacttacaatttgcgcaaattgcaagcatccattaaacaaatagctaaattgcttcaaaatgtgtgtttatatgtatacatgatgtttctttagcttatttttgccaaataaatatcacacagaaactagatatgtttatcttaaaaaacagaagccttactagatatgtttatcttaaaaaacagaagccttactagataaattatatttgtgagcaaacatttgggaagttttcacatggaggaacatccaaagttaccaacagggaggctatagggtagatgacttcattttaataggagagagaaaatgtttaacatactttaatctataaatacaattggatcactttaaaaagttcaccaggttctctagcactgaaagcactgaagcagaaaatgaagagagtcctgtctgaaagatgttctaaaaaggattctgctttggacagtgtattcgtttcctaggttgccataataaaataccagaaacgacgcagctttaaataacagaagtttgttctttcacagttttggaggctattagtctgaaatcaaggtgtgttgacaggccttgctccccctaaaatctgcagggaagaaactttccttgcctctttctagcttctggagcacttaaatctctgcctccaccatcacatagtgctcctctctaccccatctgtctccatctctcttctcctctttttttaaggacaccagtaatattgagttaaaggctcatcatactccaatatgacctcatcagcttaactaattacatctgtaatgaacctacatccaaataaggtcaccttctgaggtactaggagttaggacttcaacatatcctggttggggatacaactcaacccataatagattcaaagaaaaactagatgattaccaactctaagatgctgaggctgtaggtatgtttgacacagacagtgcaatatatgaacaacaatcccaattcattcatttatttcaatttttcacgtcattcattcaacaaatagatgtttactaggcattatcctaaacactgaagacacactgaaaaaaagttcctgccttcatggagcctgaattcaaataaacatgtcataatctatgaatatttactatgtggaaagtatggcagtaaaaatgtagatgttatctcattagtcctcacaactcttgttaagcagaaacttttatccgctttaccacatgagaaaactaggcatagagacatagttacttgttgaagttatcatcttctggaagaactgtcccttttttttcattataaacatcctttttatctttagtgatactctttgtctggaagtctcttttatctgaattaatataactactccagccttctggatgtgctttacttactttctggatgtgcttggtacaaataatcacatttagatgtcactctcatgaaacagaataattaaatttgcaatacctgaagaatctctcaaatatcttgggttcagcattcacagcttccactcatacagggctctaaatttttgcaaaacaaattaatgcattgattctacaggcttaaattacatttccctcttcgatttacatttctgaggtttatatttgtatatttaaatgtcctaaatatacctaggaatgaaacagtgagcatagtggaggctccaagccaggcttagtggtgttcccagcaatggtagatttgaaaaagttattgaatgacaaacttacaaggcttctgtcaaaggatatctaagagttgggtgatatgccagactaggtgacttgaaagatgccttcttactctatgaacttctgactctaatattaataataccttattatttgtaccaatcagattgttaggcagaaataaatagctggtgctcttcagagattaaataaatatgggaaaatattattcgtgagaacctactaatctgaaatttacaggaaatttgactggagtttaaagtctggctttgctcaattttccagacaaatgaaaaaatgaatagcgtgaaaatgatctaaagaaactgtacttcagcactttggagacaactatcttttgctttacaaacccatttgtgttacaatgtacacataaattatgttcacatactgtttttacagtctcttttaagaagctctttaagaatagctgtccttttttagctttcagttataatgcatatacaaatactagtaactcttttaaaaaaattctttaattctgaatttttatcaattcaaactcactttttccctaattattcttaatggttaaatattatttatatcagaataggcaatataataccaatttacataaaataacagtttcatggctcccttacatggtagctaacattctaaaatatatgaaagaagattaaattgtaccacttggagatacagcaaagtaatcattaaggatatagacagaaattgccatattcaccaaaactacttacttccactacgtatctgactgcttttatactaactcaaaactcaaatatattttctcacctgcagtttcatttcttctaaatctttagttttctctactaattctcctcttagttcttcaagcaggagctgaagtttttcctgctgagtttgcttttcattaaacaggtgcttgagttcattttgtaactttacatgttcattctgcaacctggttttttttaaagagaattcaattttgagtaaatcctttctttctaattgcattactttatgtaaagtcaatcaacaccacagaaaaacaagaccaatatcacacattcctttaaacccacaagtatcttttatttacagagtttcatttaattattaacactgtagttttggaatgcaattttactttggtgggagatggggaacacatttagccatctggatacatttaatcttatacgtcctgctactttcaaaataaggcttataaattcataacccacttgatatcatacttagtttggaacaaagtaattttaaagtaaaaattttactatattaaaaaagttttaaatgtatacattgcaaaataacaaaattatactatattctatagcaaacattcagccaagataatgccaataactttttaaaaccaaaccccacttctagatttaagtaatttaccttgtgtgttcagccttcagtgtctgataattagctttatgatgctcacatcgtaacctttcatcaattaacattttctggaactccgactgagaacctgtcaatccactgtctccaccaggaggaaaattattgggaaaagtgtccatatcggtaaatgtgctgacaaccatgtaaaaataagttttggctttcttactgttttagttttctttccaagggtatttcccactcctttcttgctaaggcagaatctcaggaagccaaattatacctgcacagagaaataaacataattacataatttgcgatcagtaaacgtaagcctcctttaatgttacatatttttatcacttttattattcttttttttttcttttttttttttttttgagaggagtctgctctgttgcccaggctagagtgcaatggtgtgatctcggctcactgcaacctccactcccaagttcaagcaattctcctgcctcagcttcctgaatagctgggattacaggcgcctgccaccatacccggctaatttttttttttttttgagacggagtctcgctcgttcgcccaggctggagtacagtggcgctatctcgactcactgcaacctccgcctcccgggttcacgccattctcctgcctcagcctcccgagtagctgggactacaggagcccgccaccacgctcggctaattttttgtatttttagtagagacagggtttcaccatgctggctaagctggtctcgaactcctgacatcaggcattctgcctgcctcggcctcccaaagtgctgggattacaggcgtgagccaccacgctcagcctctccttatcatttttattacaaagcccaattctcagattttaatttgttcataaaacaaaatgcaaatataaagctgaatcacaccttgaacaattttctttacctccatgcagcttctatgcttctatgaccatcaaaatcacatcttcaagtattaacctagctccactagaagcagactttcccagtttaggtagtcttaaattcacaaaccagagtcatgtttcctgaagctaccacagtaagcttcaagtatagatcctggtataaaatccatactcccaaatcagaggaaaagctatttggaacttggtaactggctagggagaatcaaggtcttcaaaaggtgaccttcagcaagtaactatgcctatgattaatgctttgaagggtcttttacttgacacaaggcaagctgcacccagactacagattcacatgagaaatttgtcaacacataaatattgatcaactcctatgtgttatacactgtgttaagaaaactaaatctcacctatctccaaaagcactgactcagtattacaaacgtcactgtttatttcatctagaaataaaaaatgatgtttcaaagtgttcttataactaagaacaaaaattttaattaaaatagttgtctcctttaatttctttctctagtcccataatacatacacacacacacacacacacacacacacacacacacacacatacatacatatttttttcctgatagaatcttccttagccatgggttattacaaatcacttcttataacaaaaaaaaatctttgtcctatgcaaaccgaccattaaattattcagccttgcttgaattataccatctctgataaattagtgtgatatctacgtattacttaagacaatctttaaactataattgcagttgttttggtttcctctgaaattatattttaatacagagggaaaagtccctcaagaacactatactccttactcttagatttaacacgcactgggattcaatctttgtaaatacagaatgcgctatctgtagcagctaccacaaaattatcctgccaaaagtacacatttgccaaggaattaatgaattgcatcataaaactggcattcaatttttactctactgtgggtaaaatgctatcaaatagaatctcatgctccaaagaaatctttcatgaaaggaagagtcaactgatgtggcaaacttcactgttgtctcattttaagaaactgctacagccatcccaaccttcagcaaccatctaaatagttagcagccatcagcagaaaggccagacccttcacctgctaatagatgattactcactgaaggctcaggtgatcaatagcattttttagcaacaaagtactttccaattaaggtatctacattttaaagacataattatattgtaaacttaacagactacagtatactgtaaacataacttttccatgcactgagaaaccagaaaattcttgtgacttgttttattgcagtagcaatccaaataagttaaaataaggaaacactaattcctaaatgtaagtttagatttactcttgacttctaaagctttacaggaagaaaaaatatttgggggttaataaatatgtttggttccacattaaaaattattctgtggaaaaaatacatttttaaagattataaaatgtgtctttataaaatgttgatatgtgacagctcaaaattgcttacttcctaggttttcactaaaagttaagattactaagatttaactaaaaattaagattgctaagagttaaaattctagttaatacatagaattctgtatgcaaagggtacaagaaaaaaacaaaatttgtttttggtgaaaaaagtgttttaaatggcataaaaatgtgtttttatttaaaaagtaatttgtctaattcagaagttattgaaagattatttcaaaatatgaatttggaaaaacatgaaaacaaggcagaaaggaacaagtgaaaaacagacacaaaaaactatgagaatgtatttttggtaagaaaagagaatgacagtaatttttgtataaaaaaacttatgtggttgaaatgatagaaaaaaagggaagtaaatttttgtcctaaggtaaaatgattgtttcagtataaacaagagaaatataagacaaaactaaaggactgagcaagctgtagaaggtctgggcaaattatgaaaggtttgtgagagatgaatcttatgaaagaaattttatttgtgaacaaattggctaaaatgaaaagtaaattgtttataggtttgtcttaaaattgagtcctcatatcaaaagtacactgatacaacactaaaatttgatcttctcttttaaaacaagattttcttattgattgctctcaatgaaaaaataataaaagtagattttaaaaggcaaaaaacccccactatttaaaatggagagagaaattaataatgataaaggttaaatacaccagaaagatgtgacaattttaaatttacatgcacttactatggccactaaatagtaaggcagaagttgtcaaaactataaggagaaatagacaaattcacaatgataggaggagaatttcaccactattcttggtaactaatgggacaagaagatttaaaaaaataatcagtaagaacacagataatttaaacaacacaattaaccatgctgacctaactgacatatggaagactataccctgtaactacagaatacacactcctcacaagtatacacataacatttataaatgttgaccacatgccaggtatttaaaaaaaatttcaaacattttaaaagaccaagatcatacaagataccttctctgaccacaatgctattaaactaaactcaatacaaaaaataatcagaaaagccacatatgcttacaaagtaagaaatacatttctaaataacttatgaatcaaagaaaaggtcaaaatagaaattagaaaatatgtagtactaaatgaaaattgatactccattttaaaacttatggaataaaggtttctactttgaggaagatggaacagatatacattttccttttatactcattaatataactaagagtcctggatttaggtatatgacaaacgtaagactctgaataatggagactagaaggctgactagctatggacctgagaatgtaaggacaaatacagtggtgagtttatttccctgggttttctttttcatatatctcagacacagagctgaagaaactggcaaccaggaaacaccaattaattcagacaaataagtcttgaacaaaaaagcctactctctagccaaaggaacaaaaaagagggagcctagcaagataatatgtagacaattacaatctactctatccaaataccatacacacacacacacacacacacaaaaaaaaaaaaactgtagttccacccccatccacacaagcaaagattaggtggaagccaagctaggctgtaataaaataccctaatactgggccaagatggtgcacaagaaggctcaccagaaaacagaaacttccattgcttcctgaaccgtaataaagctcaatgatcctgcaatgtcagaggagaccacatggaaaacctaaactttcaccccccaccaagagtaacaaagaggacctccctcaccccactgaaatgctggcacagaaggcctagtggagacttatgacaggcagaaccaccaacagtaatgaggctaccctctccagggtatcagggaagatcacatggggagccagaactacagctacctggcaataacaaagacccctcccgcaacccccctcccaaaaaaaactaaggtgtcaacagaggccatcttagaaacctcgacttgctaggcactatggcttgtgactgcaaatcccagccactcagaaagtgaggtgggaggattggttgagaccaggagttcgagaccagcctgggcaacacagtgagaccttgtctcaaaaacaaacaaaaaaaagtcattagctaggcatggtggcatgtgcctatatgcccaggtacttgggaggctaaggtaggaggattgcttaagcccagttcaaggctgcagtgagctatgattatgccaccacactctagcccaggcaacaaagcaagattcccacctcttaaaaaaaaacaaaaacacaaacaaaaaaaccttgtacttccatctccacctggcaaaaacaaggtagtatgccctctttcctctaccagaaaagtgtcagaaaaagccagctaaaacaaaaagtttagatagaatccacaatattataatatcccaaatgtccaagtttcgatagagaaccactggtcggccaggcacagtggcttacacctgtaatcccagcactttgggaggccgaggcaggtggatcacctgaggtcaggagttcgagaccagcctggccaacatggcaaaaccccatctctactaaaaatacaaaaattagcagggtgtggtggtgcacgtctgtcatctcagctactcaggaggctgaggcaggagaacgcttgaacccaggaggcaggggttgcagtgagctgtgatcacaccacagcactcccgcctgggcaacagaggaagactccatctcaaaaatacatacatacatacatacatacatacattaaaaaaagaaatccactgatcatatcaagaatgaagatttcaaactgaatgaaaaaagataacaagccaacactatgatgacaggaatgttatggttatctgacaaagactttaaagcactgatgataaaaatgcttaaacaaacaatgacaaacaagcttgaaataaatgaaaagagggtcacagcaaagaaatacaagtctcagaaaagaaggtaaaaagaagaaccaagtggaaattttaaaactgaaaaatacggctaagcctggtggctcatgcctgtaatcctagcactttgggaggctgaggcaggtgggttacttgaggccaggagttcgagatcagcctggccaacatggtgaaaccctgtctctactaaaaacacaaaaattagccaggtgatgtggcatgcgcctgtagtccagctactcaggaggctgaggcaggagaactgcttgaatctgggaggcagaggctgcagtgagccaagattgtgtcactgcactccagcctgggtgacagactgagactctgtctttaaaaagaaaagaaaaaaatacaatgaccaaaataaaaatattagatgagctcatcagcagaaatagagaggaagaggaaaagaattaatgcactgggaagatacaactacagaaattactcggctgaacaatagacagaaaatagacatacaaaataaataagcagctcagggactgtcagaactaacaaaaaatacctaccattcctgtgcttggtgtatgattccatttatatgaaatatccagaatagataaatacatagaaggtaggctgatgatttccagggactaagggaatggggaaatgggagttgactgcttaatggttacaaggttttctttgatgtggtaaaatgttttggaactagataatggtagttgttacgcaatgctgtgaatgtaataaatgccactaaattatatactttaaaatagttaatgttatgctatattaatttcacctcaataaaaaaagagaaaaataaacctagcaaactagaaacttaaaagtgcatcaatctcatcaaaggtgtatataaaaagagtattttaaaacaccacacctgactttaaaatcttaaaacatctttttctgagagtgtgatcaaaacaagaaagtccattattgctacttttattcaatattgtattgaagaactagaacaaaacaaaggaatagaaggtataaaaactaaaaaaaaaaaatctttatatacacatgttctgattgtgtatgtagaaaatctaaacaaatttacagaaaaataattagaaaaagcaagttagcaagattggcagatagagcaatatacaaaaattaattgcattccatatgccagcaacaaaatattttttatttttttcaatagtgatattctttaacaacaatgtatgtttaaagacattcttaataatataaaaaatatcaaaaacctaggtaaaaagatgtgcaaactatttattataggaaaactgtggctagctactgaaacaaactaaaaaagacctaatagagatatggactaggtgtatggattagaaaacattctaaagagacaaattctccccaatctacagatgatgtgatatcaattaatatccaaatgagtgtgtctctatgtgtgagaaacttaacatgctgattcaaaaatttatgtggaaatacaaaagacaggccaacaacagtggaaatgattttaaagaaaaaaatgagaagactttactatatatcagtacttactacaaatatacagtaattaagatggtatagtatgccattggcttaattatagacaaagagaccaataaaacaggacacagcccataaactgacctacccatataagataatttagaacaaaggtggttttgctgaaccgtaaggagaagagagtcttcaataaaggccactgggacaactagataaccttgtagaaaaaaagaaacttgcgcctttctttttattacacactaaaattaattctagttggactgaagatctaaatgtgaaaagcagaagcacaaagttgccacaatataggaaaaaatattcagtaactcaaggcaggaaaaatagcacgtctaaaatctaaaaggtgattcccagataaataatgagaccgagcaccttttctttgtttactggccatttagatatcttcttttataaaatatccatttgcatcttttgcccaattttttctattgaattgtcttttcaattactaatttgtaaaaattattcataatatttaaatctcaatgagaaaaccaaaaagactgacgataagtctggagaggagaggaagcaaaggttgtagtgtaaactggcatattcactttgggaaaaaaactagcattatctactaaggttaaaaaaaaatacatatactatgactcagtaattcctctcctgggcatatatccacttgaaatgtggtatacacaggtccacaaaaagatttatatgatactgttcatagcagtattattcctaacaactgaaacctagaaacaaatccaatgaccatcaacagttgaagaaacgaatagtggtataatggaactagcactatactgcaataaaaataagctatagatcaagtttgtccaacctgtagcccatgggccacatacagcctatgatggctttgaacgcagcccaatacaaattcataaactttcttaaaaccttatgagagtttgttttgcatggttttttttgttttgttttgttttttagttcatcagctttcgttactgttagtgtattttatgtgtggcccaagataattcttcttccagtgtggcccagggaagccgaaagactggacacccctgctatagatactctatatatatagggtgaatattacagacatattgtccagaagaagccaaacataaaagaatatacactaaattattacaaatagattattacaaatatataaagtttaaaaattaaatacaagcactatagtatataggggatacatgcttaggtataagcatgtataaagaaaggaactatattatcattaaagtcaggaaaatattacttgatgaggctagtaacgttctacttcttgatttttgtggatatatggaggtttgctttgtaacttgctttgtaaatcactcagctgtacattgttgtgtacttttctatatgtatattataattcataattttttttgagacattctcattctgtcatccacgctggagtgcaatggcatgatcacagcttactgcaccatcaatctcccaagctcaagtcacctcagtctcccaagtagctggtactacaggcacatgtcattaggcctggctttttaaattttttttatttattttaatttttatttttattttgtagagacaaggtcccactatgttgcccaggcttggcttgaactcccacactcaagccatcctcccaccttgacctgctaaaatgttaggattacaggaatgagccactgcaaccaaccttataattcacaattttttaaaaagggacttagaagggagagtaattcaaaaattgggctcagcatcatgtcaaggactgtagtccttttcatttttcttccaacaaatcctgttggcttaattctcctcatggttgtgaggctaccacatggatatgtaatattcattttttaaaaatttattctactatttctcctttattcatgtgcttgtttatagtcctttaagtaaaatttacacataatgaaatgcacaaatattatctccatgcatcacttaacaaggatatgctctgataaactcattgttaagtaatttcattgttgtgtgaacatcaaagaatgtacggtacttacacaaacctagatgatatcgcctattatacacctaagatatatggtatatagcctattgcttgtaggctacaaacctgtacaacatgttactgtactaaatattggaggcaactgtacaaaatgaagtagaggttcctcttcaaagggactttccttccagtctaattgagaataaatagtagcctctcttagaagcaaaatttactcaaagacctgtggtaatattcttaaatatctgctagccataataaagaaaccaatatgctttgtgtgcttagcccccaccttttggcctagatatttgccctggcatgcctatataggcccaagcaagcattaggttatagcctgtttctcttccttatttggaggtgttttggcctttctcagcattccacaagttacttcctcctttcctttgttctcccctacctttacctcttttgggaggttctaagttgctagccaatcaggacaagaacagaatgtgaagtcccgttccagccaatggaaactggacacagccatagcatggacgcattagattataaatgaccctgtctcctttgtttgtatgtgctctcatggcaagactgctagtgagtggcaccctttctgcagaaagtaaattagccttgctgggagatcctttatcatagtgttgatttccgcgacactgaatacccatttccaacagcaactgtaacacaaatcactaggcaatagaaattttttagctccattataatcttatggtaccactgttgtgtatgtggttatatgcagcacatgaatgcacacaatttcatgagttcacaaaaggaagaattcaagaaagcctcaatttcatcaagatataaaacagtcccatcactccagaaagttccttcatactccttccccatcaccccacccacaagaggcaaccacttttgtggttattctcaccatagctccacctgatccagaacatattaaagtgaaatcatacagtacgtactctcatgtatttgccttgtttcacccaaatagctgtgagattcacctatgtttttgtgtatctcagtagtctgttcctttttaaggctaaatagcatttcatcatttaaatataacacatattgtttatccattctcctgctgatgcgcatttggttgtttctggttacaatgaatatagctgctatgaatattcttgtacaagactttctgtggacacattttcagtttgggggtgggtggtggtaaacatttaagagtggaattgctgggtcatggagcaggtttatatttaactttgtgtaagaaactgccaaatctttttccaacgtggttgtaccattttctattccaaccaaaaacatatgagaatttttttttttttctgagatggagtttcactcttgttgcccaggctggagtgcaatggcgcaatctcagttcatcacagcctctgcctcctaggttcaagtgattctcctgcctccacctcccaagtagctgggattacaggcatgtgccagcacacccggctgattttgtatttttagtagagatggggtttctccatgttggtcaggctggtcttgaattcccgacatcaagtgatccgcccatctcagcctcccaaagtactgggattacaggtgtgagccaccatgtccagccaacatattgagaattctgtttgcgccacatttttcccaataccttgtagctgcaccagaccaatctggttcaactttttttttttttttttgcaaaagaaaaaaagtttttttgatctccttgaatgtagcacacaaaaaaagtgatggctcccccaggctccatcagcaacagtaaagggcaggaacatagagatttctttttccaggcccaggcctgtgaaaaacgatggctaagtgttagtccttagcagggccgacggatggtctccattcctggttaaccctctggaatttgggagcatgagtatctccaagaattcatttctactcagtaaagatggggaggggaatcccactgttacttgttgaactggaaagaatagaccccatgctctgagggtgtgtccactgccacttggttctgttggccgctgctctcctcgactgaaacactggaaggaaggcacaggggtgtactgggagatgtaagctccttgcatagctgcagccgtcagcatatacatgcctgtgctgctgaggcagagatggcccagttgctgggtaaggggtcccatcatggaggcaggctggagagaaatgggatggtccatccctggtgtcagaactgaacctgaaggctgcatgaggtatgaatggtggtgcatccaggatgggttaggtacttgtagaggagatgtctgagtcactctctgatacgaagacacaggagaggaaaggtatggggagagtgcagaccgagcaagcatcctgttgggggtgatgttataaggggctgggtaaaacccattctgaagagctgtggtggggtcataggtcaaggccatgatgcccatgtctccattccttggccaagcccgtccattttgcacaaatattccttggttctgtcgtttctttggcccgccatcagcaaatttgcaaagcaagggatcggatggggctggtactccagggggtgtcttaatatattttccattaaagtgggtgatgatggcttcacacttctctgtggactccatccttgcaaagccaacacctctgctggtcccactggtatctcgaaggatacgggtggagataacctggccaaagggcttcagcatcccctccagttcctgctcatccattgacagtgggaggtttgagatgtataaatttgtggggtcctgttcctgttgctttaccatctgtgcctgtacaccactggccttcagtgctgttacagctttctgtgctgctgaagggctgtcaaaatctacaaagccatagcctttacatttgtttgtggtcttgtccagtacggccttagtggaaacaatcttgccatatggctgacacagcttgacaagatcttggtcagtagtgcctggttgcaatcctcggatgtataggttggttttgctcagctggtcatttccattgcttccactactgctgttaggtgtactgttgcttgggctaggtggtgccatctgctgagccaatgacacatatggcttcttgttgtttctattgtagccaaaagtagaaatcccgggcctggaagtcacggatagcagcattttctctttaatgttagggaacgagtgagagagagagagagagagaaagggagggggtaagaaagacggggagggagggaggaggggatcgagggaaagggggagagggagggaggaaaaaagggagggggaggagaaaggaggagaaaaggagcaggaggagagagatgaaggggggctgcctctggttcaacttttatgtaataaattgtgagttatttttcagctgccatggaccctcagctcacataacctgagcatgctcagatgagccaagactgcaatctcaggaggaacctaagtgcttggaccaagaaatggggactgaattaagaagcagacattgcatggcaggatccaggatccaatcagatcaagctctggcatcatcccatggagggatcctgtcagatcatgcctccagtaccacctcattgcaagatccaatcagatcatgccttgttatcctacacttataaaacctgactcaggcccctgctttaggaactatccccatgttctccttacttgttgcaagtaataaaatcctcatgctaaatcctctttggttgtgagcactgagttgatgatacctgccaagcaaccaaacccatctgtcgtgtgggtaataatgtgatgttgtgagtccctttaattgtagcccttctaggaggcataaagtggtatctccttatgattttaatttacgttttcctgaagcactttttcatgtatttaatggctgttcacagaccgtcttaatctatgaaaagatttttgctttaagaaccatcacagcaaagaatatttatgctgtagctggcaaaatgggagattttaatagctaatgtgtatataagaaatgaaaacaggccagtgcggtggctcacgcctgtaatcccagcactttgggaggccaaggtgggcggatcacgaggtcaggagcttgagaccatcctggctaacacagtgaaaccccatctctactaaaaatacaaaaaaaattagctgggcgtggtgacaggcgcctgtagtcccagctactcgggaggctgaggcaggagaatggtgtgaacctgggaggtggagcttgcagtgagccaagatcacaccactgcactccagcctgggtgacagagcgaaactccgtctcaaaaaaaaaaaaaagaaatgaaaacaaatctaaaatttgtctcattgcactaattaccatttagcttcctgagcacatactgctgttttctaccgccatggctttgtaaatgctaatttccttgctcagaaggctttttccatctctttgtattctgatctagtgaattcctattcagccttcaaaacccagctcaggaatgcattacttcctccatgaagtaaagaccctcccaaatagttcattattctgtgttttatcttgcattttagtatatacaacacatggaatgtaactttgtccatgacaagaaacatgtcttactcatgttcataatcccaacacctaaaaaaccacaggcacatattaagagctcaaaaataacaaatgaacaaataatgtgctcaccattctaatgctactttagcctcgattcacttttctcctccaaattcagaaacagtcttccaaacaatagtgggctgaatgctagccctcaaaatatgtcatttcctaatctctggatgctatgaatattaccttatatacttttaaaaaaagggtggggtgattaaattaaggatcttaagaggagaggcttatgctggattatgtatccaaaacaatcacatgtatccttctaagagagaaggagagggagtttgagactgaagaggaagaggcaatgtgaccacggagacagagactggaaagatgtagccataagccaaggaaaacctacagccacaaaaagctggaaaaggcaaggaaaagattctaacccagagccttcagagggaacgtggcttggccaacaacttgatttctgacttctaatctctaaaatgttgaaagaataatttttttgttgttttgagacacctattatatggtaatttgtaacagcagccacaagtaactaatacaatggctttctcttgtatttatatttacttataaaaaggtttatcaaactcaaaatttctaacacaattttaaattcctaccatggttagacttctttgatttcaatcagtcaatacacagctatcaattatctgcaagacacttacacatacattagatgcttgaaatacacaataaaacgtctcctactgtgcagtttactaaatacagaaattcatattgaaaattttttaaagtaaagtacagagttcaaacagcaataagtgaaaaaaagtgaaacattatctcgattggcctgttaatcagtgagcacttgttgggctagtctcagtgaaaggcagtttttaaaagactagtacaacctttttccaaattcttcatcttctctttgcaaccattacaaatacataatcacatccacgtgtccttcctaccacttcttttgactagtcccagctttacagacctccatatgacattttattttgcataggcactgtattttttaagcagtgagtagtacaatgtctgccccaaagtatggtaattcaaaatattcaaaaaagcacagctgctgatgctcatggaaagcttccaaaacacattccattaaaagcacatgctatgcctttgaatatttcaaaacaatgttttaaatactacatgccctcaaagtgaatgatgttttttaaaaaacaacattaaaagtctagggaggacctacaccaggcatttactttacttataaacaaaacattagaaatgaatttcttcaaaatccagagataatcctgcactagtcacccaaacagcctttggatagccatccaggatgtcttgcgtacaaaaaaaaagtcacaacttgacgccctgccagaacctgaagtgcagctgggagcagacccttcaaagccctggtaaggtgccaggctctgtaattgtgatttagaaagaaacaagggagagcaaggaatgagaaaaggaagaagatatgtattcaagtggttagcaatcaaccaccaagcactctaaattaaaatgttattctatttttacgattgtactgtctgcctctgcacagcttaattcacacaaaagaatctagaaagtaggacatagtaatgactcaacctcaaatgcttagtgtaaattaccaaagtctctgaaagttgtgatctgaaaggcaaagatgattcttgtccaaattcattttaacatttcttaatgtaaggtctgttacaataacatggggactttccagaagatttatgagcacttagcacctctgtgtgagttgtatattcttctttgctcacagtcccacctttcttctgaaatagaaaaggctacccataatatggctgctaatacacaataaagattatctactgatgcaacagcatatcctgaaaattgttttttaaataaatcctgatttaattttacttctatgagatttatgccgtaatctgaaaagttaaagagaaattgatacttaaaactgagtttaactgatattttactgcagttaacacaaacattctcttcattattttgaatctgtcacaaagcaagtataaaatttttcacagccagaaaaaggagataaataaaagccatcctcaagacacacaggttaatgttaaaaccatatactttaaaaaactgattaaacaaccaatatttattaagtgactgctataccacatttactgaatggtctacttacagtaaaagggttttgagagatataaaaaatatacagaccatcaagtcaagcacacttctcatgaggaaagaagagcctgcccatattcagagtactccatggatattttctaagtacctttaatatgctagacactttgttggatacaggaatacagaaataaataaaagaaaatccttgtcctcaaggagtttatgatggtcagtggaatatacttgttaaccaacaattgctgactgaataaggatgagagaaaatggactatttaaactttctggacttaaaatttttttaccatgtgcacatattacctatacaaagtcataaattcaggaagtttttaaattgtaaaacattaaggaattcaacaaagaggtgacaggaaacacctaaatcaaggaaagagagagaagtgaggcagcctgcttatccgagattagctaagagcctggagagaattcccagtcaggggaaagggtaaatgagagatgcccaggggtccacattcccaccatggatacttgcaatcctagccacagtagaggccctggaccctcacaggccctgaaactaacaaagggaactgcatgaagagtgcacaacagcattgctccagagagggagctcacgctggggcacaccaacctctccactccccatcccagtcctgcagctatagtaagacaccattttgagaactcagtcccaacagactgcaccttgtgcttgggcttaacagcacctgtctcttcacatccctggagtcccactgacatacccagcccacagctaccaccatgcctggttcctgatgctggggccaaagtgcacgcctctggctccaatctcagccactgcttccagcagtggagccaccactcattttcatgtgcccagagtccctcacccacagctgccatcactgtgctaccaggactaaggaataagcaaagcatgagcttccactgcccaggctaaagcacaagccaagcatgagctgccaccaccaggactaaaatgtgagtgaaacacaggctgcaccaccaggactgaaacacaagccaagtatggtctgccaccaccagggctaaaatgcaagtgaaatgcatgttcctaatacttgcctgcatatagctggtatcactgaaagcaactctgccctccccagcagtagggctgcagcacagacactgcctctcacaacatgaacattgtgctgggggcctaaggatcaccccaccccttcctaacacagccagcacctatacgcaccactggggagtctaaagacaagcccacctggcctcacccaccccccatgccagagcacacaatccagaggcctggagatcacacaactcagccaccattggcaactaaggactcttcccaggaacctgagattgggctcacccacccagctactaacatcacagcaagaaaatatcatacctccaaaggaacataataattctccagcaacaaatcccaatcaaaaataaattcacaaaattctggaaaaagaatttaaaatattgattttaaagaagctcagtgagatacaagagaatactgaaaaataacataaagaaatcagaaaaacaattcctagaatatgaatgagaaatttatgaaaaagataggtatcattaaaaaaaaagaatcaaattctggaactgaagacttcactgagtgaaatacaaaatacatttgaaagcttcaacaacagactagatcaagcagaagaaagaatctcagaacctgaagataggtctttcaaataacccaatcagacaaaaggtaaagaataaaaaacagtgagcaaagcctttgtgacatatgggcaccacaaggcaactaaatattctcattttcagagtctcataaggcaaagagaaaataaaatgcatagaaaacctacttaatgaaataacagataaaaacttccgaagtctagcaagggatttaaacatccagatacaagaggctcagagattcccaaatacagtgcagaaaggtcttccacaaagcacgttatagtcaaactgtcaacaatcaaagacaaaaagagaattccaaaaacagcgaaattcatttcacctataacaacacatagactgaaagtaaagggatggaaaaagacattctatgcaaacagaaactaaaagggagcaggagtaggagtagctatacatatatctgttaaaacaggctttaagtcaaaaacagtaaaaagagacaaaggtcatgatataatagtaagaggatcaattcagcaagaggataacaattctaaacatatatgcacccaacacaagagcacccagatatacaaaggaaacattattacacccagaaagaaatccacaaatagccatctaattttgacaaaggcactaaggacatacatttgggaaagaatgtccccttcaataaatggtgctgggaaaactgaatatccatatgcagaaaaattaaattggatccctacctctcacatatacaaaaatcaactcaagatggatcaaagatacaaacgtaagacccaagactataaaattactagaagaaaacatagggaaaacacttcaggacattggtctcagcaaaaatagtatggctaacacttcaaaagcacagaaaacaagaacaaaaatagacaagtgggactatattaaactaaaaagcttcaacacagcaaaggaaacaatcaacagagtgaagaaaaaacccactgaatgggagaaaatatttgcaaaccattcacctgacaagggactaatacctagaatatacaagaaaatcaaaacttaacggtaaaaaaaaaaaagcctcattaaaaagtgggtaaaggccacaaacatttctcaaaagaatacatacaaacgaccaatgggtatatgaaaaaattctcaacatcattaattaccagggaaatgcaaatcaaaaccacagcaacatatcatcttatcccaattagaatggctactataaaaaaataacaacagatgctggcaaggatgtggagaaaaagggaactcttatatgctgctggtaggaatgtaaattagtacagctactatgaaaaacagcacgaagatttctcaaaaaactaaaaatagaactagtatacaatctagtaatcccacaatggggtatttattcaaaggaaaagatatcagcatgtcaaagggatacctggactcaggttattgcagcactattcacaatagcaaagatacagaatcgacataagtgtccattaatggattaactttttcttttttttttttttgagacggagtctcgctctgtagcccaggctggagtgcagtggcgcgatctcagctcactgcaagctctgcctcccaggttcacaccattctcctgcctcagcctcctgagtagctgggactacaggcacccaccaccacgcccagctaattttttttttttttgtatttttagtagagacagggtttcaccgttttagccaggacagtctcaacctcctggcctcgtgatccgcccacctcggcctcccaaagtactgggattacaggcatcagccaccacccctggcctgaactgttttttttaaatgtggtatatatacatggtgaaatactattcagctatgagaaagaatgaaatcatgtcatttgtagcaatatggataaagatggagatcattacaataagtgaaataagccaggcacaaaaagacaaatatcacatgtactcatgtgggagcttaaaaaaagttgatctcatggaggtagagaataaaatgatatcaaaggccaggaagtatgtgtgtgggggaaggtgggataaagggaggttgcttaatgaatacagatatccagttagatagacaatacaagttctaatgtcgcagagcagagtacagttaataattaatttgaatcatatatatttcaaagtagctacaagagaggactttaaatgttcccaacataaatgataaatactcaaggtgatgaataccccaagtaccctgacttgatcattacacattctatgcatgtaacaaatacacatgtacctcataaatatgtaaactatgtgccaatttaaaaagagaggaacttcaaaaaaattataaaatattataacatatttaccagtagtatgaatggacaagggagagaaccctaattctgctagtgaagctgccagggaaaacttcacaaagcagcagctaaaattaacaaagggatgcaaggaagaaacatcaagtgcaaaataatggagattaaggagaagaacattagtggtggagggcagaggagaggagaacaccctggggaggtaaggtagggcctagaaggccacatgcagaagactggaatttattccatggtcttggagagccagtgaaagattttaaacttttagatggatagaagacattacggggtagactcacatttacatttcagaaaaataagtcgtttatttgcagaggatagatttgaggaggaagaatagaagaaagagaaaaagaaaaggagatcaaaggtccaggaaagtaataatgagggccttaactaagacagtagcagcaggtagtcaataatcttgaaaattaatttgaagccaggcgcagtggctcatacctataatcctagcactttaggaggtcaaggcaggcagatgccttgagctcaggagttcaagaacagcctgggcaacatggtgaaagcctgtttctaagaaaaatacaaaaattagcccggtgtggtagcatgtgcctatggtcccagctactcaggtggctgaggtgggaagatcgcttgagcccaggagggtcgaggctgcagtgagccaagatcgcaccactgcactccagcctgggtgacgaggtgagaccctgtctcaaaaaaaaaaaagaaaagaaaagaaaattaatttgggggcagcaagagcaggagttaataattagatacctatacccatcccccagcaaaaagtattttaatgtcactagttaaaaggcctatcaggaaaccaagataggaaagcaaagaataaacactaaaatggaatccagttaaagtgaaagaaaggttgtttcaaagattacaattacttcaagcactaatcctacataagaatgaggaatcctgtacactgacctttggcaaatgaatcttagtaaactgcaaataccatcactgtaaaacactcagaataactaccttttttccatagggatttcataagcagaggggcaaactctaaagctggctctgtcgggaacaaagacataaaataaggattttgttccttaaatgtccacctgctgctactcctcctcattctttccttcaaacaaatcatctctatagcaacacactcttaaagaatttgtgggtggaaagcatatgtttgtgcaaaaatatgagaactcaagaacatgagctattttattttttcctttaatacaagagatacacaatctattaggatacaactaaaaaataagagatatgaaacaaaaaaatgtttatacacaaaaaaatgtaaaaattgtacaaatgataacgcaaatgtttacatggaaattctttttataggttacaatgacaccttgtggtaagacttttcaagttatacaaattatcttagaaaatattttttacagcagagacgtaagaaaaccggtttagaaaataggaaagctcaaaaccatagtaatgagttaatgtgtacaagtataataatacatttgaaaagttaaggttgaaaaatcaaacttttaaaaatgtcacaatattaggtaggcaaaagcactttactaactgtaaatacaagttgaatatcccttatgtaaaatgcctgggaccagaaggatttcagattttgaattttttcagattttagaatatttgcatgtacataatgagtatcttggggatgggacgcaagtctaaacataaaattcatttatgttccatatataccttatacatacacatagcctgaaggtaattttatttttcccttgaaggtgcttaataaactgcgtgttgtatgcctgcattttgactgcaacccatcacatgaggtcaggtttgaaattttccacacggtgtcatgttggtgttcaaaaagtttcagatttcagagcattctggattatgggattagggatcctcaacctgtataaagcattatactagtcccttcacttgaactgaaattattaaatactcttccttattctctggtcccttattcccatcttgtaagaaaagtcaagctgcacctctcaaagcttcatctattactttatctgaatgacactgaaatttgcaccctagttcctaacctctctctgcttatgaatccccctctacttacatgttctctctataacagaagctcaaagatgggatttaagacagactacccaaaatatggcaccttggcatttgagaaaaaagcagaagcaagaaggtttatctcaccttcctctaaagtaggtcataagatcctcaatccagaggtgtcctccctatacctgtaggagagaagacacaaagaggaatctgaacaaacaggacttactaagtttcccccagtttgttactgctagagcatacccatttgtcctctaacgatacttctgcatgactgtccacaaaaaaacagagagacagaccctttgaaaaaagcagtttactgctgcaaatgccacaagacagccaaaaaactccaaagacaaaagacatgaactctcgggagctctatgggcctgtccatcatctgagaaaccccagtacttatcctgccaatgcagggcaagattatatcccccttctactaccgcagctgctcctctcttgaaattgccacttcctgactggaggccaaccaactcaagccatttcagcaactcctaacagaacaactctgttccaacggagaaaacagcagctaattcaactgcctgcaactccctggctaatcagaggtcctgagtctgtccacatgacaacttcaaccgctagcctaaccagcattcactctcctgccacctccactacagcaggtgctggtatccacagctgggagacctgaagacagattatatcacaagacaacttgcagacattcgccagcaccagcctggagcccagtaaccctgctgggtggctagacccagaacggtaataacaatcacctcagtctggctcctaggaagccccatccctaggggaagggggtgactccacatcaaggaatcaccctgtgggacaaaaaaaaaaaatctgaacagcagtccttcagttctagatctttccactgaaacatacaaataaaaaggaaccaggaaagtaattctggtaatatggcaaaacgaagtttgataacacccccaaaagatcacactagctctccagcaatggatccaaaacaagaacaaatctctgaattgccagataaagaatttggaaggttgattattaagctactcaagggggcactagagaaaagtgaaaaacaacttgaacaaataaaaaaaaaaataaaaaacaggatatggatgaaaaagtctccagagaaatatacatcataaaaaaaagacaaccacaacttctggaaattaaatacacacttagagaaatgcaaaatgcactgaaaagttccaacaacagaactgaacaagtagaagaattttagagcccaaagacagggctctcgaattaacccaatctgacaaagacaaagaaaaaataattttggctgggagcagtggctcagcttataatcccagcacctcaggaggctgaggcaggtggaccacaaggtcaggagatcaagaccatcctggctaacatggtgaaatcccatctccactaaaaatacaaaaattagccaggcacagtggcgtgcacctgtagtcccagctactcgggaggctgaggcaggagaatcacttgaacccggaggaggttgcagtgagccaagatcacgccattgcactccagcctgggcaacagggggagactccatctcaaaaaaaaaaaaaagaaagaaggaaagaaaaagaaaagaaaagagaagaaaaaattattttagaaaatgaataaagcctccaagaaacttgggacgttaaaagacccaacataagaataattgctgtccctaaggaagaagagaaatccaaaagtttaggaaactatttgagggaataattgaggaaaacttccccggttttgatagatatctagacatccaaatacaagcagcttggccaggcgtggtggctcatgcctgtaatccagcacttcgggaggccaaggcaggaggatcactcaaggtcaggagtttgagaccagcctggccaaaatggtgaaaccccaactaaactaaaaaaaaaaaaaaattacctaggcatggtggtgtgggcctgtagtcccagctactaggaggctgaggcaggacaatcacctgaacctggcaggtggaggctgcaatgagccaagatcgtgccactgcactccagcctgggcaacagggcaagacttggtctaaaacacatacacacacacaaacaaatacaagaagctcaaagaacacccaggaaattcatcacaaaaagatcacctaggcacacagtcatcaggttatctaaagtcaagacaaagaaaagaatcttaacagctgtgaggcaaaagcattaggtaacctacaaaggaaaacctaacagattaacagcagatttctcagcagaaaccctacaagctagaaggaattgggtcctatcttcagtctctttaaacaaaaaattatcagccaataattccatatctagcaaaactaaattttataatgaaagagcaatagagtctttttcatacaaacgaatgctcagagaattcaccactgccaagccagcactacaagaactgctaaaaggagttctgactcttgaaacaatctcaaaacatcaaaatagaacctttcttaaagcataaatctcacaagacctacagaacaataacacaatgcaaacaaaaaaaggtaattaggcagcaactagtatgatgaataaaatagtatctcacatctcaatactgatgttgaatgtaaattgcctaaatgttccactgaaaagatacagaggccagcacagtggctcacacctgtaatcccagcactttgggaggccaaggtgggcagatcacctgaggtcaggagttcaagaccagcctggccaacacggcaaaagcccatctctactaaaaatacaaaaaaattacccaggcatggtggcaggtgcctgtaaacccagctactcgggaggcagaggcacgagaatcgcttgaacccagggagcagaggttgcagtgagccgagatcatgtcattgcactctagcctgggtgactgagtgagactgtcccaattaaaaaaaagaaaaaaaaaaaagatgcagaacagcagaatggataaaaatctaccaagtatctgctgccttcaagagactcacctaatacataaggactcatataaacttataaggtaaaggggtggaaaaagatattccacgcaaatggaaaccaaacgtgagcaggaacagctattcttatatcagacaaaacaaactttaaagcaacatcagtttaaaaaggcaaagatagacattatataatgataaaaggattagtccaacaggaaaatatcacaatcccaaaaacatatgcacctaacactggagctccgaaatttataaaacaattactactagacctaagaaatgagatacatggcaacaaaacagtgagagacttcaatactccactaacagcactagacaagtcattaagacagaaagtcaacaaggaaacaacagactataccctaaaacaaatggacttaacagatatttacagaacattctacccaacaattgcagaatatattcttttcatcaacacatggaacattctccaagatagaccacaaaacaagtctcaataaatttaagaaaatcaaaattatatcaaatattctctaagatcacagcagaataaaactagaaattaactccaaaggaagcttcaaaactatacaaatatatggaaatttaaacctgctcctgaatgacctctgggtcaacaatgaaatcaagatggaaattttaaaattctttgaactgaacgataacagtgacacaacctatcaaccctctgcaatacagcaaaaacagtggtgctaagaggaaagttcatagcaatcactgtctacaacaaaaattctgaaaaagcacaaatagattatctaacctcacaactcacagaattagagaaacaagaacagaccaaaccaaaacccagcagaagaaaagaaataacaaagatcagaactaaatgaaattgaaacacaacaacaagaacaacaacaaaatacaaaagataaattagacaaaaagctggctctttgaaaagacaaaatcgacagaccattagcgagattatcaagagaagagagtagatccaaacagctcaattagaaacaaaataggagatatcaaaagtgataccacagaaatacaaaagattgtgcttttgtatggctactatgaacatctttatgcacacaaactagaaaacctagaggagatggataaattcctgaaaagatacaaccctcctagattaaactaggaagaaatagaaacaaactgaacaggtcaataacaagtagcaagattgaaacagtaataaacaaaaaaaatgccaacaaaaaaaaaaaaagtccaggacctgatggattcacagctgaattctatcagacattcaaagaagaattggtatgaatcctactgaagctattccaaaacacagaaaaagagggaatcctccctaaatcattctatgaagccagtattatcctaatagcaaaaccaggaaaggacataacaaaaaaagaaaaccacacaccaatatccctgatgaacatagatgcaaaaatcctcaacaaaatactagctaaccaagtccaacagcatgtcaaaaagaaaatacaccatgaacaagtgggttttataccagggatgcagggttggcttaacaaatggaagtcaataaatgtaatacaccatataaacagaattaaaaacaaaaaccacatcatctcaacagacgcagaaaaagcatgacaaaattcagatccctttatgattaaaaccgtctgcaacatcggcatagaagggacataccttaagataataaaagccctctatgacaaacccacagccaacattacactgaacagagaaaagtttaaagcattccccctgagaactagaacaagacaaggatgtccactttcaccacttctattcaacacactactggaagtcctagccagaacaatcagacaagagaaagaaatcaagagcatccaaagtggtaaagatgaagtcaaagtgttgcagtttgctgatgatatgatcatatacctagaaaaccctaaaaactcatccaaaaagctcctataactggtaaatgaattcggcaaagttttaggatacaaaattgatgtacacagatgagtagctctgctgtataccaacagccaccaagctgagaaccaaatcaagaactcaaccccttttacaatagctgcaaaaaataaaataaaatacttaggaatatacctaaccaaggaggcgaaaagacctctacaaggaaaactacaaaaaaaaaaagctgaaagaaatcacagatgacacaaatggaaatatatcccatgcgcatggatgggtagaatcaatattgtgaaaatgaccatactgccaagagcaatctacaaattcaatgcaattcccatcaaaataccaccatcgttcttcacagatctagaaaaaaaatcctaaaattcatatgaaaccaaaaaagggcctgcaaagcaatactaagcacaaagaacagatctggaggtatcacattacccaacttcaaactataccaaggctatagttaccaaaacagcatggtactggcataaaaacaggcacatagatcaatggaacagaacagagaacccagaaacaaagccaagtacttacagccaactgatatttgacaaagcaaacaaaaacataaagtagagaaacgacaacctattcaacaaatggtgctgggacaattgacaagccacatgtaaaagaatgaaagtggaatctcaactctcaccttacacaaaaatcaactcaagatggattaaagacttaaatctaagacctgaaaccataaaaattctagaaaataatatcagaaaaactcttctagacattggcttaggcaaagagttcacgaccaagaaccaaatgcaacaaaaatgaaataaatggatgggacttaatgaaactaaaaagcttctgcacagcaaaagaaataatcagcagagtgaacaggcaacccacagagtgggagaaaatattcacaaactatgcatcccacaaaggactaatatccagaatctacgaggaactcaaacaaatctgcaagaaaaaaaccaaatattcccatcaaaaattagggaaaggacatgaatagacaattctcaaaagatatacaaatggccaacagacatatgaaaaaatgttcaacatcactatcagggaaatgcaaatcaaaaccacaatgcactaccaccttactcctgcaagaatggccataatttaaaaatcaaaaaataatagatggtgacaaggatgtagtgaaaagggaacacttttacactgctggtgggaaggtaaactagtacaaccactatagaaaacagtgtggagattccttaacgaatgaaaagtaggctgggcgttgtggctcacgcctgtaatcccagcactttgggaggccgaggcgggtggatcacaaggccaggagatcaagaccatcttgactaacatggtaaaaccccgtctctactaaaaatacaaaaaattagctgggtgtggtggtgggcacctgtagccccagctactcgggaggctgaggcaggagaatggtgtgaacccaggaggcagagcttgcagtgagccgagatcgcaccactgcactccagcctgggcgacagagcgagactccgtctcaaaaaaaaaaaaaaaaaaaaaaactaaaagtagaactaccatttgatccagcaatctcactattgggtatctacccagaggaaaagaagtcattatatgaaaaagacacttgaacatgcatgtttatagcagcacatttgcaactgcaaaaatatggaaccagactaaatgcccatcaaccaatgagtagataaagaaaatgtggtaggtatatatatatataatgcaatactactcagccataaaaaggaatgaaataatggcattcacagcaactgagatggcattggaggccattattcacagcaaccgagatggaattggaggccattattctaactgaagtaactcaggaatggaaaaccaaacaccgtatcttctcacaagtggaagctaagctatgagaatgcaaaggcataagactgatataatggactctggggacctggggggaaggagggaggggggtgagggttaaaagactacacaccgggtgcagtgtacactgctcaagtgatgggtgcaggaaaatctcagaaatcaccactaaataagttatccatgtaaccaaacaccacctgttcccccaaaactattgaaataatgattttttttttagaaaaaacacggaaagaaaggtttccctgtttctttcagtcttcacttctgaagactcatataaagtaaaggtttcattaaataaatgtgtatgctttcctcttgataatctgtcttttgttataggggtctcagtcatgaatctagtaataggtgaggaaaagttatcacattttatccgctacatcaacttaacaaaaattcagttcattaggttcaaattttctacttgtctccttaaaaaagtcagttaccactatcctcctctcatttcctaaccactacccatcctctatcctctatttataacaaattaatcctactgattcttcttcatctgtttgttgaatttaatcattcttccccatttctagagccatcacactccagtgccgaatcttaaatattttacacttaacagaagcctcctagacagtgtcccagactttagtattttctcattcttacatagcctacaaatatcaccaaaacaatctttctcatacattgccttcgtcactataactcctatgataatccttattctttcctgactcaaatctaaatttcccagctaaactcacagccccgtattagccagctccctatacaaattcaaacattttgctgccccacaggacccctttgctagagtcaattaagtttacagacccccaggacccctttgctagagtcaattaagtttacagaccctcaaacacatttctctttgccttcacaactttgttcatacagttatgccaaattaaaataccttcttaaaccttgtctattaatccacaaatcacagagtcaaacctgaaaccctacagtctgcaaaatcacaaaactattttcggagttttagttgctctaaaagtgaacagaaagagtagcttttgtccatgtgctttataggttcctgccttccttgtgcttgccccaggatatttattctatataaacatatatttttttgagacagaacctcaccctgtcacccaggctagagtacaatggcgcaatctcagctcactgcaacctccgtcccgcgggttcaagtgattctcctgcctcagcctcccgagtggctgggattacaggcatgcaccacgcccggctattttttgtatttttagagatagggtttcaccatgttggcaaggctggtctcgaactcctgacttcaagtgatccacccaccttggcctcgcaaagtgctgggattacaggcatgagccactgtgcccggcctaatttattctatattctataatgtctgcacttttcccctccagatgctttataactatataaactacgttttccaaagaaactataaattcctcaaaggaaaaactacatataatcttctactgttttgttcatcttcatagttcccaattccagtaaactgttaatgacagtaaagtgatccacaaaatttctatgatgtgaatcctactctcccataggcttgtaatgtaatttcagagaaaccttggggaaggatgtcaccaagaacactgtttgctaaccaattatgcatgcgttatagttagttatcaagaaatttctacctcaggccgggcgtggtggctcacgcccgtaattccagtactttgggagaccgaggtgggcagatcacctgaggtcagaaattcaagatcagcctggccaacgtggtgaaaccctttctcaactaaagatacaaaaattagccaggcatggtggcaagcacctgtaatcccagtactcaggaggctgagagaggataatcacttgaacgtgggatgcagaggttccagtgagccgagatcaggccattgtactccagcctgggcaacaagaacaaaactccaactccgaaaagaaaagaaaagaaatttctacctcaaaagttaaaaattctggaggacagtctactaagcaaaagctttcaaaatgaatatatcttttcatttagtaattctaattttaggaattaatcctgagaaactaattagagatgcacaaacatttatgttcaagaatcttcttttatttgtcattcagtaaatgtttactgagtgcatcctaaattccaggtaggaatggaggatagaatcagttcttatcctcatggtactaacttaatagtggtgtttacaatggaaaaagagactattaaaaaagcaggtcatggccaggtgtggtggctcatgcccgtaatctcagcattttgggaggtcgaggtgggaggctcacttcaccccaggagttcaagatcagcctgggcaacatagtgagactctatatctattttataattgtttttaaaaagcaggttacaatagcaagaaatgccatatttgtggatcagaaaattcaatattgttaagatgttaatttctcccaaattcaatgcagtgtcattcaaaataccaagttttcatagaaattaacaagctgattctaaaattcatatggaaacacaagggacccagaagagccaaaaaaaaaactttgaaaaagaacaaagttagaagacttgcattacctgacttcacttattaaagtgccatagaaatgaaaactatgtagtattaaatcagtcacaaaaatccattaaacaaaaaagactgtccagaaatagagtcaaatagaaacagtcaattgatttctgacaaaaatgcagtcaattcagtgaagaaaggatagtcttttcaacaaatggtcctggaacaattgccttttccatacacacacacacacacacacaaagaacttcaagttgctccccacgccatatacaaaaataggatcaaaataaatcagaggcctgaattaaaaacctaaactataaacctcctaaaaaaaaatacaggagaaaatcattttgatcttgggttaagacttctcagatataacaccaaaagcacagtccataaaagaaaaaactgacaaactggatttcatcaaaatgaagaacttcaaaatccactactcttcaaaatccactgttacataaatgacaagatataccagactcaggggaaaaactgcaaatcataaatcttataaagcacttgcatccagaataaagaactctcaaaactaaatgataggaaaataaacaatcaaaatttttttaatgggcaaaacattcaaatggacacttcaccaaaaaagattaagtaaacatttgtttgtattttccaagtactccagtttcctcttctcatatcctaaagatgtgcacattagattcactgggagattgaaattgtcccagtaggaatgagtatgggtgtgtatttaagtgcaccacgcaatggaatgtcatcctgtccagggttggttctgtgccaggataggctctagccaccagaaagcctgaaccctagagcaggctggaaaatgaatgaatgaatgaatacaaattattgtaaaatgaaatttcaaataaagtatataatcatgtaaatgcatgacaatactatgtagtacaaaagcactcttatcaagcctgccatatttgtgattatttttgaactgcatgatagtaagaggtgtcccttatattttttgctttgcaaacatttatttcttgggttaacccaccaccactatgaccattgtcactcactggttcaccaaaaattaggtaagtaactatcttacttgttttttttactaatctttcttaaacattatagctcacatttatttcaacgtttaatgttggaagtgtcttgggtctttatttagaagtttgatgatgttttttgaccagagatatgccataggaatttaactattgtttttatcaattagtctagggtaaagttggtttcatgatacatcatttcacttaaagtcagtttccaagaacctatcaataatgttaagtgacggccgggcgtggtggctcatgcctgtaatcccagcactttgggagggcaaggcaggcagatcatgaggtcaggagatcgagaccatcctggccaacagggtgaaaccccatctctactaaaattacaaaaattagccgggtgtggtggtgcgcacctatagtcccagctacttggaaggctgaggcaagagaatcgcttgaacctgagaggtggaagctgcactaagctgagatcatgccactgcactccaccctggcaagagagcaagaccccacctcaaagaaaaagaaaaataaaaaataatgttaagtgacgacatactgtacacgaaatatgcagtgggagttctagaaggtcagtaaagagagaaagaggcagaaaagaagttttgaagaaataatcgccaaaaacttccctaatttaatgaaaaacattaattgacacatctaaacagcccaacaaatccaaagaaacctgcaaatgctgaaacacaaagaggaaatctttaaaaaggagcgagagaaaaatgacttcacatacagggcaacaacaatattattaacgttgatttctcatcagaaatgacatggaaaaaacaaatttttttaaagaaacacaaaaaactcaccactaaaaattctatattcagcaaaactgcccttcaaaaatgaagatgaaataaagacattttcagatagataaccaaagacgaagacaagtcgctgctgtgagacatgccttatgagaaataacaatggaagtccctcaggataaaaggaagtcacaccataaagtttaatctaggctgggcacagtggctcatgcctgtaatcccagcactttgagaggccaaggtgggtggctcacttgagcccagaagttcgagaccagcctgggcaacatggcaaaaccccatctctacaaaaaatagccaggtgtggtggcacgtgcctgtagttccagctacttgagaggctgaggcaggaggattgcttgaactgggtaagcggtggctgcagtgagccaagatcgcactattgcactccagcctggaaaacaggagaacctgtctggaaaaaaaagaaaaataatactctacaggagaatgaagctcattggaaactgtaattacatcagtaaatattaaagactctaaaaatataattattttcacttcatctcgtttaaagacataagactacataaaggaataattatagtactgtgtcgctgagtttgtaatacatacagctgtaatatatataataataatagcaccaaaaagagaaaaaacagataacactggaggaaagtttctataatttatcagaatttagtattattctgaaggagactgtaattaagttaaaaggcatattgtaatccctaacaatatagcaaaagaaatcaacagaaataaaaagatacactaaagaatatttaacacagaaagatggtaaagaaaagaggaaaaagcaaaaaacaaatgagacaaatagaaaacaaatatgaaaaatgcagatgtaaatccaataatatcaacaattacattacatgtgaatgaactaaacactctattcaaaggggggattatattacaatggattacaaaacctaactataggctgtcaacaagagataaatcttcaattcaaagacataaacaggttaaaattaaaaggatttttttaaaaaaatacaccatagaaacagtaaccacaaaaaaaactagagtggctatagtaccaagaaaaatagattttaagataagaaatattacagacaaaggaggccatttcataatgaaaacagggtcactatatcaggaagatataacaataactgtccatctaaccaaagaaccccaaaatacatgaagcaaaaaaagagataattaaaaagagaaataggtaattcaacagaaacagctgaagactgcaatgactgatagaaaaagacagaaaatctgcaaggatatagaagtcttgactaacctcatcaataaacttgacataactgacagaaaataccacccaatgattgcagaatatacaacctttttacaaacacaaggaaaattttccaggatacaccacatactggggcacaagacaagtctcaataaaatttaaaagattgaactcataaaaaatgtgtgatctgatcacaatggaattagtcatccgaacaaaaataaatctaggaacacctcaattattggtaaattttaaaacatacctctaaataacccattgatcaaagaagaaattgcaaggaaaaattttaaaatatatttcgaattgaatgaaaacaaaacacagcaaaccaaaatgtacagaatgcaactaaagcagtgcttagaaggaaatgtatagttttaaacatttatatgagaaaagaaaaaaggtctcaaaccaataatctaagcttccatcttaggaaactagaaaaataaggagcagaggggatattaaacccaaaacaagcagaaaaataataattttgtagtgtggaaatcagtgaaatagaaaatatagatatgaaaaataatcagtgaaataaaaggttggttctttggaaagatcaacaaaatcgaaaaaaaaaaaaaaacttcactatactgaccaagaaaataagagatacaaattaccaaaatcaagaatgaaagagggaaaattattgccaaccttaaattattaaaggatttcttaatacaaacttcgtatcaacaaattagataatttatatgaaatggactacacttcctagaacatacaaattaccaaaactctagaagaaagagaaaatctgaatagacctataacaagaagtgaagaaactgaaccaataattttaaatattcccacaaagaaatggccaggcccccacaactgcactaatgaatgctatcaaacatttaaagcagtaagagcaagatcacgagcaaccaacagactaatatccctcaggaacatatacccaaaattccttaataataatcagacaaaccatattcaacaacatataacagagattatacagcacggactgggcatggtggcttaagcctgtagtcccagcactttgggaggccacgcaggtaaatcgcttgagccaaggagttcaagaacagcccaggcaacatggcaaaaccctgtctctacaaaaaataccgaaaaaaaaaaaaaaagaaaaatagccaggtgtggtggcatgagcctgtagccccagccacttgggaggcggaagccggagaatcgcatgagcccaggagtttgaggctgcagtgagccaaaatcacaccactgcacttcagcctgggtcacagagcaagagtctgtctcaaacaataaaaaaaaaaaaaaaaaaaaaaaaaaaaagattttacagcatgaccaagtgtgatctgtcccaggaatacagggtgggtttaatctccaacaatcaattaatatatagcatactaacaataaaaatcatataaccatatcatcagatgcaggaaaaaacatgacaaaatctaacacccactcatgattaaaaacttgcaacaaactaggaacataagggagcttccttaaccttcttcaaagggcatctatagaaaatctacagctaacattatacctgatggcaaaaatctgcatgttttccccctaagactgggagtaatgcaatgcacattcaacacttctcttcaacatcttactggagggtctaacccaagaattaaagcaaaaatgaagaaataaataacattgagattggaaagaaaaagtatcgttttgagacatgatcatctatgtacaaacaatatgcaaaaattggttgcatttttttttagacagattctcgctctgtcttctaggctggagtgcagtggcacaatctcagctcactgcaagctccgcctcccgggttcacgccattctcctgcctcagcctcccgagtagctgggactacaggtgcccgccaccactcccagctaacttttttgtatttttagtagagacggggtttcaccgtgttagccaagatggtctcgatctcctgacctcgtgatccacctgccttggatcccaaagtgctgggattacaggcgtgagccaccaagcctggacgattgcatttttttgtgctaacaatgaacaatttgaaatcaaatcatgaaaactccatttccaagagcatcaaaattataacagtcttaggaataaatttaaccaaataagtgcacgatttgtacactgaaaagtaaaaaacattattaagagaaatgaaagatctaagtaaatggagagatattacatgttcatggattggaagactcaagatggttaagttagtgattcttcccatattgatggatagattcaatgcaaatcctacaaacatcagatgtgtttttgtagaaattaacaagctgatcctaaattgtatatggaaatggaaagagcatagaaccaattttgaaaaagaagaaaatgttacactacttattttgaaacttactataaaactgcagtaatcaagacagaatagtgttggagtaaggataggtttatagacatgagtcttggaataaattcttacattatagtcaactgatattttacaaagatgccaatacaattgaagggaaaagaacagtctttttaacaaatggtactggataatttggcattcacatttttaaaaaatgaacttagatcctcttcttacatcaaatgcacggttaattcaatatgaatcttatatttaaaggaaagagctcaaagaagacctttgggagctcaaagaaaaatctttgggaccttggattaggcaaaaagttcgtatacataacatgaaagtacgtgccacacacacaaaagaaatgacttcattaaaaacttttgcacttcaaaagacaacagtaaaaatatgaaaagccaagacaccaactgggagaaatatttgcaaatcttatctctgatattaaaaacaatacaaactttcatccagcatatataaagaactcttacaactcagtaagaccaaaaaaaaaaaaaaaaaaacccagctaaaaaatgggcaaatgccttaaacagatattccaccaaatggccaataaccacagaaaaaggtgtccaacattactgtgcagggaaatgcaaattaaaattacaatgggatactactagatactaactagaatggctataattaaaaagataataccaactgttggtgaggatgtggagaaactggaatcatcatacattgctggtaggatgtaattggtacagctactttggaaaacattttgacagtttctttaaaagttaaaaataagcttaccatataattcaacaattccactcctaggaatttacccaaaacaaatgaatacatatgctcacacaaggaattacagacaaatcttcatagcagcattattcataacagccaaaaactggaaaccatccaatgtctatcacctagtgaatgggaaatactattcactggttaccagtaaatgggaaatactattcaccaatactattcaactggtgaatggaaaatacacacgaatactatgcaacaattaaaaagaacaaaacattgatatacatacattaaataaacctcaaaagcatgaagttaaagaagccagatgcaaaagactactgtattgattccatttatatgaaatatgtagaaaagacaaatttatagtgatagaaagtagatcagtggttctctggggctgtgggaaggagttaccttaaatgcaaataagcttgagagaatctaggagactgataaaatgtcagaaattgccttgtgatgacagtcgcacaactctataaagttgctaaaaaccattaaattgtacacttacaatgagtggtttttatggtaggtaaaatatatctcaataaagctgtttaaaaagggctaggtagaagaaagaagttatctcttccaaactttggaaaatttgttgatagttgtagtaatcaaggctgagttcaaaggatgaccaagcaaaaagaatccaggttcttaaagattatcactaagccacttaattgacaatcttagaaccacctatctccagacttcttacatgtgagataatacaatttccttcttaaggctttaaaaaagaaaaagaaaaaagaataacgttgctaattctaagggacacaggacatgttcattccattacagaaaatttgtaatatcatccatagaggaagatatcaaagaaaaggcaggaattttggtggatcttgaaggatgaaagaatatgacgggggatggggaaggaaaagaagggtatgtagttcagaagagtcattaataatggcaaggataaaaatcaacaatgcccactaaaagtcaagtttacagcttaccttattttaatccatacattaaggaccaaaaaattaagtaactggttcaaaaagttacgcagctagtaatctaaccttcactctcaggatccaggctccaaagtacatactctttcctctgttacgctgctaaacaaggacttaaactacccccatttgcaagttcagatctttgtagagggcatctttatttagataggtttacatttataggactacacactcaatgtttcttgagcaacaatttccatttaatcaataaactaaatgtgatgtgcattctttctttggtttccaaaacgttaccctactctggttttcctaccttctttctcccccttcctattacatgctggtgttcacaagctctcttctgattctacacaactctcactaggaacctcatctatacctggtatttcaactaccactaacgttgatgactcttctctctctccaacttcaagaattgttttcctagttttctttgactaacttcctccgggccaagttgaatactgctctgtacaccctacaactacacttacaagattctaaagagacattcctcaatttttgtgtattctttctagttctaggccaggtattcttcctacatgccccaaaacacattcttatctatccttatagcatttaacatgctttattacaaattactaattactttgtccatttctcccatcagagaataaggtgcttgagacttagcactatgtcttattcacaatctccccagtgcctagcatagcatgagacacataataggcactcaaatattgattaaacccatatataagagaaataaaatttgctttaaattggaagcataccatttctgaaggaaactttcagagatttatgttttcaaatgagaaaataggccatgaaaggtgaagtgactcacccagtcaagccttggtctcctgaatcacaattctcttcccacaaaattacagtgcctaggccgggcgcagtggctcacacctgtaatcccagcactttgggaggccaaggcaggtgggtcataaggtcaggagatcaagaccatcctggctaacatagtgaaattccgtctctcttaaaaatcaaaaaattagctgggcatggttgcatgtgcctgtagtcccagctacttgggaggctaaggcaggagaatcgcttgaacccaggaggcagaggttgcagtgagctgagatcacaccactgcactctagcctgctgacagagtaagactatgtctcaaaaaaaaaaaaaaaaattagagtacctattaaattgtgcttagtgatctcagctttctatgaagctctagaagtaatacaaaaatgttataaagaaccatttcaacttcatccactccagctctggctggctatatcagttgtagagaagtctgttattacataatactttttctgcccagaataatctttaattgaaccagtattttcacgtgtccttcacacaaaaaataattcaatacatacttattgagacatgaagccagctgggattctgggtccggtgtggacttggagaacttttctgtctagctaaaggattgcaaatgcaccaatcagcgctctgtgtctaactaaaggtttgtaaacgcaccaatcagcactctgtaaaaacggaccaatcagcactctgtaaaatggaccaatcagctctctgtaaaatggaccaattagcaggatgtgggtggggccaaataagggaagaagagctaggcacctgagccagcagcagcaacccacacgggtccccttccatgccgtggaagctctgttcttttgctcttcgcaataaatcttgctgctgctcactctttgggtccacactgcctttatgagctgtaacactcaccacgaaggtccgcagcttcactcctgaagccagcgagaccacgaacccaccgggaggaatgaacaatgccggacgcgccacctttaagagctgtaacactcactgcgaaagtctgcagcttcactcctgaagccagcaataccacgaacccaccgggaggaatgaacaactccggacgcgccacctttaagagctgtagcactcactgcaaaagtctgcagcctcactcctgaagtcagcaagaccatgaacccaccagaaggaagaaactccggacacatctgaacatctgaaggaacaaactccggacacaccatctttaagaactgcaacattcaccacgagggtccgcagcttcattcttgaagtcagcgagaccaagaacccaccagaatgaaccaattccggacacattatcatgcatctctatgtggaaaacaatgtgaaagaagttataattcatcagtactctaaaaaatatccttaagagcatatattgcatgccccttaagtttaacaatatctgaaatagctgccttaaaacaaaatgcaatcacacttgagagaggctgaatatgaacatcagagataggcaatgcaacttcatcaggaaaatccctatagtccaatgctactgttttcaagggttgctatattatactgcaattgtgttactgggcaacaactcagaagctagaatggcaaattcactcaagaagtaactgaatcaaacgaatatttatgaaagcattctgagactcaacttcactttctatatcttcaactgaagtaactctttgttataagcattagatacaggatttttggtgagactgtaaaaactacatggacattttatagacatattttgagacagaagataggtgctttccaaaagggaatggccaggtttaggttcctactaactctgaattttaatccaaaagcaatctgaagtcacaatatacagaaggcaaataactgggcatttccttaatttcttccatcctggattatagctcagttaaaagaaatagtaggccgggcgcattggctcacacctacaatcccagcactttgggaggccaaggtgggtgaatcacttgaggccaggagttccgagaccagcctggccaatgtggtgaaaccctgtctctattcaaaatacaaaaaaaaagccaggtgtggtggcatgcacctgttagccccagccacttgggaggctgaggcaggagaatcacgtgaacccacgagttcaaggttgcagtgaacaaagattgcaccactacgctccagcctgggcgacagagcaaaactccatctcaaaaaaaaaaaaaagaaaaaagaaatagtactagacttgacagtcagtgatctctccatgacctagagagggcagtcctgatgaaaaaaatataattaataaactgatattctactaggaaccaggaaattgaccaaactccccaagcccactgaagaatagtgccagcattcctgagagtccttactgctggtattgccatgggaaattctcaaatactcactttctaggaacagaatctttatttctgattccgtgaattcccactcttcaatcttttttatagtttactgttgccatttccccttcacttactctcttctctcaacaaccttactttcatgatacttacaaaagtgggggaaagtagaaatgcctatctgtcattgtattagtccattttcatattgctataaagaactgcctgagattgggtaatttataaaggaaagaggtttaattgattcacagttccacatggctggagaggcgtcagaaaacttacaatcatggcagaaggtgaaggggaagcaaggcaccttcttcacaaggtagcaggaaggagaatgaatgcaggaggaactaccaaacacttataaaaccaccagatctcatgagaactcactgtcacgaggaacagtatgggggaaaccgccgccatgatccaattccctccacctggtctcttccctgacacatggggattatggggattataattcaaggtgagatttgggtggggacacaaagcctaatcatatcagtcatctttaagaaacatttattcagcaacttgtatttggaaaagactaaggatacagctcatcgagatctgaagtcctgcccttaataagcttacaatctagttaggaagtcaagaaagctaaaataatacaataaaaagtataagtatcaaataaatttaactcacaaatacatactattcctatgtatgtatgtatgaggtcatggtggagttgaaccttatagaaaaggtacaatttagattttaagaaagaagggaataagatcaggtcacgggggatagaaagatatgcagactaatatggaaaggataaagtacagagcaggtttaggggatagtgaagaaaccaatctgggcagagacaccttttccataaagaacatacacttgaaaaggcaaggtgagaggatttcaaataattcaccttaagtcaagaaacatgaacttgggttaaaaggaagttttttacacagatttacacacattccctaaaagcacataggttaaacaatgtgggcaatttacttatggaacctaatatgtatgacaaaattaaaagcaagctcatctacttttaggcaaagagacagtacctgggggtggggaaattctgacaattcactaaaattcactaatctttctgttaagatttcactctaagcttcttgaattagaacatcccatgacataatgctgatttctgattactaaggattatacgagtcattcttgatttgtctcctccatcttgcccaacttttgaatatttcattacttcaacatcagcatatagaaaaaaggaggagagaactaaaattaagtccatggattttagcaatacataagggtatctgacataaagaacattaaacttcaagttccaattcccattattaatagatttcaaagaagtcatttagtctcatcatgtctcaaattttctcacatacttgcttacttgaaaggttattgattgaaaagatcattcaaaaagtgctctaaaaactaacaacttgccataaaaattttatcattaagggttcaataagaggagacagtgaggtgactggtaaaccaaggattaaaaactacctgtgaataggccaggcacgctggctcacacctgtaatcccagcactttgggaggtcaaggtgggcagatcgcctgaagtcaggagttcgtgaccagcctgggcaatatggtgaaaccccatctctactaaaaatacaaaaattagcagggcatggtggcatgcacctgtaaccccagctactcgggaggctgagaggagagaatcacttgaaactgggaggcggaagttgcagtgagctgagatcccaccactgcactccagcctgagcgacaagaatgaaactctgtctcaaaaaaagaaaaaaaaaaaaactacctgtgaataatcagtgtttcattctcccagtgctgcatggaattctaaattgtatttcactattatttgagaatgttctaaatacagtccgcgcacttcatctgatctggaaagaaaacactcaaagtaaggggaatacccagcatactctgtcctaaataaccaaaggacaactcaaaaccatttgcaactctcaggagagtcctgtgtgacacttataatttaaagcattctggcctggtgcggtggctcacacctgtaatcccagcactttgggaggccgaggtgggcggatcacctgaggtcgggagtttgagaccagcctggccaacatggtgaaaccccatctctactaaaataaaaaaattagccgggcatggtggcacgcacctgtaatcccagctactcgggaggctgaggcaggagaatcgcttgaacccaggaggcggaggttgcagtgagccgagatcgcgctactgcactccagcctgggcgacagagtgagactcagtcataaataaataaataaagcattctaacaattctgaacaaactgagtttgaaatcaaacctcaatacaaaaggtgagtattaattctaaccacttacaggctaaattcataaatatggaaaattctaaatccaggtaactgtaggatagatacctttaattgtgttttagttaaatgtcagacttgtttacagacatgttgcttggtaacagaagcactgctttaacaacccactctgttttagagctgcttaaagtctgaacagattatgaagtatatatcatatacacgaaattcagacaagtctttccttatcctagagatctgtaagatttgaaagagcttcctcatttcagctaactaaaggctttacaaatacttagcagtggatattcttaagagcaaaatgcccattgattatggtcaaaagttggacactgaggattaaccaaagtatttaaacccagcatatgctaacatattttaggtgtttatctcagtaatgacagtcgacatcactgttcattcaaattgtcttcaaagccaaggaaaatggtagcatagctttttcatcgtaaattaagctggaggtacttaaacgtctggccaattaccaaactggctacacaaccaccaagccagagtgcatccaaaagctccatgaagagtttcacgtgcgtctctctgcctacttttctagcacgagcttccactactttaacaggaaaataaaaaaaggattcaagggcagtttgtggagggacaaaatgagtattccaaaatacaaacaagacaccgtccccagaaagagaggttacataccagacgcacgcacgctccttgcaacccgcacacggaaaacttaagtgaccgcagttctggccgcgctcgccaccggggacacctccacagctccaaccacaggcacccactcaactccgcttacggaggcattgggactaagggttacggtcctacagcggggtgtcggcccagcgagaggaagagggccgaacggacccctcgggctcccgtccctagggaaatgtgaagtatcccgggagaggtccgagggcggcggcggcggcggtgaaaagccccactcctccgcgtggaccgggatcctcaggggtgcggcgccaccccacgtgctgacgtatggcccagaagccgcctcatcgcaccgccccaccagcctggaggagcgggctctgtcccttggcccagcggcacgcgaagcaggaagtcccaccc

SEQ ID NO: 324 - DNA, 151709 bp, Homo sapiens; identical to SEQ ID NO: 323
  source 1..151709: mol_type = genomic DNA

SEQ ID NO: 325 - DNA, 28060 bp, Homo sapiens
  source 1..28060: mol_type = genomic DNA
agtgcggggtctgacagaggaggctccgtgtctgcagctagtgtgtcaactcagcgtttctcctctcgtccctggtgaggtgtagcggcggcacgcggctggagatcccctgtggcctccagtttaggaagggtccagcatcccaagggaggggtgtgtgggcgaggggtctctgggcccggggtcgcggctgtgaggagaggatgcccgcgcggcggcatctcaggcacctggaggaggccgcgctttctcctcagggaaccggcgccttggcagcccccggcgacgccgcccccttcgcggcctaggttggtctggtgagccgggaagcgggcgtcgttcgcagcgccgctgtgaccaccgcgtcccgggcggagctgggctcagtgccggcctgggcctagagtccgagcctcgagctgccggcgtggggggtcgcgagtggcctaatgcggcctcgaagccgaaggacccgagtccgagctcgcactccgacccgctggtgctgtggaaaactcaggtggccttccgctttcgtagcctctaaagtggggaccaagactttcacctcttaggattgtagtcgggattaaaagattttcccggtaagcgtttggcaactgctattatttgagaagccgcttacttcttcactccccatcaccgaccttcctggggacgggggcgattggaaactgccttggggtatctggacccggcaggggaagctccgccgcctcgggcagagggacggtcccctctgcggactagagagatctagctgacccccaacaggctccttataagcttgaagacttttctgtgcctcaactcttccgtgcattcgcccgtttccttgaccctttgaagtattgtcagtcctctgcctgaagaatctgaggcccagagaggttaaatctggcagaaccagccagaccttgacccccagagggggaccctgcaggctacccccagtctccttgcatctagaaaagcaagcacctgctacatctgagctctggccttagagttggccagagtgggctggaatagagcacacctgaaatcagtcggacagccttccttagttgccatttcatatcagagtgaatatctttttttttttttgagatggagtcaccttctgttgttcaggttggagtgcagtggcgagatctcagctcactgcagcctccgcctcctgggtttaagtgattctcttgcctcagcctcctgagtagctgggatacaagcgcccgtcaccacgcccaactaatttttgtatttttagtagagacttggttttgccatgttggccaggctggtctcgaaccccagacctccagtgatctgcccacctcgccctcccaaagtgctgggattacaggcgtgagctgctgcgcccagcccagaatgggtgtcttgaattatgtcattccctagtttaaagcccttcagtggtttaccattgagcttggaatcgaatccaatattctttctgtctgatatgacaagaccttcttgagtcattccccttttttattatgctcttccagatctgcctttactttctctttcattgcttttaggccttttgcccttcccactgcctggatggatttccccgcattcccatcctctatctttgtcttttcgtggttggctcttgtacttcagttcttaatttaaatgtcgtctccccagaaagttcttccctgaccactcttatctacctaaagtagatttgcctctattccgcccccatttatttgtcagtatacttttccatcacaatactcaagttatatgtatttttttgcttattgtttttctctaccactaaatcgctttatcagagactatatttccttattttgtaaagtatttttagtgccagggcacagtggcacacagtatggtcttctttttctttgagacagggtctcactctgtcaccccggctggagtgcagtggtgtgatcacaactcactcactgtagcctcgacctcctgggctcaagcctcccaagtagctgggactacctcagcctcccaccccagcctcccaagtagctgagattacaggcatgtgccaccatacccacctaattttttgcttttttgttttttgttttttttgagagggagtctcgctctgtcgcccaggctggagtgcagtggcgtgatctcggctcactgcaagctctttttagtagagactgggtttcaccatgttaggcaggatggtctcgatctcctgaccttgtgatccacctgtctcggcctcccaaagtgctgggattacaggcatgaaccaccgcacccggctgcttattttttataaaggcagggtcttactatgtttcctggctggccttgaactcctgagctcaagtgatccacccaccccagccttccagagtgctgggattacaggtgtgagacactgcacctggcccacagtattgtcctttttttttttatttttattttttgagacagaggctcactctgttgcccaggctggggtgcagtggtgtgatcctggcttactgcaacctccacctcccgggttcaagcaattctgcttcagcctccctagtagctgggactacaggcacccggctaatttttttatttttagtagagaggtgtttcgccatgctggccaggctggtcttgaactcctgacctcaagtgatccgcccacctcagcctcccaaagtgctgggattacaggcatgagccactggacccagcctcaaagtattgtcttaattaagcatgttgaacaaatgactaaatacatgttttgaaaagtggcaactcgcttgataatgccaaaacctttaaagaaccctactgggggcaggatttaagaccatttttgtatcatggaaaggaataatctaaactaaacaatggtagtaaagttgccagtgctttgctttctgcattgacatcttgtttaaaaagcaggagaaactttatagtgaagaaatttggcagacaccatatcaactatgtgatcatggtttacatcaatagtaaaataagactgttgacatcatgtaccttctgatataaggcactgagatgagcacaacatgatttctatggtgttcttgccaaaaatatataacctgaatttaatcatgagaaaatatcagacaaacccaaattgaaggatattatataaaataactagctggctgggcacggtgactcatgcctgtaatcccagcactttgggaggctgaggctggctggtggatcatatgaggtcaggagtttgagaccagcctggtcaacatggtgaaactccatctctactgaaaatacaaaaattagctgggcatggtggtgcacacctgtggtcccagctactcaggaggctgaggtcgaggttgcagtgagccgagatcgcagtgagccgagatcgcaccactgcactccagcctagacagcagagtgagactctgtttaaaaaaaaaaaaaaaaaaaaagccagtatgcttaacaaggtcatgaaagagaaggaaagactgaagaactctcccaaatcaaaggagattaactacaagtaatagccaaatgcagtgtgtgatcctagattgaatgctgaaccagaaaaagggtgggatggtgattttttttttttttttttttttttttgagacaggatctcactctgtcacccaggctagggtgcagtggtacaatcactgctcactgcagctttgacctcctgggcttaagtgatcttcccatctcagccttctgagtagttgggaccacaggtgtgtgccaccacgtctggctaatttttaaattgtttgtagagaagggtttcaccatgttgcccaggctgatcttaaactcctgggttcaagcgatcctcttcagctcagcctcccaaagttctgggagtacaggcatgagcccctgtgcctgacttgttggtgaaatttgaatgaattctatagattagttactagtattgtattagtgttaatttcctctatttgataattttactattgttatgatgcttttagggtaattggatgaagtctgtaagggatgttattttatttttatttatttatttatttttgagacggagtcttactctgtcgctagggtggagtgcagtggcacgatcttggctcactgcaacttctgactccctggttgaagcgattctcctgcctcagcctcgcgagtagctgggattacaggcatgcgccaccacacccagctaatttttgtatttttagtagagatgggggtttcaccatgttggctaggatggtctcgatctcctgaccttgtgatctgcctgcctcggcctccctaagtcctgggattacaggtgtgagccactgcgcctggccaggatgttattattattattatttttgagacagggtctcactctgtcacccaggctggagtgcagtggcatgatcatggctctctgcagccttaaactcctaggcttaagcattcctcttgcacattcctcctgcctcggcctctcgagtagctgggactacaggcacacatcaccatgcctgggtaattttttttttttgtattttttgtagacatgacgttaccccatgttgtggccaggttggtcttaaactcctgggctcaagtgatccgcctgcctcggcctcccaaagtactgagattacaggcatgagccactgtacccagcctagtaaaagtattttattttattatttttattttttaaaactcccttatccaataaaattattttaaattgaaaattttaaaataagaaaatcccaagggactggatattgaataaaatgctttaacatgcaggtttgggtgacagtttctgtatactagttttttatttgtttttttgcatgtcatctttaaagcagaaatgaaagagaaagttcatgtcttcctttgtggttttcaggaagagctaaagatggctgaatttctagatgaccaggaaactcgactgtgtgacaactggtaagacattaaatctaagaaatgttagtggaatgaggacagtcaagcttaatcactatcatttcctgatttaaaaactgttagtgaagactggcacagtcttgagttaagctttctattttggtgtttataacccacatgaattacaagaaagagcatctctttcctgatgaaatgaaaccggttgtaaagttaataatcagctggttcctgttggggttttcctaagaacttatcttggtatcttggtgctatacaagtgctgttactgtaagctgacaaaaaaagcaaagcagaactgtctgctatgtttattactttattttccttcactgggtacttctttcacaatgtgctatgtttaccttagcaaactgtggtagaaagagatgtggaataaggaaaatagtttaactcattggtggaatatttgagccaaataacatttttgtcatcatcgttgtctttttctttcttctcagcctaactttggcagaattagaatataattagagcaacagctggttacaatattctttacctgcttggaattaagatttcatctcattgtaggtgtcttgccatattgtagagtatttctgctatgccactatcactttctaccatttcataaactattttagttttgtttgggttttatatgtatagctactgaaacagagtaatcagaaacaaataatcaaaagaaaacatgattttgtaagaaaagagacacattggtttttagcattagttaagatacacctattttatcagtccactccaattaggaggaatctcaagcctaggacaaaatataaataactatgctaagagagttaaagggtgagttaatggaaagctagtgaaaaacaatgctattcaaagccaaagaaattaaagaaaaaagcagattagcatagaaggctgactaaacctgtaaagaattaatttctggctgtttgtgtttagtgtttggaaagttcttgggaatttttctggaagctttggtttgcctttcagctatttctatctaaatgaaatttcacctctaatttgctagcccttccttgagacttttagcagttttatctggatacggaattgtgtgctcatttatctcacttaaaacatcttcattttctccgaaggtaggaagtaagcatattagtatttggtctggttggaatgtttggtaggaatatgttggcagttaaattttaaaagaaaaaaacccagcaggcaactgttttatataattgttgcaaatatcttttttatttcagcatttcctaagaggtgaatatgtgcaatagtaaatgctttgtggtcttacttgacagctgcttttgattcttgttgcttcatattatgatggtgtggtccttaatattttttgttttaattctaaagttttaggggccttgtgtatgtagtatgtcaacaagttatcctgaacagccttgtaaagtaaatgctagacatttagtgtctccatatttaccattaaaataaaaattattgccaatattatgaaaaaggaacccaggttttctacaccctaagcagtaattactggctttaattttcatggcatttgtacatacatgatttacaatcacaatataacatttcttctttcactttgttggtatactatatgtaacttagctattcctttcttgcttaggtatttttaatgactttcattttttaccattctatgatactgtaatgaaaatattcatacataatcccaagagtaggattattgtgttacagagtatataattttatggtcctagaaatgaattttcagactgtttttaggcagtttatactaccaccagtaatgtattaaagtattcatttcacaacatctttaaaaagttgggatgtattattttaactaaattaattcaaaatgagtagtttccttagaaagctaaaaatttgagagaaatatgggaagttaaatctgtcagtaattttcctctttatccatttgagttttcttcccatctctcacagttgattgttctgtcaccttccagtgctgctttgagagctgccttggggtccctagcttgataattccaccactggatgaaaatgaatttgcacttccttggtgtcttggtctttcagtttggaagaatgactatagctggaggcacatcatttatcctacttcaaaatgtttcttagacaatgtctgaatattaaaggttattaaaagagaaataagctatttataatttagtatgggagacagttcttctagtattcagcttcagaggcaaaatatggtattaaataatgtgttttatgactatctgtattgatcctgttcagtattttatttttctgaattattgttatacgtaccttctttaatgtagtttttagctggtgaaattggaattttacaatggtcctatccaaataagtaaaagtaaggcctttgaatagaatgtacctttagttcgagtacatgtataatcttttcatgtttaaatggtcttactctttcatgtaacattatcactttacctccttaatttgtatagcttagatatgatctttgaaccactaaactaagtgagaaaggcaaaaatgaagtggagagaccagactggtggaggaaagggttcaggatttcatttttgtacagctttacagtgaagtttctaccaacccagccagagagcatgttcctgtagtcaggaagcatccagcctgcttcgaaaggcatgtgaggcatacaggagacaatttccccttcccctttgactgtccaaaagctggagtcttctctttttggtttgacttttcatggaataaaatccaatgaaattaaactacttaaaagtgagagaaaatcagtggtagggtgttttttcacttgtttttgttgttgttttggtttgttttctgttttaaaataatcctggagcgtatcactctgctttgggacatggatggttttggaatagcctagctccactctttttggcatctgacttcatgttgtgatcagctctgactttgagaaagtaaggctgagcttttagatgtagtagtgcatagcaccggtaactcagaatgttgcacagaagagccttcaggatttagttctttttttttttttttttgatacggaatcttgctatccccgaggctggagtgcagtggcatgatctcagctttctgcaacctctgcctcccgggttcaagtgattctcctgcctcagcctcccgagtaattgggattacaggtacccgccaccacacctggttaattttttatatttttggtagaagcggggtttcaccatgttggctaggctggtcttgaactcctaacttcaagtgatctgcttgcctcagcctcccaatgtgctggcgttactgcacctggaaaggatttaattttttttttttttttttttttttttgagacagagttttgctcttgttgcccaggctggagtgcaatggcacgatctaggctcactgcatcttccgcctcccgggttcaagcgattctcctgcctcagcctcctgagtagctgagattacaggcatgtgccgccacacctggctaattttgtatttttagtagagacggggtttcaccatgttggccaggctgatctcgaactcctgacctcaggtgatctgcccgcctcagcctctcaaagtgctgggattacaggcgtgagccacggcgcccggccagttttttttttttttttttatagcaacctctgcctcctgggttcaagcgattctcctgcctcagcctcccgagtagctgggattacaggtgcccgccatcacgcctggctaatttttatatttttagtagagatggggtttcaccatgttggccaggttggtctcgaacgcctgacctcaggtgatccgcctgcctcggcttcccaaagtgctgagattacaggcatgagccaccgcgcctggccaggatttagttcttgaaaagcaggaatggtaatagtcatgagtttgtaggctaggtattcactaaagataaataatggagactaaagattggacaggacagatttccatgtgatgccactgtgcaagaaaaggcatagattagtcagtaatgcttgcctttttctttggtctatttccgtagcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgagccaccaagtactcaaatgtttatacatgtgttatacttgctgttgttcgtaaatgtattctgtttgctattgtgcaatagcaaatgagcatattgtcccaaagccaatttactgattctcacttcttactctaggtgacctgcaaatgtaacaagaagttggagaagaggctgttaaagaagcatgaggttagtccatggagtgagttaccgtgggcccagtcctgctgagattacagacccacatgcagagcaggaagccagtctggttgagtgttagttctccgtgagctcacatgcatactgtttctcaaagcctgtttgaggccttgactatgtaactgctgccagattcggctacctggctgttggaactcacttgtgtatgttgagactcgcgaagtatctccctttggaactgagtctattatttctgttggggtttggttattggcagcctcactgaatatgaagccagccctagagttgccagtatgggataacctctttagcacacagcctgccttacaagctgtcatttcatttaaaattcttttttgtttgtttgttttttgagacggagtcttgttctgttgcccaggctggagtgcagtggtgtgatctcggcttactgcaacctctgcctcccaggttcaagcaattctcctgcctcggcctcctgagtagctgggattataggcgcccaccaccactcccagctaattattagtagagacgggatttcaccatgttggcctgaccttgtgatctgcctgtcttcagcctcccaaagtgctgggattacaggcgtgagccaccacatctggcttcattttaaaatcttgaacacctggataacatgctatttaacctaagaaattcctcagcatttggtgagagagaatagagtatcatttgctcgctagttgagataaaactggccaaaggtttttttttttttttttttaaatacagacagggtcggctgggcatggtggctcatgcctgtaatcccagcactttgagaggcagaggtgggcagatcacttgaggtcagagtttgagaccagcctggccaacatggtgaaaccctgtctctgttaaaaatacaacaattagctgggcgtggaggtgtgtgctacttgggaggctgaggcacgagaatcgcttgaatccggaaggcagaggttgcagtgagccgagatcgcgccactgcactccagcctggatgacagggtgagactacatctcaaaaaaaaaaaacccaaaaaatagagacaggtgttgtctctattgctgtgttgcacaggttggtcttgaactcctgggctcaagtggtcctcctgcctcagcctcccaaagtgctaggattacaggcatgagccactgtactcagcccaaagttttttttttttttttgagatggaatcttgttcccgtcttgcaggctggagtgcggtggtgcagtcttggctcactgtaacctccacctcccaggttcaagcgattctccttcctcagcctcctgagtagctggggttataggcgtgctctaccatgcctggctaattttttttgtatttttagtagagacaggattttgccatgttggccagggtgatcttgaactcctgacctcaggtgatccacccaccttggcccctcaaggtgctaggattaaaggcgtgagccaccatgcccggtcatttttcttttttttaattaaaaaccttttttaagagacacagtctcactctgtcacccaggctagcatgcaatggcatgatcataactcactgcagcctcgaattcttgggctcaaatgatctacctgcataggtggtactacaggtataggcctctatgcctgactaattttatttatttttgtttttcatagagttggggtcttgttatgttgcccaggctagtctcgaactcttggcctcaagtgatcctcccttcttggctttcccaaatgtcgagattacaggcgtgagctatggcatctggccaaaactggccaacgttgaatgagtatgttaattcaccaatttaaaaatccagccgggcgtgatggctgatgcctgtaatcccagcactttgggaggctgaggtgggtggatcacagggtcaggagttcgagaccagcctggccaatatggtgaaaccccgtctctactaaaaatacaaaaattagctgggcgtggatacgcacgtctgaaatcccagctactcagaaggctgaggcaggagaattgcttgaacctgggaggtggaggttgcagtgagccgagatcgtgccattgcactccagcctgggtgacagggtgagactccatctaaaacaaacaaaaaaaaactggctcaccttgttttcaagtgttgacataaacagtcaaaagcaccactcagtcttttataatgcaagtgaaatcagtgctgtgccccttcaaggaaccacgtgacagtttgttcagttgagcacaagttccttgcaggaacagttgctggcagaagggctgtgtctacagcccatgtggaaccaaggacagttttcccattcagtagggagcatccctcagccttgatcttcatttcttggctgggcgcagtggctcacgcctgtaatcccagcactttgggaggctgaggcgggcggatcacgaggtcagaagattgagaccatcctggctaatacggtgaaaccccgtctctactaaaaatacataaaattagctgggcgtggtggcgggcgcctatagtcccagctacttgggaggctgaggcaggagaatggcgtgaacccgggaggcggagcttgcagtaagccgaggttgcgctactgcacttcagtcagggcgacagagcgagactccgtctaaaaaaataaataaataaaaataaataaataaaaatccaaacagctgtttatatggtagttatagaagagtggatatacatatgtaaaaattcaccaaggtatatacttaaagatttgtgcatttcattctgtgtgcctcaaactgtaacaacttgattttattaatttataattaaattacccttaaaggtaattcacagcgggctacagtgactcatgcctgtatcctagcactttgggaggccaaggcgagagcattgcttaaaccaaagagttcaagaccagtctaggcaatatcgtgagacccctatctctacaaaaaactaaaaaattagctgggaatggtggtccgttcctgtagtcccaattgctcgaggggctgaggtacgatattgtttgagcctggaggttgaggctgcagtgagccctgtttgtgccactgcattccagcctaggcgacaaagtaagaccctgtttcaaaaaaataaaaataaaaataaaaaggtaggccaggcgcaatgactcagcctgtaatcccagcacttttggaggcagaggagggcgggtcacttgaggtcagaagttcaagaccagcctggtcaacatggtgaaaccccatctctactaaaaatacagaaattagccaggcatggtgccgcatgcctgtaattccagctactcgggaggctgaggcaggataattgcttgaacctgtgaggcagaggttgcagtgagccaagatcacaccactgcactccagcctgggcaacagagtgagactgtctcaaaaaaaaacaaaaacaaaaacaaaaaatgctgggcgtggtggctcacgcctgtaatcccagcacttcgggaggctgaggcaggcagatcacatgaggtcaagagttcaagaccagactggccaaagtggtgaaaccccatctctactaaaaatacaaaaattagccaggtgtggtggtaggctcctgtaatcccagctacttgggaggctgaggcaggagaattgcttgaacccaggaggcagaggttgcactgagtcgaaatcatgccattgtactccagcctgggcaacagaagcgaactccgtctcaaaaaaaaaaaaaaaaaaattaaactaaagttctattctaaatgctactccaacattttcagcactgtttgtatatacatgaactacctcttgcaggaaacacaataaattgataaaaaggccttaggtagcagaggaacaggggagaagagacatgatttttacatatatcctttttgggctttaaaattgtataccagctgtgcacagtggctcacgcctgtaatcccagcactttggaaggccaaggtaggaggactgcttgagcctaggagttttgagatcaacctgggcaacataaggagacccttgtctctacaaaataaaaaataaaacaaaaaacctagctaggcatgatggcatatacctgtggtcccagctacttgggaggctgaggtgggaggattgcttgagcccaggaggtcaaggctgcggtaagccatgatcgtaccactgcactccagcctgggtgacactgagatcctgtctcaaaaaaaagaaaagaaaaattaaaattaaaaaataaaatttgataccatgtagatataatgccaattcagaaagttttttttcaaaagctttttttttttgttttccactctgtcacctaggctggagtgcagtggtgttatcccagctcactgcaacctccacctcccgggttcaagcaattctcctgcctcagcctcccgagtagctgggagtacaggtgaatgccaccacaccctgctaatttttgtatttttggtagagtggggtttcaccatgttggtcaggctggtcttgaactcctaacttcaggtgatctgcctgccttggcctcccaaagtgctgggattacaggcgtgggccattgcccaggtcccaaagttcttttattagataaataacacggatttgctaggagtagtggctcataccatttgaggatgggagtttgagaccaacttggctaacgtggtgaaaccccttcggtgctaaaaatacaaaaaaattagctgggtgtggtggcacgcacctgtggtcccaagcaactcaggaagctgaggcacaaggattgcttgaacccgagaggtgaaggttgtagtgagctgagattgcaccatgcactccatgcacaccactctgtcgctgggcgacagcaagactttctcaaaaaataataataataaatgaaaaataaagcctgtgctaaatacaaatatgaaggttagagaaacctgtgtctttctaaagtgcagtttcttttcctcattattaggtacttaagactgaattggaggccgggcgtggtggctcaagcctgtaatcccagcactttgggaggctgaggcgggcggatcacaaggtcagaagttcaagaccagcctggccaacatagtgaaaccccgtctctactaaaaatacaaaaaattaagtgggtgtggtggtgtgtgcctgaaatcccagctactcaggaggctgaggcaggagaatcgtgtgaacctgggaggcagaggtcgcaatgagccaagattgcgccattgcactccagcctgggcgacagtgcgagacactgtctcaaaaaaaaaaaaaaaaaaagactgaattggaatagttggtaggggacagggacattggagctttgacaaacatctgacttgctatgattcttgttatttgctcctgggcttctctggctggttttagattactaagtaatgtgtgcacaaaacaatatgatagttagggtggctgagtagtgggctccctctaatattttattttcctttatagaacattgtggcaggaacaaaaggggaagctgtgactcttaaataattaaatacattaaaaaagggtaggagaatcaagggttggaagagaagattgcagtagatactcttggctttccttgccctatactaaaacacacctctcctagatatgcatattaactgcctcattcctctgttttgtaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccatacctcctaatgcatatgatgaatcttggggtcaggatggaatctggattgcatcccaactcctcagacaaattgaggctctggacccacccatgaggctgccgcgaaggcccctgagagcctttgaatcagatgttttccacaatagaactaccaaccaaaggaacattacagcccaggtttcaattcagaataatctgtgtgagttgtgcttgggattagggaactagaatggtatcaaaatcccaaggcaaatgggaacagggctttggggccagatagatcttgattatagaaacccgactgtagctgagtaacactgggaagaatacctctctttcctataaaatggaaataacctccattggattatagttagggttcataatggtgagtatgatgacagtgttgtaaatagccaacacttatacagattgagtatcccttatccaaaatacttggggccagaagtggtttggcttttgaagtatttgcattatatatactggatgagcatctcaaatctgagaatctgaaatccaaaatgttccagtgagcattttctttgagagccatattgatgcccaaaaagtttcaaattttggatttttggattggtatgctcaacctgtatcttatttcccttaggcatttgcaaagtgctttatacgtattaactcatttaattctctcattatttgaaggtaggtaaatttgaaggtagaactgagatttgaattcagataatctgacctcgtgctttaaaccattctactgtaattcagaaaataagtataaaatgtttagcacagtgcctgtctcataattatggctcagtaatattgcttaataatacagttagaataataatggagccttttcacagggcagactttaatgttcaaagctaggagacccagagggtgaagagagctagttgaacatggtcatttttattccttcccggatgcctgtaaaccttgactatttgctaggcatggacttgagttgagggtggtaacatttctaatgtatcctgaatgttggttggtttttttttttcagttgaagaacaagagaggcaggaaaggaatagaggccaacagccccccaaagagggtggtgaagagagtgcaaacttggacttcatgttggccctaagtctgcaaaatgaaggccaagcctccagtgtggcagagcaggacttctggagggccgtatgtgaggccgaccagtctcatggcggtcccaggtctctcagtgacataaagggtaggcttgcttattctgcactagcctctttctctacagtttttgtaagtcttaggttatacaattcttatacaattgaaagattttaatgaaatagaatttgccttactcttttttgtttcttttttcttttcttttttgggacagtctcgccctgtcacccaggctggagtgcaatgtaatgatctcggctcactgcaacctctgccttctgggttcaagtgattctcgtgcctctgcctcccaagtagctgggattacaggtgaatgcttgaacccaggaggcagaggttgcagtcagctgagattgtgccactgcactccagcctggtgacagagtgacaccttgtctcaaaaaaaaaaggctctaaaggacattattgtacaagtagagaacttacattaaagttgctgagagtgacatccgtattgtttacataggagaaagcagtgcccttgttcttcaaaggcacatgatgaagtacttaggaataaaatgttatgtgttcaaacttattctcaaatagttcaggggaaaaatacataaaagtaatgtgaggaaatattaagctttgtgaatatagatgaggagtatatgggtatttgctatactattctgaacatttttttttttttttggagatggagttttgctcttgttgcccaggttggagtgcaatggcacgatctcggctcactgcaacctctgcctcctgggctcaagtgattctcctgcctcaacctcctgagtagctgggattacaggcatgtgccatcacgcctggctaatttttttttttttgagacagagtcttcctctgttgcccaggctggagtgcagtggcacgatctcggctcactgcaacctccgcctcccgggttcacgccattcacctgcctcagtctcccgagtagctgggactacaggcgcccaccactacacccggccaattttttgtatttttagtaaagacggggtttcactgtattagccaggattgtctcgatctcctgacctcgtgatccgcctgcctcggcctcccaaagtgctgggattacaggcgtgagctactgcgcccagccatgcccggctaattttttgtattattagtagagacggggtttcgccatgttggccaggctggtctcaaactcttgatgtcaggtgatccacctgcctcagcctcccaaagtgctgggattataggtgtgagccactgcgcccagccattctgggtaatttcttatcggtcttctagttcactgatttttctccgtagttatttctaatctgttgtttaatgtgtcccttaagattttcacttagtgattatatatttcattttgagttctgtttgatccttttcctcattgtacctcctaatttttaaaataatcttttgttccatagtcatattacagttcccgctttggtttttttttttttttttttttgaggcaggatcttgctctgtcaccgaggctggagtgcagtggtgtgatcgcggctcactgcagcctccgcccccaggcctcaagtgatcctcccacttcagtctccgatgtagctgggaccacaggcatgcaccactacctttttttttgtatttttagtagagatggttccttaccatgttgcccaggctagtctcgaactcctgaactcaagcaatctgccccacctcggcctcccaaaggattgggattacaggcattagccactgcgcccagcatagttccctctttaacatgtctttaaacatgttaaatatacttatttttcttttgtgtccaaaaatagcaaaaactgtttctttgctatgttgtttctgcgtctcctgttcatggaggcttgctacgtgtgtgtgtgaacaccaagttttctagcatgttcctctgagaatttataaatgcttctggcaggcacatagagatactaccattaggggtaactttaagcttttggcctggacttttttttttttttttcttgagacagagtctccctctgttgcccaggctggagtgccatggcgcgatcttggctcattgcaacctccgcctctggggttcaagtgatttctcctgcctcagcctccagggtagctgggattacaggcttgtaccaccatgcccgcctaatttttgtatttttagtagagacagggttttaccgtgtcgctcaggttggtctggaactcctgacctcaggtaatccacccaccttggcctcccaaagtgctgggattataggtgtgagacaccatgcccggctggcttggacttttaaaaagcataaacgtagctgagcatcatgtctcattcctgtaatcccaacactttgggaggctgagacgggaggttcatttgagccaaggagttcaagaccatcctgggcaacagagtcagacttcatttctacacaatataaacaaaaactagctaggcatggtggcacacacctgtagtctcagctactgggtaggctgaggtgggaggatctcttgagcctgggagatcaaggctgcagtgaaccaagattgcacaactgcactccaatctaggcaacagaaaaaaaatcacaaatgcgaatttatgtaaaaatagaaacataaaaaacagaagcacagactgtgaccccaaacctatgtaaggggccaagctctagttactctacttggtagagacttttcttttacccagaactaaaatctagatgggtagaagggtaaatttccctacatcccgccattgttcaccctcccatttgtttagcagttttcctgaggatgttgtgtctgggaatcttgggtttaaaatgtatcgatttgttcacttcagttacttttaggcagcattttttggtactgggaggagtattcaggatattgtttgccagtttatccgtaaaataaggataatgtaggatctacttcgtaagttttttctgaggattgaaatagtgtgtggaaaacacttaagattattgcctatggttattacacatttaaatcgcttccttagagtagtgagtagcaggtaaactactgctatactgctactcaggaaattggggtcaagtacatttcttgttttgtcatggaagttttggcctagagtttatctcttggatgggttccctctgagaatatacagccccacaaattgctatctataagaaacattaaagaaagccaaacttctatataagaccccataaagaggataaaaagttaaattcaagtttgtttttgttcatcctgagtctcattgtgtggcctaatacctaggtgcagctgacgagatcatgttgccttgtgaattttgtgaggagctctacccagaggaactgctgattgaccatcaggtgtgttatgaattacttgaggacttttagtaggattgtatgcaggccataattggtgttgcaggccacatgaggccttgaacaaatcattttaatacaatgcccatagtaggaatagcaagtgttcttttccatgatgtgagtggcatacagatatgaaaacttagccttgttccttcttagaaaaagtgatggcatcctttgtagggacatggatgaaattggaaatcatcattctcagtaaactatcgcaaggacaaaaaaccaaacaccacatgttctcactcatagatggcaactgaacaatgagaacacatggacacaggaaggggaacatcacactctggggactgttgtggggttgggggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaaaaaagaagaagaagaagaaaaaaaaaaacaatagtgaaataacagcaaaaaaaaaaaaaaaaaaaaagtgatggcagtgatgtatgcctgtagtcccagctactcaggaggctgaggtgggaggattgcttgagcccatgagtttaaggccagcctgggcaacatagtgagaccccagctctaccaaaaaaaaaggggggggcagggaatgatgctcatttcagcagacctggaaatctcatgctagcagccctttcatgtggtagtgactggtgcacatatatctccactatccgttttgtgatctggtctcatctcatgccacattttgatttattggagctgtattgaagtccttgcatttttctagaaaggtcaagggtgttttctgcacattactttatctacctgaaaggtgtctggccttctgcccctgtctccttaacacatccaacaacacagaccccttacttgtagagttggttcagatgtgactttatggaagccatcctgataggtactatgaaggctaggtcaggaaccacacctgtgtgcttctaaaagtctgtgcccacctctcttatagtttgtcactttatgatgtggtcttctgatctcctgttggtctgcaccactaggctgatttccctgagggcaggttctgggttttcccagtttcggaatctctaaatacttggtatctgaaaaggtgtcagttatttgaatgattgactattcttgagccatttaggaatgatgagcaaatagctttatgtgtttgaggattacctgatggagggaacttctgttttttttttttttttttttttttttttttgagatggagtctcactctgtcgcctaggctggagcgcagtgacgcgatcggggctcactgcaacctctgcctccggggttccggctgttctcctgccttagcctccagggtagctgggactacaggcacacaccaccatgcctggctaattttgtatttttcgtagagacagggtttcaccatgttggctaggctggtctcaaactcctaacctcgtgacctgcccacttcagcctcccaaagtgctgagattacaggcgtgagcctccacgtctggccaggagggaacttcttgttccctcaatactctgatttggtttggcctagtctggcatttccacaactaccaaatagtgcctgtgctctggatggtggaacatactttcccccataaatgaaataatatattatttgaatacatgtagtttttgttttgggagtaccatagaaaatccattaacaaagataataaagaatatttgtgcctctcttttactgtatggatgtggtgggaagaaccttgaatcttttcaaattaatttaaaaagaatgaacacacttaaaaaaaaccataaaaatatttaaaagtaaaatgagtgttctatgtgtattcctcttttttgttcctctttccaatattaagcatttaaaaaaatttttttttttttttttgagacggagtctcgctctgtgacccaggctggagtgcagtggtgcgatctcggctcactgcaacctctgcctctcaggttcaagcaattctctgcctcagcctcccaggtagctgggattatagccaagtgccaccacgcccggctaatttttgtatttttagtagagatggggtttcactgtcttggccaggctggtcttgaactgctgacctcgtgatccacctgcctcggcctcccaaagtgctgggattacaggcgtgagccaccgcgcccggccaagcattgttaaaattatatgacttcttctagaaaatattttaggaatgtagtttttttcttaacctctgattcttgtttttaacctatattttttgaatgacagacaagctgtaacccttcacgtgccttaccttcactcaatactggcagctcttcccccagaggggtggaggaacctgatgtcatcttccagaacttcttgcaacaggctgcaagtaaccagttagactctttgatgggcctgagcaattcacaccctgtggaggagagcatcattatcccatgtgaattctgtggggtacagctggaagaggaggtgctgttccatcaccaggtaagggtccctggagtccctgtccatgtggctctgtgcgtgaacctgaggcttccagagctgagaacacttccttagcctttaagttgcattccatcctgacaaggaatgcacacacttggcttctggccaagtcatctttgtgagctgtctgtggtaaccaataccgcaggctttcagactttccctccctttgggcaactgaagccatcttgttactagctgaggaccaaagagccaggactctatttgagcaggtgtggaaggaagccttgtcagagagtttagatgacagtctccctgcttttcaccaggtgggtttttcccattgtggtggcatttgagacttgcattctaggagacctgagggtctacttctggttttgtcctgtggatgacccttactggggccatctgtgagggagttggactagacaatatgaagtcatttttcagcatttacagtataggattccaatctattagtggaaaatatgttttctgcccaatcgtatatgttacagggagtgagagtcaacactgcagctaccatttctgtagttgatgccatgtagctgttactagaacattgtacatttcatttctgtaataaagactcctgcttttcagaggccaggcatggtggcttatgcctgtgatcccagcactttgggaggctgaggcgggcagatcacttgaggtcaaaagtttgagactagcctggccaacatggtgaaaccccatctctaccaaaaatacaaaaattagctggatgtggtggcgggcacctgtaatcccagctactcgggaggctgaggcatgagaatcacttgaacctgggaggcagaggttgcagtgagccgagatcacaccactgcactccagcctgggtgacagagcgagactctgtctcaaaaaaaaaagagaaagaaagaaaaaaaaagacttttgctttgggatcaaacagtagataagtgactgcttaccctctagggcagactgaaataagcaacgacacaaataaatactctggtgagagtatagaaatgcttttcagctgctctgaaggtagtgagttatctcagttgattgttcacagtcagttacagattgaactccttgttctactcttttccccgttctcactattgcacttgaatagtcttaaaaaacagaaaaaaaaaagaaataaatgtttttctgggctccaagatcagcccttcccgcatccctgcacaaatcagaaagtgtttctgtcagtgcctcatgtgccgatgggattgaatgcaaccattccagatgtgtggtttctgaaagttcccagaactttcagaggttgtcaaagtccccctccagatgaggaatacactgctgttcctcccatcgcatgctcttttctgggaatgactcaattcagaggtactaattctggtttttcttgtttaggaccagtgtgaccaacgcccagccactgcaaccaaccatgtgacagaggggattcctagactggattcccagcctcaagagacctcaccagagctgcccaggaggcgtgtcagacaccagggtatttattagccaggactcagccaaggccgcaggtctactgctggctccggcctgtttaccacttcccatccactgctctaatgtggggattacctgcatctcaaatttccaaacacactagggtctcataggggactcctctgcaggtagttgtggtcccacattagactgagctctctcaagtgtgtgatttttagggtaatggctttgcggacatccatgagatacatgtagtagtaagtgcttgtaataagtttctggtttcctatctgtgcacttagtggattatttgtagataatttgcagaccttatggtagctaccctgggcccccatttcaagttgaaatacacttagggtactcaaacctattattattatttaatttttttgtagagacagagtcttgctctgtcacccaggctggagtacagtggcacaatcatagcttaccacagcctcaaactcctgggctcaagtgatcctctctcctcagcctcccaagtagctggaactacaggcacactctactacacccaactaatttttttgtttttgtagagatagggtcttgctatgttgcccagggtgatttcgaactcttggcctcaagtagtcctcctgccttggactcccaaagcattggggttacatgcgtaggccactgtgaccgacctcaaacttatttatttaatttattttttttagacagggtctctttgtcatccaggctggagtgcagtggcgtgatcactgcagtctcaacctcttgagctcaagtgattctcccactcttagcctcctgagtagctgggactataggtaggctaggtgcccaccaacacacccagctaatttttaatttttttttgtagagttggggtttcgccacattgtccaggctgatcttgaactcctgggctcaagtgttcctcccagctcggcctcccaaagtgttgggattacaggtgtgagccatcacacccagcctcaaacttattattattacttaagaccatcatgtttaggcaagtaaactgtttttgaaacctcaccactacaaagccaattagaaattattttttggctgggcatggtgactcacacctgtaatcccagcactttgggaggctgaggtgggcggatcacaaggttgggagttcaagaccagcctggctgacatcatgaaaccccgtctctactaaaaatacaaaaattagccgggcgtggtggcgggcgccagtagtcccagctacttgggaggctgaggcaggagaatcacttgaatccaggaggcagaggctgcagtgagccaaaatcatgccattgcactccagtctgggcgacagagcaagactccatctcaaaaaaaaaattatttttcaaggtttgcttgcacactattgttgaatagttaggaggctgtctttgaggactcagataatatgtgcagaattgataaaatatccccatctctgccctggagatgtgggttccagcagccttttggggtgagcagttgtcttttttttttttgagacacagtcttgctctgtcttgtccaggctggagtgcagtggcatgatcttggctcactgcagtcttcacctcctgggtttaagtgattctcctggtctcagcctcctgagtagctgagactatagctgtgtgccacctcacctggctaattttgtattttttttttagtagagatggaatttcaccatgttggccaggctggtctctaactcttgacctcaggtgatccccgcacctcggcctcccaaagtgctgggtttacaggcatgagccaccacgcctggctgagcagttgtcttctatctggaatctttttgttcctgccctaaacctggcactatagccagagcaggctttttcctaaagctgttaccattttctcttctcaggagacctgtcttctggttacctggatgatactaagcaggaaacagctaatgggcccacctcctgtctgcctcccagccgacccattaacaatatgacagctacctataaccagctatcgagatcaacatcaggccccagacctgggtgccagcccagctctccttgtgtgccgaagctcagcaactcagacagccaggacatccaggggcggaatcgagacagccagaatggggccatagcccctgggcacgtttcagtgattcgccctcctcaaaatctctacccagaaaacattgtgccctctttctcccctgggccttcagggagatacggagctaggtaagaatcagtagcccaggaatggggcttgggagtagctgaagcgaacatgggcaaaggcctggttacccttgccaggcctggggtaagactgaggtacttgcatggtaaggggaggagtatggattttccctgtattgtcacctgactccaaaaaaattattttgtggcctatgggttttttggggtttgtctgctagcataggactgcttcctgttccctctgagtttgttgacctttgctcagggacacttcaggagctagtttctaattgttttctttcagtggtaggagtgaaggtggcaggaattcccgggtcacccctgcagctgccaactaccgcagcagaactgcaaaggtaaggtgggctccagcccatgatgctcagtgggggactcagacatggtggggcttgtgtggctcctgaagttgtagaagttgttgggaccaggctggttgtggttcaaagattgttcctttggcttttgagaaggaggtttctaaggaagcgggacattttcggggatccaggggaggagtaatgctttttcactttttatgtaaagcttcgtttgtgttgtgttgttcaccaggcaaagccttccaagcaacagggagctggggatgcagaagaggaagaggaggagtaatggtgtctccagagactttacatcggttcctgtcttctgtgcacagcagcacttgccgctgtgcaggcccacctctttggctctttgggtgggagagtttttccagattttagatttttctaggttatggccattttgtgtcttttgaggttgtgctgtgggggtttgggtttgagggaagggagcagggtggcggttgaggaacgcttcagccttagctgctacctttcggcagcagtgaaatacaagctgcagcctcggctgccagggctcccttttgacttattgtcgccactgccccttggtgctgtgtggtcccagtggaaggaggggaagattttggaaacctggtagccaccagtaaggtgattctctgccctgttggggcctaaatttgggggcttttgggcaacctctccgtgtactgcgtctgtccacactcgattgggccccaggtgtgtatgaggcgctctggtaaggtgctcaggccagttgcaatgtctgtcagtaacgaggcttttgatgtgttgagctggaggtgagtggaccgggggctgtgttttaagctgcttccttggcatttggcatcactgccttctgttcccgggggagcatggatcttttgtcctcactgctttctaatggggagggctgagggctccctgtccccacagcaggtatgttgggctctgccccagccccacacttgctctgaaaaccaagtgtcagagccccttccccttgtttttattttactgttataataattattaacttccttgtaatagaaataaagtttgtacttggagttca

SEQ ID NO: 326 - DNA, 28060 bp, Homo sapiens; identical to SEQ ID NO: 325
  source 1..28060: mol_type = genomic DNA

SEQ ID NO: 327 - DNA, 13472 bp, Homo sapiens
  source 1..13472: mol_type = genomic DNA
gtggcgagggcggtgcctgggggcaggggcctcctcggagggcggcggggacagacccgtcgccccggctccgcagccccgccccggccccgcctccgctccggccgccgaaggctataagatctaggaacccgagccggtggtagggcgggcgcggaccgtgctgggagcggcgcggctggagcgcagcgccgaagggactggcagggctgaagtgtgcgggacagcaagcccccgaatagccccggctgccacctcgcaggacccaaggccacgcgcgccgggcccagctgagccgcctcatgaagccgcccgcggcgcagggcagccccgcggccgccgcggccgcaggtgagtgcggggtccggggtccccttaaagtctcggctctgcagatggcgggtgagaaaggaggggccccgtgtcgtcccttcacaccccccacccttccatcctccccggcgggaacctgtccccggtcttcccgcgcgggcggctgcagcctcctttccggcccgggctggcccccatgtcccaccttccctccaccaccagctccgcgcgcgcccggggttggggggagcggcggggacaggtaaccggcagcgcctggggaggaatctggccgcgccaagtcgctgggtgaccctgggcctggcgaaggctcagttttcttgtctgtaaaacggacttggtaatagaacgcacttcgggggtggtggagaagattacaaggtaacagcgactgcgtggctgtcacttggcagaggcgccaagtgtcagttatcttcgggaaccgtggcggcccctcctggccctgggaggtggtcccgctgcccccctgacttccgtgcactgagcccctggccctgcccgcagccccggccctggactcggcggccgcggaggacctgtcggacgcgctgtgcgagtttgacgcggtgctggccgacttcgcgtcgcccttccacgagcgccacttccactacgaggagcacctggagcgcatgaagcggcgcagcagcgccagtgtcagcgacagcagcggcttcagcgactcggagagtaagtgcggcccccgctaggatggcgccgggatctcccagctcccaggacctgccccgcgaaggctgcggcctcagttttcttatcagtaaactgaggaatggtttcctgaagctcaacgcagtaggccgagtggtggcggggcccctgacgataatcacgggaaaggtcgctggagggcaggttggttcacttgccgcccacgggtgtgtcaccaggcaggcgagtttaagcagcttgtcccgactcagccagacaggactccctggacctgcaccaggcctttccgcagtttccctcctcttctcctttccgtgcctctcccctctcagctgtaactttgcagatgtggaacaagtgccagtggaatgagggggcacagtggggacatgggagggcgcagaacggaaatattcatgaaaccaggaaaggtttcataagcccaaactgctgttcttgggatttatgaaataactgcttgcattgtcttctggcccttagctctcagacttgttgctccattgcatgcagttatgaaaatctttggcactgctgagttcaagtatttttcagccaggtcctccaccaggctggagggggagccagagagcacatgggcatgaaggtggttcctggtgatctttctcacaatggagactaccccagggtctctttgtcctgaacaactttgtcaacaacagcaacaacaacaaaaacaacaaaagagacagctttttccaggaactcacatgtcctgggaggattacaggtacctcaaacagcaaattaggtgcctttttaatattacatgattgttggtttcaaatccagaattgcttattgtttttcaaagggcaaagtcaattttaaactcttctgtgttattcttcagcctttaatccttagatgggttacaggcatgaatgtcactccttttgctgcccttgactcaggacgtgaaagtaatggcctttccgtgtgattctcttattttgaaacctggagctcttccttgttcctgggctaagattcggggctagacatgaacatgagctgcccttctgcaaagggataaatgcgctcaccaccctggtcagggtttgactcaggaagctgagttccagcttgtttccttggcagcactgccaaagagttagaccaagctgcagcttttgaggtgaaaggggatggaagaaagtactgttacttttccacttagaatttttggactttgttcttaatgaataggttcattttcaatttcaaagcaaagtgttaacatttttgaaatttgtctcaattctaaaggccaaacttaaatatgtctcctcctactggggcatggagcaagttattcatcaaatacagattctcgcatggaaaagaaagctaggatagtgtgtcgctgctgctctgtggcaaagaacagctcctttctaagcaacagcctcactctactagaataggtctgagcgcgcccattcatggctgattgcaacttccactgggtgggatttcagatctagaatctgttttcagatgccttaaagagaagacatagaaacacattcttaacagtttcaggggagatagttgggatagtttgtagttttgcttaggttatatgtgtctgttttctgcttttgttgttaacggactaacccttagtttggtggttagagaagtgatgggaagaacataaagaaagctcagatgacatttgtctttgctttaaatgtgtagtttttctctcacaaggctagtcagaaatattgttggcagaagctgtgtgtatctaaatagtaatttcttaaggaagcataatatgtatatcttaattgctgccaagaattgagtacagacatttgttatcctcgtttgtctgtttaatgcttttctatgggagagaatgcttaagagaggtagatactactgaaatttagctcatcaagagggagacacaccaggataaggataataacagcagctcacttttagcaaacgcttgttatgatgatgatgatgatttattagctggaatgggaaccatgtcttcacgaatagactgaagtccttttgagcccagatcacatgcctgtttgtcaatgatggctgtttatgaaggtgtctctttgaggtggtggtcatctggcagggtcagtagagcttagattgagccttgtcaaggccctgggtgatgagtgggatttagtttctctagctgtgaaattgaaaggatgctatttaatagtgctattagggagaaaatatttgctctgttgaatactttcaaaatatcattacaatgtacatgctgtgctataccatatagatacattggagccagtgtctcgcatgaaaatattttggatgaatatgtaaaccaatgttacctttgttttttgctctagtttttacagctctgtctgaaggtgcaccaaccttacaaggaagatcaaacagcaagcctgttctttgaagaatacttctttattatcattaaaaaaaatttaggttgcttgcacccaaaggcaaaaaatagccattcctcgtactgaaagaaacaagttactcagataggaaagaagaacagatatttaataaggaaatattccttcctgttcccactttcagggaggcctcttaagacatgaagaggaccaaaataacaattgcagtataacttcacatggtggggtggggggtgtggagttcaaatgtggttgatcaaaatagtgttgttactttcgtttagacttgattccaacatgtaaaaaaatcaggcactttagtgggagtgattttaacttcagtagtgaaagggcaatgcaattaagagttagggtagtgtttctcaaacttcatcctcagaggtgctttagaaattgactacctttggtttgaatttatttttagaaatatatcttcttttcagtatttttaaaactgtaaaaggtaaaccatgttttctcaaatgtgttaaatggaattttaactcattatgtttcaagttttaaccagtgtgttgactttataagaagtttataatattaacttaaactttaaaaggtggtatgcacttatacctttaaggtattggggtttcacataatttttcctttgacgggggagtgttttgctgctcaacagaaaaggtctgaagtctactgtgtatgctagggttattatgatattgtaggaccatttaggaaatgaggaactggcttctttagcatcagcaagacttagaacacctgcatatctttgcttaggctattctggcctggccctgggagaggggaccttgtgggccctggagaaccagcatgacagatggcttatgtggcttagaagccactgaggtagaacctgaacttgttcaagccatgagagaataaggccaatgaggagccttcagggttccctggtactgtgttagcaattctgcatgggtaatggatcttgtgatgcttggcaaggcatatagagggacagtgcgatcccagaaagggagctgggacaacagtggagaagttgaggaaagatgctctttcttattttgcccccctttggcgaggctatcagaatttagattttcaggaggagaagtcaacccacacccccagccattccctgtggcaaaagggaggtaggtccaaagctttctttttcttggttaattactatagtttgcttgctttaaacgtgtgggatcgttctatatttacaggagccttgggtaaggtttactgtctgtggttttacttccccctggagcagcacgttgacatgcgctaaccctaaattacctttctcccaacccccctagctaaaaaaacacacctaccttttaaacaagcctctattttgcagcagtgtttctcagactctgttagttgtatatttcatatgcttttctttcttttgatggtgccttagaaaacacggtcccagaatttgaggttcctgacttcagtacactaactagacttgccagggatgtttctaatgggaatttgagatacatgtgagatggtgctttagagctgattgaagccgatattgtaaggccctcaaatatccagccttaccacctgccagggttccccaaattatcactgttctaggtccttcgagcccctattaatagcagcacctgatacccacgcggggcaataatacatgaatatgtgatcagccagcaacacattgctgtcatttaatcagactaactggctattacttttgcaaggaatagagttccaggggagggaaaagaacaggatgtccggctttgcctaccttgaaatctgtcttgcgtgagattttgcccattgtatgttcttaataaaactctatggaaagaaattttattggttaagggtaaagagaggtctagagcttggggtacctctatgttgagagtttgttcttgggaggtttgttctaggatgccactgaagagaaagttctcttaagaatgttgctgctctctctcaagaagagggaggatcttgattctgtttattctctgtgattaccttttctctctcaggagtgctattctgcactttgctaggaactttagagttaaatcattaaaaccacaggcattatacacagagcacctaggttattgttcttcttctaacaaggaagaaacagagtgactctacagggtcatgcagttttcacgtggcctctagacacccactcgacagtggcatagatgctagatgcccactcgccagtggtgtagctttggggccttgagggctctcttttcatctgtgccatacacgatgtgtagatatcatcacagggtgcgcctcagctgcagcaggtttggctcaaggatgctggcggtcggcttcttcttggtggtcgaaggttgaacagttcaaaacttggagttgggtctgtcccagattgtacacctcacggaaagggagtgaagtcatggtgtggcaacgagctggggcgtgagctaatgtgtatctgtgtgtgtgtgtgtgtgtgtgtgtgtgtgtgtggtgggcagggcgggggcgggcaggaggaagtgagtgtagctgtgctgccatgcctctgtttgcgtgtgtttctatataaatagatattgtaactagtatttttcctcctcttcctccctcactgtgggagtggctgtcagtttgtctgtatattttctcagtttgggaaaaattctcacatcaagaaggcatttagcctgtgaacctaaaggatcagaggacagtcctggcaatattctggatctacggctcattctctacagattctctccaggccccatgagttatgctgagtctttcctgaatctttgctggattccttttttcccctgctaacatcctcttttgtaatggcctttccatatctagattgttccttcttccaacattcaatagcgtttggcctccttgcctgtgaggtgaacaaattgtggtgtctttctcccctgcagaggagtgtacgtggatggaaacttgctggagagtaggggcagaagagagctgaagttcaaagtcagggtagggcctgtggtgcatgccgggtgggtggagtgagcagtggtgtggaaagttgctctcccaggccagctgcttgtgggagatagagagcggaggtgtggtccctgcgatctgggccagccagcctctgggcccagggatgggggcgaagctctcaggtatccttcatagccacggataatgtgccaagggcctggtattttctggctcagagtctaggcatgaggcctgcctcctcaggaccctctgtggttttcttgcccctaaattttgccttatcttctccccatgagtttctcaggctgtatttgtggcgattctcctggtgactgcatggtgacaacagtaaggcttccttgcaggtctgcagtgggtgtggccagcttcctgtgtgtaggggaaagggcttcccttgggagaattggagagcccacctttggaggtgggctcggttgagggagccagcaggagggcttcccaagtaaggttccacggagtccaagggtcctgagaagtagtagcaggagcaccacaaagaagtgtcccgtggtcaggtacactggggaaatggggctggttttgtttaaccgcaagtcttttcaggatgttggaagtgggcatacccatgggaatgagcaaggctgtttggtgtttctcaggtgtacctgatcacacagccctcggaggaccagcactctgaggaatgtatttttggggaagtgtaggtatcaggtccaggattttggatctcagtccatgttcatcctcaaagcccagtgatggtggtcatttcaggtgagctgggctggacctctgaaggaagcaaagattgtgagggttgctctcaagggtcttctgggcatgtttggaaaagtggacaagatggcggtgtcagcgaaaaagagcagggggcaggtgggcccctgggcaggagagggtggggggaaagggagccaggtgaggcacctgagaagttgtggcagcctcttagggacaaagctgaatttccctgagactagaaacctcttcttccgaaaactctgatactttttgtactgggcctatctcttgtcacttaggcaaattccttttcagttaatgggaccaaagagagatgtttttgcctccccctaagctggaggtagttggcttaaagtggaagaatcccgaggaggcggggacctggtaaggcccccatcattcagctgccctctcacacctgaagagccacttctctgctccaactgtggctggctttgtgttttgttttaaccaggaaggctgttccccgtgacctcaggggccacatcctgcttctgctgcctgccttgcctttgcaccctttgagtcagtgctgctcagccagcagcccctttctgagtcacagccacacagctgggccaaccgtgcgttggtttccttccccttagcaggacttagagaatctcagaactttagagctagaagtgcctttaaggattatttagtccgccttcccattctattgataagtaagctaggcccagagatgtactagctcaaaggcaccctagtacttagtagttgactggatggtccccttgactcccagttcagccttgaacttctggggcctcatcttgctgtggttcaagtctttggaggtatgagaatagagggagccatgatgtcactccaagtgtctaatagatgaacttccaggagaagatgtctttatctttgaccttctggcttatctgaagagtacagactcttaggaaaacctctcttaagtaaaagagaggattattaaattataggacagcaagagagcaaagatctctcttgagcagggaaagaggcttaagtcatgggatactggatgtttgtattttaggaggctcagagggcagaagggacatatttcacttgagatgattccttttgcctaaaatccttacccccacactcccaccatcaaccaagcactggtcatgatgatcctatcacccccttcctgtattggggaagcaagggcctttggtatacttgatttgacacacacacactctctcacttctcactcacactctcacactcacatgctctcacacacacactctcattttctcacacacactccacactcacacacgcacacactctcacacactttctcacacacacactcacacacactcatacactcacacactttctcacacacacatattctcacacacacccacactcacacactcatgcacacacacacactttcacacaaacacacacacacactttctctctcacacacacacactccctctctcccctgtctcgaatcattttgggggcataaacataaaacctggaaatcaacctgttttctaatctttttttttgagacagagtctcactctgtcacccaggctggagtgcagtggtgtgatcttggctcactgcaaactccacctcccagattcaagcgagtctcctgcctcagcctcccaagtagctggggctacagacacacaccactatgcctggctaatttttgtatttttagtagagatggggtttcaccatgttggccaggctggtcttgaactcctcatctctggtgatccacctgcttcagcttcccaaagtgctgagattacagccgtgagccaccccatgcctggctgttttctttactatagagttgcagctttggcttattttgaagacaaattgttggttatcaatagactataaagtgctaagtctataatctcatgagtactatttctaatgagtatattttccttcctgaaaggtgcagattcactttataggaacagcttcagcttcagtgatgaaaaactgaattctccaacagactctaccccagctcttctctctgccactgtcactcctcagaaaggtaaggtcattagttggaatttgagttttttgcttttttattcctctctccttctcaatcccttctctgtcccttttatccctaaacaatctttctcaaatgtacaaaacaaataggtaagactaatgtcttaatactgtagagtatacagtggaattttttatttctcaggattttaatcagtgtgaacatgaaatcagataatttggggcagaaaacctgaagtcacagggagaaagaaaatttggagactagactgttctctctcatgtgatgtaatcaagactgtgcaaatgacagtgtttcttaggagtctcctcccagacttgttggttctagaatttaaaactcagcagtttgcctttgcagatagtgggattctttttattgcattaattatttaaccaatgctttcagatgaccaatttagcaattaaatggggttgtcattattagataagctatgatctaacatgatttaaaatagcagctccagcctgtctctactgtggtattaatagacctaaaatgtctttaaagatgcatgagcagtttcttattttttggaactggtaaaatgtctccagctagagagttgaatgttctgttacattggacaagtgcctttttgaaaacaaaaggagctttttttcttaagaaaagttatacttgctgaaaatagttgcagaatgcaataaaaatggaacatagttaaaaagaaatgacaattccatcactcttttcactttggcaataagacaggacttcactcttttttcagaagaggcatttgaaagttcccttctcaacatagcaacgttagcacccactgggaattctgccactatccagccctcagtctgtaatgaatcagttgaattcagagacagagcagtctaaaaagtggcttaaaacgtgctcagatttgttacctgatcctcaagaggtaggaattaaagagggaaaaaaagcccctagtggcaaattgacttaaaaggctaagaacaattagccatttgtagccagcaggtgttaattaataaaactgtccagtactgcatttcagggaaggcatgaatgatgtgatgaactctacaaaaataaagtcagctatatgaaaaaaatctctacatctcaggctctagagagaaccaaatcagaatgaggactcgtttccttgtgtgggcacctggaggggatgaggctgtcctgggcccagaagactcatggcaccttccctgtaccattttgataagaaacagtgaactcttcattcatttcatattggaggaactctgagggctgcagcgttgccctggggggacagcacaagcaagaatgcatcagaaggctagtgccgcaggaatgacacaatctaggtgtctgctctgcacagtgctatgcttactgaattttttgactaataactcatattctacacaatacaaaaaccagactccttttatcttcccttcctgctcctcactctcctgcaaacatttaagacagtgaaggaagattcctcttctaggtgagggagaagtggggtgggatgtttggagagggtggtgatgaactaaaaaataaagaaacacttaggctagtcttcagaatcagtttctgagtttactgtatcaaaacactggagcacacacttagggttggcccaggacactcttcaataaaagtctctgaagataaggaggtagatgtaaaatagaaataatccattctataactctggaagttccaacttcctggaaaactcaatatggagtcatcagctgtctttgttatggaaactgaactctctctctctctctctctccctctcctgtttcacagctaaattaggagacacaaaagagctagaagccttcattgctgatcttgacaaaactttagcaagtaagtacatgtctgatattaaaaacaaaaaaacaaaaaactaacagacacttctgataaagtgttgtaatgttaaccagcttgccctggggcagaaagtttcatcctaagccttctataggtttagaaacaggaccctaggccggggcagtggctcacgcctgtaatcccagcactttggaaggctgaggtgggtggattacctgaggtcaggaattcaagtccagcctggccaacatggtgaaacccaatctctactaaaaaatacaaaaattagctgggcatggtggcgcacacctgtagtcccagcttcttgggaggctgaggtaggagaatcacttgaacccgggaggcagaggttgcagtgagccgagattgcgccactgtactccagcctggtgacagagcaagactccgtcaaaatagtaataataataataataataataataataataagaagaagaagaagaagaagaagaagaagaagaagaaacaggactctagtggctaggaatgaaattctgggataagcttgtgttaaagtagaccatgtgcgtttccaaacagtgagaacaggtcactagcaaacaatggcattttgtttgagaaatggagagcgagcaagactggagcattaccatcatgatggcctgtcaggcttttcagagaagaaatgaactgattaaccacaagtgcattattccaacaagccaaaagtcttccatcccatgggccagggtaattttcccaggttagatccagggtttgggtgaaatttaactttaagatgtgggtgccaaaagagagaattggcttgtggggcctttcaccagagacccatgccagtgactgaatgacctggattaggtatgcatacttgcaagcctcttatttgggaattacactaatggttacctgttttgtgtgaccaaaaatgttgagaactgaagacatcaaattataactgcagtataggggcccagaagaagggaccctcacaatctatctacacactctatttccaaaggataagattgcaagagccaggaggaccaactccagcttctgggatggaaggttcagcaactctactacggggggtcctgtttagtcacagagtgggctaggaaaattttgtcccagccccttaattttccagggtaagggttgattttctgtgagaagtatttaatgctattctttgctaaagagccgggtaaactctgaaaaattaaatccaaagctggttatttaaaaataactatgttcttaacactcttgcagacaaacctaaatatcagatagaaagtccttgtatcatttctatttgaaaattgaagattttattgcctcttttcttatgtactgcaccatcttacatcagaagaccagggcttgttttgacagggattattataattgcagcataatttgtattagacccatgtaacaagcctgtctacttcatggaaattgcagtgggttgcccagtcattccagttaatcagacactcatcgtgtgggaagcccagcattgagtttggtgctttgatgcacgtctgagacagtgtgatgtggttaagcataggaattgtgagcctctgagtggataaccttacctatctctcatttacaggtatgtgaaacaagaagttctgggtcctttcatcataagggagaagcttcagaaagttccgaggacctgctaaaatcagctactagaatctgctgccagaggggacaaagacgtgcactcaaccttctaccaggccactctcaggctcaccttaaaatcagcccttgatcccatttctgggcaatttagacagtgaaactgactttgtttacctgcttgcagcatattagaacagacgatccatgctaatattgtattttctcttaaaacatagctttcctgtaatttaaagtgcttttatgaaaatatttgtaattaattatatatagttggaaatagcagtaagctttcccattataatatatttttgtatacaaataaaatttgaactgaagtctgc

SEQ ID NO: 328 - DNA, 12642 bp, Homo sapiens
  source 1..12642: mol_type = genomic DNA
aaacatgcaatttaaatttatttcaaatctgctacccacagtgtttgagccagggcctaactttgggtctttttgcatattgccttaaacctagaaatgctaccctgcaaacagggaaggggaaagaggaaggtgttaatccgaagtaagtgggagacagaggaacctcatgcacagttacagaaggcaggtttgctgttttaacccagatagaggggtttctactcttatttctaggaacacgacgacactggttgtgggagggagagagaagggatctttggtttctcctaattctagaatcattaatgcactggcatccagagggtgggtaatagaaatgtctgtgggtagttggtatgcacaaatggcccatcagctaactcatcaagctggtaggaatctgagcgcacaggtgggctgcggcaggcagcagtcctgggctcctcacagctgtgtgctacctagcagggaacaaaaaagaaagtggactcacacagacctgcagaaatgcagacagggtgtgaagagggtttaaatttctaatatggcggaccagaatgtcttgatctatttctaggccatctattctattccggtggtctatttgcttacttctaaacaaatgccatacaatgtggtggctttatagtataaaagcgtttaacaacaggtttatgtatttaaattcaacagagatcatctaatgcaataacttgtgctaacgggttaactccgtcgtacagaactcagactaaaactcgtctttccaactctgcgtatgtatttgaactttctacaaccattaataacagaaataattgaatgctagactaatactgtgtaaaggagcaatggtcaatcttaatctgattacaaaagtttgaaaaaagaagcctcactcttctgattgccattataataagtgatggctatactattgaatttgtaaagttatcctaatcaaatactacttttctaatttatatatatttttatatacatgactccaaataagactgtttataaaatgggttccatccagtacaagtttttaaactactgttgtaacacataaatttgtgctgcctccaacagcaatgattcaactgttagtctgattacatcattcacattatcaccaagtatatcctctaaagtgtctaattatcacttttataaagcacattcacaaagttttgcattcatcaccactacccagttcctgtttgtctgatttttattatttaaaaaaatggaaaaacaaaagtgcatttttcattcaataaatgttccatccttatttagttttgttgccgaaagtgaagtccatgactttagaatgatagcaatttatcaaccaaagaatccgtcttcacaccgtttcaataactgcagcaatttccttgaactgtctgtagaaattctggagagaaagggggaaaataatattaattttgcttttagaagatatttaagtagttattttaattatatctgactaccggagactatataacatattaagtttgcattttagtgttacattctcaattactgaaggttgctgtaagaaataggtgcaatttggtactgcaagcaaaaatactactgtggggttggataattatcttatgactaaacttttcaaaaagcacatgagaaagtccttttaagatcacaccagatttattaaatactcagcactgtcctagacactgaaaataaaagcaaaaataacaagttggttccaggcctcaaaacactttcaatctagtaaaggaccgcatttcagtgtggtaagggctatctcatttaagattatgggttcaattactagaagagagatccaacattaactatggtttatatggtagaagtttatttctctgtcatttaaaaattaagctggtataacggttctcctatagaagtcatcttcttttaaatctcaggtaagaaaggaatcaagcaaattgttcttctgtcttctcctgtacctaccccaggaagctaggagacaaatttgaaacttaaccttggcaatcagggtaccttctaatgatttacacatctgcattttccttcttatttggtcttaattttctattttgctacttaagaggatttgtattgttttaatttatatgcaaatttgtcacagaatgaagcaaagtgtaactatttctttaaaaatatgtactgatgttcaaaattttagttatcaaaaagatataaattaaaagctcaaagaatgttccttagctctcagtcatgtaatgtgattaacaggctatctcgtggttagttttaagccatgtaaaaactctctttaaaagagttgcctctaatgaaaatgtttttgtgtatatttatatttaatatgattataatgtatgtctatatgtatatactatgtatgtgtatacatacacacacaatggaatatcacacagccataaaaaagaaggaaatcctgccatttgcaacaacatggatgaacctggaggacattgtgcaaagtgaaataagccagacacagaaaggctaatactgcgtgatctcacttatatgtggaatctaaaaaagtcaaactcacagaagcagaaaggagactggaggttgccaggagctgaggctgggggtcaatggggaaatgttagtaaaaaggtacaaacttttggttacaaaatgagtaagtctgagatctaatgtacaatatggtgactacagtaatattgttattgtttacttgaaatttgctaaaaaacattttacatgccctcagcacacacacacacacacacacacacacacacatacatgcacacactctctccaaaaaaaaaaaaggtaactgtgtgggggtggatgtgttaattagagtgactgtggtaatctttacacaatgtatatcttttatcatatcatcacattgtgaaaccttcaaaatacacaattttgtcaactgtacctcaataaagctggggaaaaaaagttaatccaattgtgattttttttttcctataggaaaaaatttctagaggtggaatcaggacagcacaaatgctgcacagaataataacaattaggccagcactgtgaattacaaaaaagaccaaaacgtgtattctctttcgaaattgactgagtcctcatatttagttgaatgttattcccatatcacaatatacatttatttccttttcactaagtctcagttccaagacactaatcaatattaataatgttaaatttgtgaacattatttttgtttcaaagcacggatatctattttaaataaagaaatcaggctgagcatggtggctcacgcctgtaattccagcactttgggaggctaaagtggacggatcaactgaggtcaggagtttcagaagtggatggatcaactgaggtcaggagtttcagaccagcctggccaacatggtgaaacctcatctctactaaaaatacaaaaattagctgggcgtggtgctgcgtgcctgtaatcccagctactcaggaagctgaggcaggagcatcgcttgaacccaggaggcagaggttgcagtgagcctagatcataccattgcactgcaattgcatccagcctggccaaaaagagtgaaactgtgtcccaaaaaaaaagaaaaaaaaaaagaaatgaaagggaaacaaattatttaaaatgtagtttataaaagcagaaatcaaaagtatcataaagtggtatatgaaagggttttctttaaaaggaagcctaggaccaatataattttagttagttttacaaagaatcactttttatttccatttcattcacgatggttgctttctctgacttttagagtactaactgctgtttaagtactaagtgtaagtactaacttcgtactagtgtaagtgctaagaatagattcctacctattcataccaaaaggaacaaaccaaacaaaaacaaaactgtacaggacagttaaattaatgacaaaacatctccagtatgtacatttaaaagaaaacctggccgggcccggtggctcacgcctgtaatcctggcactttgggaggccaaggtgggtggatcacaaggtcaggagatcgagaccatcctggctaacatggtgaaaccccatctctactaaaaatacaaataaattagccaggcatggtggtgggcgcctgtagtcccagctactcgggaggctgaggcaggagaatggcgtgaacccaggaggcagagcttgcagtgagccaagatcgtgccactgcactccagcctgggcaacagagcgagactccgtctcaaaaaaaaaaaaaaaaaaaaaaaaaaagaaaacctgatttattcccacctcccccccaccttttattcctccttggttacagaaaagaggtagaatgataatatggtaacatcactctaaactactgagttacttaagtccctagctgataaagccagccaagaggtacacttgctctgacctgtcttttgtaaacattatcagtcagaaaattcagggtcaacactattcaaagattcatttagcttaacattcttgaatattaagcccaaaggaataagaataaaacatttaaatgcaaagtaaatatcctgccattgaagataaaactttcctaaatatactcagagaggagtactgttcaagcgatcaaatggcgcagtacacaacttcagcacattatattgaaaataatttatcaaattcccaaagaagacaaattaatgtctcttgcatatactactagtaaacgtaaagcatatcaatctacaaataaaaaccattaaagttttcccgtagaaagattttatacatctttttatgcaatgattacagaaaagctgagctaaaactggatgagttaaatcacaaacctgaaactgtggaatcgtcatttcaaagcacttggtctttacttggcctgaatgatctgccacttttagcatcactgcaacgtaaggatacttaagagatctgcaagtgtctgagctcacagccatacccagtttccactgaaaatctacaagctttaataagacaggacaaaataatacattagtagtaacattacctggaatgcagatatttattcaattttactgcagttacactcaacttttagtttcaacgctggtcatatttacataaagtatcttcattttaatactgctagaggaacaataatcaaatgaaaaaatggagaggttataagggatataaacagttaaaaaacaccatcatagtttaaaatggaaaaaacaaaaagtgaaaaaaaaaaatctcccctccaatgtataacggaagtggaaggaagatgtggcagtattggtttcctttaacaggcttggagtatcttttagttcactttgctgttccatgctcaagacttacattagcatgtatagtgataaggtggttttggatttcatcattgttcatgacagatacataccctgggtgatgtgctatgcagtttacatgtattacatacctcactgaatcaacataacactataggttattgtttccactttgcagatgacaaaagccaacttcagagagcttaggtaatgtgcataaagtcacacatttctggaatcagaactgaagccaaagtctgtttgactccaaagattacatgcttagtgactactggttgtcttaatacttttaatctaattcctgtcaatgattgttaaatgatgccatggcataaaacatgcagctgttaatactgcctcatattaaggcacataactctaaaacataaaacacaggggtaaatactgtctgtcttgtttccaaagcatagcctggtacatagcagccactcaaaaagtacttgctcactgactgatacctttttctacaaaactaatgctcactgggcaaaaaacttcacttgttaatacatttcttcttggaaaagttaggatttttgtaaatcccaccacgtatcctaccacatatccatcatgaacaatgatgaaatccaaaccaccttatcactatttacactaatgaaatatttgagcttgaggactatggtgaggtaaagaaatagaatggttcccaagtgtgcctcaatcaaccataaaagttatataacccattttctattttaggacttttggggtatggaataggggaaggcatttgtaaatctcccatttttataaaagggggaccaaaaattcctcctatctcagactttctttgcaccaatctcctacagcattaagtccaagctagtgctgacaaaaggttaacatcttttataagaagattgaataaattcattttaaagaaaagttctccatataaaaatagaaaggcaaatcacaaaataactacaaatttctaataaacatatgaaaatgtgctcaccttaagaaacaaggaattaaaagccacaattagataccactacacagctaccaaaatggcaaaaatttaagtctgaaaattccaagtattggcaaggaaggatgtgaggcaatgggaagtgtcacatgctgttggtgaaagtgtaaactgggccaatctatcaaagagctgactttagctagtaaaactgaagctctgcatactgtgatccaaattctactagggatagaacttagaaaaactttttgaatatgtacacaggatacatatatgaaaatgtccccagcagctttattcataatagccctaaactgaaaacccaaatgttcaacagaaataaaatggataaatgaaatgctatacagcaatgaaaatgaacttcaattacacgtaaaaccaaaaatatttaaaacaagtccaaaagttatgattcagttcacttaaacttgagaaacaggtggtaaaactataaagagaatatgcctatccttttggggtggagagaagtgggcattgattgaagaggagcatctggtgggcttctgggggactggtaacactccatttattgacttttgcttgtggttacacgagtgttcgcttttagataattcattaactgtccatattttgtgcactttttgcatatatagtccagagagagcaatgtaagtcagtgactacatttctggttgaaaggaagagtttattgtagcctagggagttaagggaaagctttacagaaggctttaagctccattttgaagaataaacagaacaggaattgaggaaaatgtgttttatttatacataccataaatgcacacctagcaaagaataaatgcttaataaatattgggcggaaccaattacagatgaaaagagtcgaaatttggtttagggatagaacattttatctgtcttgctgggtgcggtggctcacgcctgtaatcccagcactttgggaggccgaggtgggcggatcacgaggtcaggagatcagaatcatcctggctaacacagtgaaaccccatctctaccaaaaatacaaaaaattagccgggtgtggtggcacacgcctgtagtcttaatttatctgtcttaaagtagatggcttttgtaagcaaatatgaaaaataaagttgacaagtgatcaaaaagccagtaattccttgcaaattgagctttcagaggttttcacagtacttttatatcctttatcttactatggagaacttaccacattaactcacttaaactttccctgtaggcattggggactcaactcactgaaagtttttgttttgtttttttttttttttgagatggagtctcgctctgttgctcaggctggagtgcagtggcacgatcttggcttactgcaagctctgcctcccgggttcacgccattctcctgcctcagccacccgagtagctgggactacaggcgcccgccaccatgacgggctaatttttttgtatttttagtagagacagggtttcaccatgttagccagggtggtctcaatctcctgacctcgtgatccgccctgcctcagcctcccaaagtgctgggattacaggcgggagccatcgcacccggccgaaagtttttcaatagagagaatgatatcaaaatattgattaatggatattcaggctgggcacggtggctcacacctgtaatcccagcactttgggaggccaaggcaggtggatcacttgagtgcaggggttccagaccagcctgggcaacagccctgtctctacaaaaaatacaaaagtacaaaaagtagccaggtgtggtagggcatgcctttaagtcccagctacttgggaggatgaagtgggaggatcacctaagcccaggaggtcaaggatgcagtgagctgtgagcatgccactgcactccagcctgggcaacagagcgagaccccaaatctgaaaaaaaaaaaaaaaaaagagagagagagagatattcttctggtggcagcagaacacaataatccaagtctgaagttatgtaagtgcctgaactaagttggtgacaagcaggactaaactgatcatatgaaggatgcattgctaggtcttgatgattgcctacaagatacaactatagttgtttatagaaaattataaaaaattgagcttggataactgggagaatgctgaggtatccagtccaaaagtatcattaagagatgatactagggttatctctataggaatgttcagaaagtggctaaaaatccaagaacagaattcaggagagttcatgagtagagagagttttaattccagttcaatagtgatgtccaaaaactaaaccaagaattcattttccttcttttttttttccagacaggatctcagtctgttgctcaggctggagtgcagtggcatgaatgtgactcactgcagcctagacctcctgggctcaagcgattcttctacctgggcttccctcccctaaatgtttgagtatgaaataagtaagcaatttcttattcttaacagtatttagcctgtacaactccttgatggaagaagttccacttttaccatcaacattaaagtggcagagtaaagggttgcctatttgtttctcagaatctgaaataaaactagaagatttcaagcagaaaagcaatgaaggcgtgcaatgctaagttccactcactattaaaacagtgaaattgtcaggtgaggaaacggagagctgccatcaagacactgtgcaaagtcagtcttcacaattgaaagaaagctaagactaggtttatgagatgagagtttccaaaattctaacctcaacagttaaatgcaaactgaaagcaaaccttctaataagtgtggtttcaccttaagtaggagtgaactgcacagattttaaaaataaaagaatataaaagaaaaaatcagaacagagagcacttaccactatgcagaatgttaagaatgaaacaatgtgcggtagccccaaaatcattgtatgatgaagtattaaaaaaggaaaacatacaaagaaacaaaaagctagtagtaaaaaaggaaatataaaaacatccagaagtaaaatgaatataaagaataatcagaaagtaaatatataaaaaggtaaacacacaaattagctgtagtcacactaaaaattgatgtggaggctgaagttactagtaatataaaaacatgactataaaaactgtctatatagataaaactggtaattcctatgtgttttgagtaagagagggaggcctcactattcagtatatactaagcaatactatattctaggaattagggatgtaaaaaatagttcctgaccttcagaattctagtggggaaggcagacaataaacaaaaatataatgtaatggtagtattatagcgtgacgaaatgcagggtaaggtgacagagtgacaagaaaggctatttagatataacctgggacgacctctttcatgcggcttttgaacagaaagagactcgaataaaatgaagaaaaagccacaggacctggagaaaagagcattctggactgagggagaagcatgcttggcgtgttcagggaacaatgaggcccaggtggctggaggggcatgagctaggaagagtggtaagagatgaggaatccatcttcgaagggccctgtaggccacagtaaatacctacgacttttttccagtgtgacaagaatctcttaaaaagctctgagtagcggagatacctggtctaacttacattgcaaaaggctcatccagaccgccaggtgaggcacaaagtttaaggaagttggaagaccctgttacaaggctactgcggtattccaggaaagagaatggcggcttggacccaggtggcagcaagaggaggtgaatttagagtgagagaaaacaatatgctgatctgattgtatgtcaggtgtgagggagagttgggagcctccagtaatttgtcgatttcagtttaggcactggtttctgtggagcttctgctctaagctgtggttctctgtattcgcagtctgtctcaccaatttgggggacagcaatttgccctgtgacctcgcttctctgacagatccaagaggagttgttgatttttcagtttgttcagtttttccttgttgctaggacaggtggtgacttccaagctcctcatgcgctggatcacaaagtaaaagtctaccgctttttgtaattttcttcataaaacttttaaatatcttttattagatttcttgcaagatactccgtaattttttttttttaagagatggagtctcactctgtcactcaggctggactgctgtggtgtaatcacagctcactgctgcctcaaactcctgggctcaagagatcttctcttctcagcctcctgagtagctagtactacaggtctgtgcctccacacctgattaatttttttatttttatagagataaggtcttgctatgttgcccatgctggtctcaaactgctggccttaagcaatcctcccaaagccctgagcttacagtcatgagccaccatggctggcctgtaatttcttcatgttataaatgacatctttaaaattatattttccaactctttatgtctgaactaaagaacgttcaacaatggaatcaccttgctgactctcacattaattctaataatgtttgtaaatgatcttggcttttcctatgcaaacaatcatataatctgtgaatgactgcatagaaggatgtgcagtaggctgaataatggccctcccaaatatgtccacatgctaatcctcaaaatctatgaatatgttaccttaggcaacaaaacagtattggtagatgtgacaaaattaaggacttggagatgtggagattttcctggattatccaggtgggcctaatgtaattgaaagggtccttataagagggaggaaaaagggtcagagtcagagaaggcaatgtgacaacggaagcagaggctggaatgatgtgctttgaagatggaagcagaggccacaagctaaggaggaaacattctcccctaccgcctcagaaggaacaaagccctgcagacaccttgcttttagcaccgtaagactagtttaggacttctgacctccagaactataagataataaatttgtgtttaagccaaaaagagttcaactttaaaaaccccataattagtataattctgtttcagaatatcttaaatacaaaacttaacgtaagagaatggataaaatgacttatgaaagattgactcgaaatgcactaaatcatataactaagcaaagccaggtagacggttgacagctctctgacttcccctacttcccaggaatcctcgaaagcaagatcagttagagaaaaatgacagacagcagtcaatggacacctctttcagcccctgtattctaattatttcttacctcatccctttcttacattttgtatggacttgggtaactcctggcctaaaaatactctagttttagtactcctattctgggaagtgtgttataaattatttgcctacaaatagtttattggctacaacagcacagcagcacttgaaacagaaatggggctaagatatactttaaaagtcaaattcatattcctagcattataaatgcatactctaaaaggctaaaatgctatactccatcttcaaaaataacttagagactaagaaaatgtttgcggtgctatctctgcaaattttcctaacttctttatccaacactttaaaataccgtgttcctggcttcgaataactgtcgcctaatcaaagcccaacaatccttgatctgcattcttcgggctagtgcagggtggggaagaggagctttcattacaatggcaacggctaccggctcaggtgcaaaagagaaggagcaatgcaagagggacggctgaaggtcaccggctcgcggacacaggactaggggagacctggggaaggctcagggtggcacggcctcgcggccgtgggaggcaggctggcggaggacagggcggggcggccgctcacccacctggttggtgacctgaaacggaagcagaaacacaatttagagaaacatctttcttgctccagagcctcgctgcccactctccttccaggttggaactcacatcggacttagcatccagcggcggctcgctggacgcctccatgggcagcgtctgggacttgcggcccggactcgagagaacgcccccagacc

SEQ ID NO: 329 - DNA, 12642 bp, Homo sapiens; identical to SEQ ID NO: 328
  source 1..12642: mol_type = genomic DNA

SEQ ID NO: 330 - DNA, 1468553 bp, Homo sapiens
  source 1..1468553: mol_type = genomic DNA
ggcggcagtggcggcagtggcggcagcggcagcagttgcagcagtggtggccagagcggatgcttgcgggctccctgcggctccactagttttcttcgccccgcccagccgcccactcttctcggctagggaagaagaccagagggtgctcagctggaaaactctggtgtctcagcttagggcctcctccgggaagagctaactgctcccaggtgaagccggtgcccgcgggcggtccgtacaccccgcagccggctcgcaccgctcgagagcctcggccgctgtgtcttccacgtctgcagctcagccagggcgcgcagggcgagtggggtccactggcgggtaaaggggaccaggacggcgaggatggacgcacagacctggcccgtgggctttcgctgcctcctccttctggccctggttgggtccgcccgcagcgagggcgtgcagacctgcgaagaagttcggaaacttttccagtggcggctgctgggagctgtcagggggctgccggattcgccgcgggcaggtaaggggcaatgagggggtctctggactggcggcgtccgagcccggccttcgctcccccaggctcccttggtggcactcgtgggaagatgacctttcgggccctgcagccgcgcagggtgaatcccggggaggcttccggggatgcttggtgcgggtagcctgagtgcagcgcagcgcagctctggggacccctaaccaagcctgcgacgaatccccgttctgggcatctgcttcccgcccggctcccttcgtcttggaggatgagttggaaggaaccaggaaagcagacatcagggcgtgggggacacgcagtctaactccgtttctcttccgagtaggaatttccccagtgccccaccggggatttcggtttactgctttctcataaggtggagggaattgaattgatcgccccaagtttggtactaaaaatcacaaacctgcgatatacccctttgctggagaatggggcacagacaagggcagccggtctcctctgtaattaggacttggaccctgtgcacccagagacgtgacccttagctgcccttctgtgccctcgtatcaagccctgcttggaggaaacccaaccacccagtgtgtctcccagcaccaaggtagtttttagcctgaaaagtgttagggcaacaggcgatcaaaccgaacgtactggggagtcacttgacatggatgagatgtaccagcgttccaaagggaaagatacagtttgtgtggccagcgtggatcttgcttcctgtgagcgccttttgcctgtgctttcgaaccctgctccccgtttccaccgcaccaatttccttctgctggtgggagttccagtgtaggttctgtctggaagaataggtcatagctgtcaaacgcaatagcaggtgtctagagctaagtaagatctcactagagccatgcacccctttagctgtgactatgaagccaacacagacgaatctgtgaggttactggttgaacaaagaacttgtggaggacgcttaagtctaaagtcccgagtttccagggttgggggacttgcttgtagcaatgaggaagtgtgagctgtagccgcttttcttgattgctttgctcaattttaagtcatcccagaaagaaaatctaggcattcgggaacactgactccatttgagtttacatgaccagtcttaaacccagctatttctttgtatacctgtttggtactaggtgctttttctgtattacttgaaacaaagttgacattctcagtttagggcgattcttctatccccaaataaaatatcgccttatagatctgtatttttcttagtgcattcttttcattaggaaataaatctcactttattggctgctgataaaactaaagtgagtttgtgcgtgtgggtggtgagggtgttatgatgtgagatctttacctgaattattagatttttagtccccaaatatggtaactttgcctgctatgttcaccgaatgttgatggccagccccttctccccagtaaggccctgatttcactccactctggtatctcagtatttctggtatctgctgaatgcaacacattgattgggtgttcatctcttttaaagatgaactttccagagtatcagtcactgagacagtgtcttaccaggatgtcagggaaaactaaagctctgtcctaaggagagggaaatgactgtaattatttgcatttgatacacatgacacacaaaaaagttccatgacgacaaggaatctttcttttctaagtcactctggattgtttccccattgctagtagattttttaaatctgtggctgaaggtgatggaggaatcacgggagcactcacagaagaggcttagagacatcagtggtactggtgaaaagaaatgctaagttcctttaatattttcactaagaaaaagtcacacaaaagtgctatgctgatttagatccaccccccaaaaaaggcattcatataggaatttgatataattctgaagttttgtgtctgtattgttggtcattcttttacaaataattcagcaaaatattaaacttttttaaacactgattcctctcatctctctaaaaaaaaaaacccctcaatcccaaattgagtaaaccaaacataccacatgcttaataaataattttctttctttttgtatttatatatgatctacaacatttaacatgattgaatatggtaattgactatcatattttctaagattatcctcaatctcaagagagaacataatttagtcatttctccatgagaatacaaatagtaatatcttttaacaaatctattcatttagcacataccctttcactgactaaaacaaacacatttaatttgattttgtttttggaagtacgtatttttactgctttcttgcatttcttgttcacagtggttaatccctgagatgtctagccaaaacacagtttgtataatataagcaggtagaataagtttttagtttcttcctacctttgtgacttttactttttctgataaaaatgttatccaaattgaaattattaaaattgtgagagcagtgatttaaactgtttctcagattcccctcacctttgttctctaccctgctccaattcttttaagcctattgagctcctaaggatgtttggatgagaaatgtaaaaaaggagagaaggtgtaaatgtgattagaattagagatttccctgtgttccgattttattttctaagtagtagtcaaggtgccctttgctcttgtttattttattcagaaaagaactgttactgaaagtgtcttttaaaggtcttttcatttttattttatttattggggatggggataatgcttttctattaaaattctctttgcacatgcattgtgcattgttcacacatgcagtagttcctcttttagagggtagttcagaaaggggaagttcataaaaaataatacatttagataatttatataccaactattttttgaaatatgcatgtttgttgatatagaaatctatagcaagtatactctcgatatcaagtagtctgtgaaagtaacttttccttggtagattttggctataaatagagtaataaaaataaactcttgacatggctaagtgaaattttaatactaaaagacactgtaagcagtgctctgaagttgttgttgttttttaaactgctttcattataatcaaatcttattattgctccaaggacagtgtagtttcattctcacacctaagaaaaatgatctgcttggtaaccttggagtttggatttactggatagacatttggctttcaaaacttggttctaccacttgtagttctgcttcatagacaaattatcatcttgaacctctgttttctcatttagaaataggaatattcttaaaaagtgtttgcatagataaaatgaaataatgtaaaatgtcacaaatccaggcacatagtaagtgctgaaaatatgttcttgttgtcattataatttttttgtttactgtcttgattttaacttgatttttaaggatgacattttaattttagatctttatatatcaaagatgtttttacaataatgagttggtttcaagtcagaaatgattatttttaaatttgggaaatgtatttttatctaaagtgatatccgttacattatggtgaatattttgtttatttttgtgaactaataaacctctatgaaacaaggctgcgctgctgctagctgcaatgcccataaccactgtctccactgccacaccaccgttcttctgtctgtagggaggtaaaatagtgcttctaaggtggtttacagattcacacaattagaatgttggtggccatagtcactcatggacagtaatctgaaattgcgactctatttctcatgaaaccaattttgctgtttgaacaacgtgtttgtggggatcaaatttccaaagccagaattgggacccgtcgtctgacattggggcagatgattaacatcaggattgccctgggtcgaagcccaccagccaggaaccactggaaacaagattgtagtaaaattagattcattttgtttgttgcagcaagggagattgcacaccaaagggactctggagagtttggtagtaggtagttgggagggctttttataggatttgggcttgtggtgggctattattataaggaaggtttaatgaagtggggcaattcaggaattggctattttggtaacttttatctaggtgttagaaagattaaggtggggtagttgtcataaataaagaagcagtagtagctagtgctggttaaaagaggggaatgtttagttatttttgtggttgcagagtgcctttgtcctcatccttttataccacaggtcccaagtggtcttgcctcatcattgttttctaattctgtgcatgttatttatcttgaattgtgagcatcaaggcccagttccacttccaggacagtttgtcaccttttcccttgggaagtccagtctgtgctttgatgtctaagagaatcacgtgtttcatttttctctaggcctttagtgcatcttaatggtggagaagtgagtttgattttctactttagggtcatagaatccaatggctcatcaggtgctgaactatactgatcacacatattccctcatggggttaattataactattgctgtcaactataaatctagtgcatcaactacaaatattatatatgtccccattctctctccatcccataatttaagttccattttgccgagtgtccaacatcctatagttgtaaaattggcttaggaggggtacaacttgaggaatttaagaataatattttccacttatcaccccccaatccctattatttttccttgtttccagcctgttaaggctttccggaagatgggtatttttggtgtgtacatgtatgtgtgtgtgtataatccactttcacattgtccttatatttgataagaacactttctaaatctaccacatttcttttatagttacctggtaagaccaagaacaacattctagctaggtgcctcaactaaacagacataatttatagatgaatggtctcttggtataactgttcaaccgacaaacaacagatctgatttgttaaaatggagtcatgagagacttgaaacatatgtctgttgaaatatattctctgtgaatgtggtatctgatctacttggttaagtaacaatagcaattaattttaatagataatagccattttccatatctacctttcttttataaagtcctgaccttcaactagaagaaaaggcagcactgattgtgctctcaattcttgaacttttcagttttagtaaatcttccatttcactaatgagattgcccaaattatcctaaaatgattattcattcctctgtgaatcaccacaaacagcacagcccttgattagttgcatcagggccacatatggctactatgtaagttgaatgtgcagtgtacctttatagaaagaaaagaagatgttatacttccacgtttttatggaagaatgtatgttttcttaaaaatttataaaactgaaaagtacaaataaagtaaaataattttaccatccagaaataaccaccgaaatgcctttgcattgtctttttagcatgctcatcagccccctgctaagcatgactattttttgaaagaatatagaataatttcctttttgaaaaacatggcttttccaattatgaatgtatctttatttcccatttcccatgctgttaaatatctttctaagcctgattttttaaagtggctgtacagtattggattaaatctctgtagcataaattaaattcacctttgtcgttagaactgtaggtttccagtattctctaccataaagtcacatacatggctgaggacatcaaaggcacatgtgccaaactcctacacaactcatggctttgtacatgatttacattactatacgttagggtttttcagcctgagtgccattgacattgggggattggcaattctttgttgtggggtgctgtcctgtgtattgtagaatgttcagaagcatctctcacctccatccactagataccaatagcattaccactctccaccaagtcgtgatgaccaaaaatgactcctgactttgccaactgtcccatgggagacaaacttgtcctcgttgaaaaccacaggtgtgaactcttcaacctgtgggtccttcacacacacagactgtgtggttggcttgtttgcatatcttagcttaaatgtcagctcttcacagaggcctttctcaagttcacgaaactaggttacaccacttattatggtggaatcctttttgtttcctgtgtggcacttttcacggcgccacgttccttttctttgttttaactctgggtcttttgccactaggttgtgtacgtgatggagacagagaacatacctgctagggccattttcctgggcatgtgatctgtgcagtcaagcaggatcctacactccaatgaaccgtgtggttggtttaatgttctcttgtcaacctattgaaattttttgttgttcagacagggtctcactctgtcacccaggctggagtgcagtggtataattacagctcactgcagctttgacctccctaggttcaggtagttctcccacctcagccttctgagtagctgggcccgtaggtgcatgccaccatgcccagctaatttttgtattttttgtagagatggggttttgccaccttgcgcaggctggtcttgaactcctgggctcaagcagtctgcataccttggtgtcccaaaattctgggattataggtgtgagccaccatgcctggccctaattgaaatttgaacaaaaggccctgcattttctttttgcattggtctctgcaaattatgtagccagtcctaacgtgtaccttattgactgtggagtatctggtgcatagaacagggcttggcagagaataagagtttaaatgattgttgaataatttaataaagctttaagtagtattctgatatgtcttttgaactctgattcttaagttaaactctagacataggcctgtggatactgagtatctcagattctgcttctgtgtacaatgatattttttgtcttgtgatgttatataaatgggttaaagatggacccccatgtttttcttacttcttcacagcaggctaggaccattagcccaaagccaaatggtacccaactccgatttttatacatccagttgctttaaatatagctcaaataaatatatttttagccatttaaagcctacctgctttgcatacctgataaaatttaactgaacatctgctaaccatagataaagtaaactctgggacactaaaagaccccaagccattgatacccttcaaagttctctgacccagacacttcccaatttctagtaagtggtatcacctagacgtgcaagccccctctccaatttccccttctcctgggagttcgcttgtcatcttctccttctgggtggtagccaggcaccattgtctctggaaggtctcctgttgtgagggacttcgcctcttggcaacctgtcaaagcaccacccaaataaagctccttttgtactaccgccctcttgtggtcctgtattttctttgattagccttgacatcctgaaactcaccacgtatgggtcaatacttatttctaatggaaggtagggactcaaagtagcaatactgattttaaatatatttctttctttttactagactataggctatttgagagcaggatctgtgattgatttcccttttggttctgtgattaggccaacatttataaataaatagtgatttgtagaattgaatcttatttttgtagatacctaataggttatttattgtgtttaattattttttatgcttaatgttagtagaatgagaaatatagagagtgaagttccttaaaatgtatgtgggctcatttgtgttgaatgaattgtttttgtggggttaatttttgcttacataactgccacaaattttataaagtgaccaaaccttttaaatttaaaggactttttatctgctatctaacatttttgaaatggagtaaatgagttgccagacaaaggtttagaaaggagtattctcagatgtcctgtaaggaaaagaaaattatttaacatctaaaggattaatttgcacagctgttatcgtcatgtagtggggtgactgatctgccttacagcattgatctgttgttgagagaatggagaaaaataaagatgagcagttataatttgcatttggctctggaatggttggcttgtgtattacttgattttttttctgcaaaatagtatttttctaggaggaaattaacagtaaggaactagaaaataattcagcttttctgtgtttcacccttgttaatcccatgtcgggagtaaagtatacatcactcgtctgtggaactattcctgagctgatcattgtttgttaaaggacactgacttggagttcagtctctattgtggatcaaccagagggaccacagttttcagaataaggaaacaaataattgctattaaatcacaaaacatgatatactgtagcaggtataatctgtctctgaaatatttccaacaattccaattttagaaatatttatctaatctttttaaaaaatttattttaaatcgacagataaaattgggtgtatttaccacatacaacatgatggtttgaagcacagtacagatgcattgtggaatggttaaatctagctaattaaactatgcattacctcacctagttaccaattttgttgtggtgaggacatttaacattcactctcttagcatttttcaagaatacaatatatcatattaactgtagtcaccatgctatgtaataggtcacttgaatttattcttttcatctatctgtaaatatgtgtcccttgatcaacatctttccaactcttcctcctccccaacagccccagctcctgataatcaccattctcctctctctttctatgagatcaacctttttagattctacatgaatgagatcatgtggtatttgtctttttgtgcctggtttatttcacttaatataatgtcctccaggttcatccatgttgttgcaaatgacagcatttccttattttttatggctgaatagtactctatcatatccacattttctttgtccattcatctgctgatggatacctaggtttatctagtctttaagacctcttttcaatggtagcatagaaaattataattttcgtgtatgaattgtggctggttatttgtttaggatattttacaagagctgctaggaaattttacttaagtagaaagactatttaagtcaatgctaatgaaacaaacctgcataattagatatggtccagctattaacttaaatatgtttcaaatgttgttgtatttaaaagctagtaaatattgtttcataacttaaattgtttattactcttattaggataatgggtttaaattactagtttttctctcctctgtgctataataaccaaatctatttcagttcttataattccttataggcagcataattaaataatcttcgcagctattttgttagtcttttgcttttccttgttttacagtttcaagagaatctagttcatgatttcttcaatatttgccttgggagaagataaaatctgagaagagaattggttaaaaagcacaccaagagtgtgtcttcattgattaaatgagcataaaaattatttctggatgtccttgttcattacatatatattctttaaatggaagattgtcaatatcaaattacttgtgcagatttatttgctctttgaataactctcttattcggtaaggttataccgagctacatttggttcattttcttttgatcattgagatgtctgtgtttaatgagctaaaactgaagtaggtcaataaaatgaagagattaacagcctgttctcaccaggcttggaattcattttactctagggggaaaaaagtcatttttaaaaaaggtatttgatcaacttaaaaggtaaagggaataagaaaaacatggcaaaactaaaaaagctgagaaatcaatgagttcttcagggtactatttgttaggtgaagctatgtggatctgtgtttgtattgttaagagtttgcattacaagagcagaaccaaattttacttcttcctttgataagttcagaagcacacaaaaaacttcaggttttaaaatatttcctattcaattcatctttggaaatatcttacataaggaaaactagtagttatgacaaaccatgaaaatgtcatggaaaataaatgggaaaagcagacttgtcaccttatttgttgcgtattatgatcacatattttcttttcttttcttttctttttttttgtcaagggacgaggaagatgcctgtgttatttgttttttctcccgactttcatattagattcagggggaacatgtgcaggtttgttacttgggtttattgtgttatcctgagatttaggatatgaatgatcccatcacctggttacttagcataattcccaacagatggttggtcaacccttgtccacctccctccctcccctctctagaagttcccagtgtctgtgtttcccatctttatgtgcatgagagcacagtgtttagctcccacttataagtgagaacatgtggtatttggttttccattcctgtgttaatttgcttaggataatggcctgtggtcacatattttagtgaataatgtgaataacgatgaatttgtagttttgaaataggttagtcttcactccatcacttactacctatgtgacctttagcaaatgacccaacctctcagaaagtatttctctttattcacaggcttgtcccttttccctttcagtggtttttgagaagcatgtggtattgggaaggcggtttgtaaacagtaatagtctctacaaatgtgacataattgattctattacaaaatgttcttagatacatttaaataattatttgtgcttggtcagggagcagacagagaaatcatagtagaatcgtttccattcttttttttttttttttttttttttgagaccaagtctctctctgtcgcccaggctggagtgcagtggcacgatcttggctcactgcaagctccgcctgccaggttcgtgccattctcctgcctcagcctcctgagtcgctgggaccacaggcacccgccaccacacctggctaatttttttgtatttttagtagagacggggtttcactgtgttagccaggatggtctcgatctcctgacctcgtgatccgcccgccttggcctcccaaagagctgggattacaggcgtgagccactacgcccggccttccttcatcttaatggaatatcaaagtttcaaatatttgcctcccctcactccctctcaaggtattaatcctgtactcttaggaacatagtccatgttttcattatttaatatactaaatattttattatttgtagttcattcatatggtaaaatcaaatttgtttattcatagacaaggtttaagaactaaagactgggctttttcacatctcagcactttgggaggctgaggtgggcagatcacgaggtcaagagatcgagaccatcctggccaacatggtgaaaccccgtctctaccaaaaatacaaaaattagctgggcgtagtggcacgtgcctgtgatcccagctactcgggaagccgaggcaggagaatcgcttgaacctgggaggtggaggttgcagtgacccaagattgtgccactgcactccagcctggcgtcagagcgagactctgtctcaaaaagacaaacaaacaaacaaaaaaacactggacttttgcaaaataatgctatttgaattaattcaattaaggtaaagaggaagctactttccctggaaatataagatggttttaaggctgaattaatgtgagtagggatagattctctaatgtctgattggcttcatcaagtgagtaggagttacttctctactttattgtgttcttgcgtgttgtagtgctgagggtcttggcaagtcccctatattggagataagaacttatcttccatgtgaaaagcacaagggtggagtgtgctggcaaatctctgtctgccccttcagaaggcctctccaccctaccctttgttcctgggccctatcagtgggcattcttggctctggcagttaatgggaggcagtagctacagaaggactgggcaagtggagtggggcagacataggtctcacctttatagagtcactacaggttggttatgaccctttacataaaaccatagctcctgttgagtgtcctcacaagtctctgaatccttataactactttctctctttgcttcctaaggggcagtatcagtgacctcacctcggttattagctagggaatattgcatgatccttatagctttcctatatcctgctctttataaaaattttattaaatctaattttagggtgccagtctattttctcccaggattctgtatgataacactttatatactttaaatatgtcaagccacagctttcagaagataatttgatttgtatttaaaatgtatagaaacacaaatctgttctagagttactttataaaagtttttagaagttctagtcaataatttctttactcacattcagttgcttcataatcatgcttctgttaaatgttcctttccctcccttccccaccctttcctcttaccccttttgtgaagagcattggcaacagctagctctttaggcttcagttgaaaatgtgactgcatggataacaccccatgatgatgtgatagcttaatccccacctacgctgtcaattcaatcaccaaattctcctagattctgtttcacaaatgcctttgtgaattctctgcctatcaccattgctaccaccttgttttaacccagtgccttttcgtggctgaattgctcaatcagcctatttctgttcttagcccttgctagtccatttgccaatagattcccaactgagctcccaataaaatccaaatcttatctttatttcttgttcactgcctttcttaaaaataaaagaacatgattgtatttgaatacataacttctgtacaataaaataaaatgaaataccacagtgaaatggagccctgtgacattgcatctgtaatgcacagcaatcaaaaggttagcatccttaatcataaatgaaccctcataaattggtaacaaatacacaaatataccatgtgaaatgaaaaaagaacataaagaggaaactcaaataatgtaaatgactactgtggatatgtgaagattagtgaacttaacagaggaaatataatttctcaggaatatgacgttatcaaagattagaaatacaaatatctaatgttcctgtgactgtaggaaacagagcattctcatctacaaacactgaaaaagaaggctgataaagactgtctctgccttctggagaattccgcagtatgaatcaaagtttaaatgctgaataccctttgcccaacttataggaacatattccaagaaagtaattggacaaaattcaaactgatttatatataagcatgttcattgtagctaatgtaaacatctactaaatgataaattatggataattatgtggacattaaatgaataaaggtaaagctgtataaataaccaaagtagaggcctagcttggtggctcacgcctgtaatctgagcactttgggaggccaaggcaggaggatttcttgagctcagaagttcaagaccagcctgggcaaatagggagactccatctctacaaaaaattaaaaaatcaaccaggtgtagtgttgtacacctgtggtcctagctaatcaggtagctgaggtgggaggatagcctgagcccaggaggtgaaggctgcagtgaactatgatcatgtcactgcacttcagcctgggtgacagagagtctgtcttaaacaaaacaacgaaaaaccaaaatgaacaagtgacttaagacatcattgaaaggaaaaagcaaatatggccccacttaaaaaaaaaaactacttacatatcgatttatgtattaacaaatcccaaacaatgtggacagaatgccattagtcgtagatagcattggagaatagaattcgttggagaaaaagcagtgaagaagtgaaaatatatactttacaaatttctatgtttgaattcttaaaaaagatatttaaaaattaaatcagatttaatagttaccctgtgattagtatttataaatgtcattcacacttacaggagcactgagatgaaggccttgccatcctatcgtcttgagcttctctgtgtgataacactttccaggctcctgggattgagtccaatagcagcaaaacaatagtcactctcactgttctttatcctgatcatcttggctctgatgtagcttctcagacccttggtgatctggccccttcttttttaactttgcgtgctctttctccgcatttggaagagtctgtttttgctcctgagctaccataaataaaattattcctcaaaaatcatccctggaaacactgagatgatctaaactaacttcagagccaggaattatttctaaagtcatcttcaaatcagaatacctaattatggccatatctttaagaacaaagaaacatcatttctctcttggactgtcatgatagcgtattggttttatttgcagttttatcttcattggaagccatttcccccactgccccagtggtctagtttcccctactgcctcaatgatatagtttggctgtgtccccactcaaatctcattttgaattgtagttcccataatccccacgtgttgtgggagggacccagtgggaggcaattgaatcatgggggcagttaccccagtgctattcttgtgatagtgagtgagttctcacgagatctaatggttttataaggggctttttcccctttgcgcggcatttactctgtcctgccaccttgtgaagaaagtgcctgcttctcctttgccttccgcaatgattgcaagtttcctgaggcctctccagctatgcagaacggagtcagttaaacctctttctgttataaattacccagtcttgggcagttctttatagcagtatgaaaattgactaatacagtgatgtttccatatggaaaacctgattccatttcctctctaaactgttcacactttaagatttcagtgacagcaggccagtgaagtacattgtcagtgcatctcaagggacaatgaagacaaaggagggggagggatgcagatgggctaaagcaatgacagttgggactagagtgcttacaaatctctctgtttggcttttgcatagttttttctgctgcagagtgatttgcttcacgtaacagaaaatatgactgctataacgcttccaccaaaagggagaaactgaccatactctcttggtcatgagtttaaaaacttcaaggagggtgtcgccttataaagtatggctattttccaactaactatgaaggtgggttggggggtggaggagaaggtcttagaaaagctgtgcaagtcatatacataaatccacaggggtttgatacacatcttaagacacccttcatggttctctagtgctatggcaaaagctcagacttccatgtcttgcatttacatttctcagggatataatccttgccttcttttccagtctttgtctgctgtggcctatccactgtttcctaccttgcctccctgttgctggagataacccaccatgggccttgagcatccctgtgtgttttgactgggcatgctaacaattgaaggctctgacttccctctgcttgggccatgtgtcagtgttgtgtttgcagtgagcaactttgagggacggtctcccccagaataaagagaaggattgcttaggcttgctgtaaaagtggtgaatccccaacaagttcagtgttcttcccctgtaacacaatcccctacatgtgcaggcaactatctagacgcttgtggagcagggtgctaacgtgatgttcgtgctgtttgctgtgagtctcctgttttatgccagcatccatgaagcagcaagtagggctaatgtgcagacctttcacaactcccaacaactttccccagtccacagccgcacatagacctggtgtttcacttcacctattccccagtgcttttggtttccccaatgagccacacctttttatacgtcttgcctattgttgcctctctatggaatataatttccttccttctcttcccccattcttgtctgaccaatctgagttcaaatttgttttgctacttatcagctttgtgaatttagagaaatttaactatattgaacaaaagttttcatttataaaataggaatatttttctaccttgtaaaagtctttttgcgggggtggggggggtgggggcttgtaaggagactataaactatctatttaaccaaatgtaaagatgttgctcaatcttctctgatcccttttcatgtctctccaagaaggtgatatcatttcttcctgtgtgctcccacaaaacttagtgcatcttttatagcattttatcacattaattttttttacaaatgtgtttcccactaatccgtgccctggagggaaaattgcattttatcatttttggtatccttaataactatcacagtgtcttgtacagaatgggtgcttaataaatatttgatgaatttatttgatttattaatcaaagaacaggaaattaccctgcagtgtagcagaggtgggaggaagaccgcatatcctgagaagtaccttgaggagggaggcaagagtccatgtacagtatagggctgcccattcccacccaaaatgtagaaacatataaatttatgagtccttcagatgccatttttaagaaccctcattaagttgacctcaaaaagaataactagcaaaacgcaaactgtgtgctgctgcattttacttctactagctgtttaatagtgttttaggaaaaagggtctcactagcttgggagaaatgctgcatcctaaacatgtttcttgaagagtcacaatacatattagcattttaaatctctgagaagtactatacttgagagaatccatttcttttattattattattattattatactttaagttctagggtacatgtgcacaaagtgtaggttttttacatatgtatacatgtgccatgttggtttgccgcacccatcaactcgtcctttacattacgcatttctcctaatgttatccctcccccagcctcccaccccctgacaggccctggtgtgtgatgttccctgcccaagtgatctcattgttcagttcccacctatgagtgagaacatacggtgtttggttttctgtccttgtgatagtttgctgagaacgatggtttccagcttcatccatgtccctgcaaaggacatgaattcatccttttttatggctgcatagtattccatggtgtatgtttgccacattttcttaatccagtctatcattgatggacatttgggttggttccaagtctttgctattgtgaatagtgctgcaatcattgagaaaaccagtttattttcgttgggaaaatgttttttgacttagcccgccttttaccattcccttgaaacattttttacttttacgtcttttacttaactccaattacagaggcacttcttgaaaaagtggatggaacagagtggggtggatggagcagagggggggagtatttagaaggcagaattgttagaacctctgagggagaaataagagtctagtatgattcccagtttttaaatagctttcagggaatataaggcactctgtagggaggaaggtacaacactgggcatgtcaatattgaggctactgtgtcataccaaggtcgtgatgtgtagtagatagttaaacatatgggtccaaatatcatttgagagagtggcagcagaaaaagatttagagatcattgggtgtgtaggtgaatttctagaagtagaaaataattcagggacagaactgagagatggaactcgagataacacaaatacagtagcccctgctgtcagcccacaaaacgtagattctctaaagacaaggagtttattctgaactctgcagaagctttgcaggcagaatatgtgtgctgcaaccatgggtgcatttgagaaggtcgaggtaagggaaagattttaacagcaaaaggaggagtacactaagttgttttgaaacaaagagaacactggatacagggacttctggcaggagttgaccagtttactactggagacaatgtgtcaggtaaatattcctgtgcatccagttagctgtccttgggactgatgtagcaagcagcagttaggagtccataacgaaagttcttgttataagcatatatgcccacaagcccttcaggtagtctttgtagtagttcttatcataggcatgtgtacacaaaggccctccttagaaactcctggctttatttattttcttagggtgtgacgcaactgacttcatttttattctgatacttttcacacatcttatgtgtggttttactttctgaggtttcagttacccatgatcaactgtggtccaaaaatatgaaagggaaagttccagacaaaaacatttatacgttttaaattgcttgctgttctgagtagtatgatgatctctcttaccttccaactccatcctgcctgggacatgaattgtccctttgtgcaatgtgtccacactgtctgtaccgcctgcccatcagtcatttagtagtcgctgagttgttatcagatttaaaacatgtcatatatagagcgtttagtactatgaatggttttaggcagccactaggagtcttaaaggaataggaggcagaagataatccagccatattctagaagtcaagaagaagaaagggttttgagaactggggagtaaattgagtcagagtccacaaagatgtcagtggtgtttagaaatgaataaacgtctcttggatttggcaagtaagagttctccacttatctgggtatatgcatttaccaaggagtgctaggatcagcatttagattgtagaattgacacaagcatgaagtggaaacagcgaattcagactaccctttcaagaagcttgattctgcaggaaagaaaaggctagagtatagattgtgcttcttgagtgtgtttgttttgcatagtacacacttcagaaatatgtaggtaacaaagtgatggggtgagtgtggaaggaaaggtgaacgggtgaggcagcagtcacaggcagactttctggctatgttaagggttttggactttattccaagagcagtagaaagccctggaagatcttttagcagaagtgccacaatcaaatttgcattttaaaaaagacctttctgttctgtagggtattcctttaatacttcttttccaggtgtgagattagagtggttgtagtaccaacaggaataagtggattccaaacttatttgaggtagaatcagtatgattatgattattttcttctgcttgtcttgtaacaggaacctgttaagatatttctgatgcatcttttcagttgtacatacagctgaaatcagtcctgaaagacaaaaggtgcatactgaccttgcattcatgataatttgaatgaccttaattatatcgtgtgttttgtataggtattcatatgatgtatacttctcattacctggttaatatattcttatgctgtaggacccttttattactatacaagttataaaacttcaagaatagctaataatttgagcaagaaggaatcaagcaattcaatgtcttaatagtttccagttagctatagctttctattttatgtgaatttatattctagctcttttgatattagtttaaatgaatgtacagagattcatataatctgaaaataataatagtgagacaatgaatatgagcacaagcataaaaataatccccaaactaagagtagtaaaaataatatggaattagttataaggttaggacacaaaatacacgtacattttattttagcagaataacgcctcaacactttctgctaggctgaaaattttggctctgggtttgctattagttattacaaagaataatccagtcaacaacgtgattcacagccattattagaaagagaaaggaacaagaaaattttcatggatttttctaaaatagattatataatgatactagtaataagccagtaggtaaattttctttaactgagagaagactctctgtggaatatttggattgtggttatcgtggccaggaagaggtaaactgcagaggcaactatttctatgcagtgagaaataaaattgtgcctggtaacaagacgtattagattgaaattgagatatgttgttagaatagaaaaaatgatcagatcaaaacttttaaacatgcgaattgatcctcctgatggccattacctatggaatgcttttagcaggatgtacctagttgtttgctgcttatggtaaataaacctggaatttttggatttatgagtcatggaccacatgaaattgttactgttagttatgtcacagttagactacagaagatgtttcatgaccaaatggcctttcttgtttaatgaacaggtgagtggttaaatttgggcctgggtttatcccaaagtagcaaggaaggatcctggggagctgcagggatggcctcagacttcttgcatttcctgtgtctcatgatcctggtatcctaaggattattagtaaactctgatactgggtaagatctctgattctgtgcatcagatttggcaatccaaccctttttgttatctcagcctagtgagctttgtttctagcctagtgagctttcatacttgtgggtttcctttgttattcctttagtaaattttatttttgccatgtaaattataaaataaccgttctccatagtgaatgatggatgtctgtcttatattttatgagtatatagctgtactcctcatagttcctggatcacacacttcttctgtacccttgcttttcaaaattaggaaaccaaggagtctccgttttggggactcctggctttcagcatgtcaagctgtttattctttttttattttatttcttaccctcagagccagcagcttaactaccattactttttcctttctgcgattatttttcgatttaccttcagatattttgtgaaataaccttatcaatgtatgcatttaataaaatctatttcctctctcatatggtttggttctgtgtccccacccaaatctcatctagaattttaatccccatgtgcaaagggaggaacccggtgggaggtgattggatggtgggggcggttcccccatgctatagagatagtgagtgagttctcacaagagctgatggttttataaggagctcttcactcttctctctctggttgccttgtgtataaggttcctgcttccccttctgccatgattgtaagtttcctgagacctccccagccatgtggaactgtgagtcaattaaacttgtttcctttataaattatctagtcttgggtagtatctttacagcagtgtgaaaatggactaacacactccccctcaaaataatgtgtgaataaatttatgttggcatcttttggtgtcttaaaatggagaatttgctatcttggaaatcaactcatgagctactctatgaggcataattatgctatcaggagcatatttctaccaatcattacaaattaacatcatcttccgtagtcaccaggaggtgaactgataaacacttccaaggattttagcatcattcacctttttctcttagcttctgttcacagaatctgttagcttatttccttgtgtagcctggggtagaaacttctctaaaggttataaagaactcctcacagttattttgggatgtgatggtctcttttaacaattgtatactgtgctgacatgcctcttcagaaattgtattctagttataaaagagcacatttttataattaggataataattgtatcctaattattattatgaagggaataataatacttaccaatgtggaactcagaagactaatattttaactctctttttttccttcctcatcctccaagtgatgataaaagtgaataaaggaatgcaacaacaaaaaaatcctttgttgaacactgcaatggaatattggccaacaatattgcattgaattgcaatgaatatttgtcaatgcttgacaaatgtctgtgtgataaagttcatggaagaaaataatgagagaaaaactaataagcttacagttggctgtaacttgtaaaagaaaacttgctccagaaataaggactgtcaccctcagtacagttttactaacaccttttggctcagaattatagaagcctgtagagagggtgggccatgagacaataagagtggaaagtattgactgtattgatgtattttaaagtgctccatatattggaatttacaaagtatatgtactctaacaaggctggcatgctatgtaaagcaggtctcctgctaaaattgcccacaatgaagtcaggagtactagctggagaaggaagcatcaccctggagccaacagaaacacagtaatgaaaatgggatggagccttgaaacgtccagcacctttctgatgatgatccttccctataccactgggactcctgagtctctcagcgctacagaagcattacaaaaaacaaaaacttaatatccctttctaggcctagaagctgacaatagaaaacctacaaattctgacaaactcaatctcaactccaaatactttgtaagacagatagctttggtaaggtgcgtataaaaatagaaaaataattggatttgtaaaaagcaaactcagtattttactcttaaatatatcgccatagtctgctttctgttgctataactgaatacccgagactaggtaatttataaagaaaacacatttaggctgggcatggtggctcatgcctgtaataccagtgctttgggaggccgaggtgggtggatcacctgaggtcaggtggttgagactagcctggccaacatggtgaaacctcgtctctactaaaaatacaaaaattaaccaggcatggtagtaggtgcctgtaatcccagctattctggaggctgaggcaggagaattgctggaacccagaaggcagagtttgcagtgagcccagatcacgccattgcattccagcctgggcaacagagcaagactcagttaaaagaaaaaagaaaaaaaaaaccatttcttacagtgctggaggctgggaagtcagcttgaggggctgcatctggtgagggccttcctgctggtggggactctgcagagtcctgagatgctgcaggtcatcacataacaagaggattcatgagagagagccaatatggtttttataacagacctactctcatgatagtccattaattcattgacaccttaatctatgaatacattaatttattcatgaggtgagagctctcatgacctagtcacctcttaaaggcctcatgtcttaatactgttacattgcagattaagtttcaacatgagtttcagaggggacattcaaactatagcagaaaagcacagcaaaaaagtacctccttaacttgaattcacaccttatgttggattcataaagacaaaactgcaccatcttgaaaaataatctgggaacaagaaataattcttggtaaaaatcatggatttcttgatacagtgaagtctgtgaaaggtaggctaaatataaaaactattctcagaaatatagaagacacattactgaatcagacttgaaatggtatagtgtactggttaagtgcatgagttttggagccacactgccagggctcatgtctcagctttttagtagacatttgtattattgctttgtggctgtttttattattgaaatggtatatattttggtaaaatctttgaatttaaaggattaaaaaatcattaaggcttatagtctaaggaaaataggttattaaatggccaaaagccaggttgatattggacttctccacaatgctgtaaactgggagatacagactttggaagggaaatatacataagacagtaggcattcttggatatacataggcttaagaagcctactatgtatggagagtaggatggtggttaccagtagagggggggtgtggggtgtgaatgtggaaagagagaatgttggtcaaaggctacaacgtttcagttaggaggaataagttctagggatctattgcacagcatggggactataatgtattgtgtatttcaaaattgggaaaagagtggattttaaatattctcacctcaaaaaatgataagtatgtgaggttagagatatgttaattaacctgatttaattattccacaatgtatacaggtatgtgaatgttttgtgctcacattgtagcccacaaatatatataattactatttttcaattagagataaaaataaaagaagtctattatatgcatacaatttattttttaaacttaaaagtttccaattcaactgagaaatagttacaattaaaatattcattcacaatgcatacttggaataaagtgaccagtgacagaagaaaaacaggtcattttagttattttgggaaacaaagaagattcctgatctcaagtttatgtaattgttttgaaaaatgattctaaatcataaatctgatgttgaatttctggaggtaatcaggaagtggaactcttgcactgtagtggatcaggataggacctcatagtaactgataggttttatccagagcaggtttctgaggatttacgggatcctggggacacatggtggcaagtacatcagtttcatcatgacattccttgaccttcttaggacaagaatgacttttttttttggtggtggtggggcggggttggtggtcgaagactggcagaatccagtactgcttttttttttttttttttttgagatgaagtcttgctcttgtctcccagtctggagtgcaatggcgcgatctcggctcactgaaacctctgcctcccaggttcaagcaattctcctacctcagcctcccgagtagctgggattacaggcatgtaccaccacgcccagctaattttttgtatttttaagtagagacggggtttcatcatgttggccaggctggtcttgaattcctgacctcaggtgatccacccgcctcggcctcccgaagtgctgggattacaggcatgagccaccgtgcccggccaaatccagtgctttctaaagacactaagaatgtggttacccttgctggatatcatagccatgactagcatcccaagggcttaggaaatactgggcccagtgtgaaggctggcaatctggtatgggttgggagaagaaattgaccccattgctggaactgaaagagagagcaggaacataatctacttgctggaattcaggtaagagagtaagtcaggacaagcaaaggtactaattaaaaatgttgaaccaatacagaattaattttggggacttagttaaacccttgactaggattcaattaatactagaatctggggtgtaatgaaggctgcaggtagaaatagggtagctcagttgaatcaagggaagatatctaagtagactgttaattgttaaatgaactgtttatttttcatttaaaatggaagatttatgtttgtataaggaaagcaaatatcatttcttgacagcctgctatataccaggtacttgctagtatttaatgtatttagatataatagcagaacttttctctaagacatgtaaccaatttcaaagtgcttttcaccttatttctttgttttgaatttcagtctttaggttagcatggtttcacaggtggtctcctatttcataatttacctatttcctgggtgaactagaatagtgtgtgatatggttaggctttgtgcccctacccaaatctcatcttgaattgtaatctccaagtgtttaggaagagacctggtgggaagtgattggatcatgggagcagtttcccccatgctcttctcatgatagtgagtgaattctcatgaggtctgatggttctataaggggcttttcccccttcactgttcactgttctctctttctcatctgccaccattcaagatgtgcctctttcccttctgccatgattgtaagtttcctgaggcctccccagccatgtggaactgtgagtcaattaaacttcttttctttataaattacccagtcttgggtatgtctttatagcagtgtgaaaattgatgaatacaataaatggataccatggagagtgggacactgctataaagatacctgaaaatgtggaagcgactttggaactaggtaatgggcagaggttggaacagtttggagggctcagaagaagacaggaagatgtgggaaagtttggagcttcctggagacttgttgaatggttttgatcaaaatgctgatagtgatgtgaacaaggaagtctaggctaaggtggtcttagatggagatgagggacttattgggaactgaagcaaaggtcactcttgctatgcttcagcattttgcccctgacctagagatctgtggaactttgaacttgagagagatgatctgaaattgaaacttatctttaaaagggaaacagagcataaaatgctggaaaatttgcagcctaacaatgtggtagaaaagaaaaactaattttctggggagaaattcaagccagctgcagaaatttgcataagtaatgaggagccaaatgttaaccaccaagacaacggggaaaatgtctctacggcatgtcagagaccttcccggtagcccctcccgtcacaggcctggagtcctacaggggaaaattggtttagtgggtagggcccagggctctgctgctgtgtgcagcatcaggacttggtgcccctgctccagctccagccatggcatattagggttctctagagggaaataataggagagatgtatatataaaagggagtttattaaacagtattgactcacacaatcacaaggtgaagtcccacagtaggccatctgcaaactgaggagccaggaagccagtttgagtcccaaaacctaaaagtagggaagccaacagtgcagccttcagtctgtggccaaaggccccagagcccctagcaaatcactggtgtaggttcaagagtccaaaagctgaatagcttggagtttaatgtttgagggcaggaagcatccatcatgggagaaagatggaggccagaagacttagcctgtctagtccttccatattcctctgcctgcttttatcctagccatgctggcagctgattagatggtgcccaccaagattgagggtgggtctgtctctcctagtccactgattcaaatgttaatctcctttggcagtacccacacagacacctccaggaacaatattttgcatccttcaatccagtcaagttgccactaaatattaaccatcacatgtgcctaaaaggggccaatgtacaactcaggctgttgcttcagagggtgcaagtcccaagccttggcagcatccatgtggtattggacccgtggatgggaagtcagtgggaaccttggcctagatttcaggagctgtatggaaatgcctggatgtccaggcagaagtttgctgcagaaatggagccctcgtggagaacctctgctaggacagtgcagaaggaaaatgtgggcttggagcccccacacagagtctccactggggcactgcctagtgcagctgtgagaagagggctgcagtcttctagaccctggaatggtagatccactgacaacttgcaccatgagcctggagaagtcacagacactcaatgccagcctgtgaaagcagccaggaggggtgttgcaccctgtgaagccacagggacagagctgcccaagaccatgggatcccacctcttgcatcagtgtgaccttgatgtgagacatggagtcaaatgagatctttttggagtttttaagttttaatgccttccctgactggtttcatacttgtatggggccagtaacctctttgttttggctaatttctcccatttggaatgagaacatttacccaatgcctgtaatcccactgtgtcttggaagtaactaacttgtttttgattttacaggctcatagataaaagggacttgccttttctcagatgagacttggacttttgagttaatgctgaaatgagttaagactttgggggactgttgggaggcatgtttggttttgaaatgtgaggacatgagatttgggaggagccaggggtggaattatatggtttggctgtgtccccacctaaaatttcatcttgaattgatgtccccaggtgttgatggagagacctggggggaagtgattaggttatgggggctgtttcccccatgctgttctcgtgatagtgagtgaattctcacaagatctgatgtttttttaaatggtagtttttcctgagctgacacacagagtctctcttgcctgatgccatgtaagacgtgcctcttccccttctgccatgattgtaagtttcctgaggccttcccagccatgtggaaatgtgagtcaattaaacctctcgtctatacaaattacccagtcttgagtatgtctttataatagtgtgaaaatggactaacacaatgtgtttatttgctatcctattgttgcagtttctttgctcccatagttcagtgagtgttacagctccttcactcccacagtttggtgagttgtgagttcttgtctcatgaccaagaggaatgaggcatgcagtcactggagagtgagtaaggcagagtagaatttttctgagtgacagaaagaaagccctcagcagcaagaggagacacaaaagtgggttgctggctgcaaggttgagtctggggtatttatggttttagaatagggaaatgcatgctgattggcttatgggtaggcttggaaaaaagcatcattcagaatgaggtatgatagtttaaagaaccaatcaggaactgaggcttggtcttggaccttggcccaggaccaatcaggggctgcgtgcaccaaatgaaaatggaagttctcaagtctgtggactctattccaaactggtatgttggtgtttaggctccaggctgtccttggcttgaaggttgagtttcactggggacctgtccctgtctacctaggaatttgtctgcctcctatcgctatcactatttaattatttgatgagaacttcctgtattctttttttaaatctcgaaattcaagaaatttgaaaggaatttttttttttgttaatgtgaagttttaagtgattctaagggaacacgtgcttatttgaacataaagcttttctagggacattttttgtatagcataccactttcaagtttgttttaggaaaaaatcttgttttacttatagtatatttaaaaatctatctagtttatgagcatctgggttttgttttgttttcttttctttttgagagagagtctcactctgttgcccaggttagagtgcagtggcatgatcttggctcactgcaacctctgcctcctgggttcaagcaattctcatgcctcagcctcccaagtagctgggattacaggcatccaccactgaacctggctaatttttatatttttagtagagatggggtttcaccatgttggccaggctggtctcaaacttctggcctcaagtgattcacctgacttggcctcccaaagtactgggattacaggtgtgaacaactgtgcctggcatgaacatctgttttaataaaaaaactttagttactcttcaaggcaactcatagactaatacagatgactggattttttttcatgctttttttgtttgtctttaacaaacaccagttagttgctggataaaggagaaatattacatggtctatgtccccaagaaggtgacagtttagaggagagaaggagataggaaataaaattataaaaagttctgtaggatatgatactgattggaagaggtttgaatggggatccaagtagagattggttaattctaacataggccctcagaaaagaatgacctgaatatggaaagatgatagaatgtttagtagaaggattggaagaagagagatgtcaagggtattctcacctgggcgagaaatagtataaagttatggaagtgatggaacaacactgtgatcagaggattccaggtgagttagtggcactagagttgatggtgtgagacagagaaaaggtcagtggctctcaatattcattatgcaaaacaaacacttgtggtaacttttagaaataaagatacccaagacatcctgattcaacttgtttgggaatctttattttcatcgaagcagtttgccttctcctcttccatggttatgatggaagtatccgtagaccacttttaaaattttagaaacactatgtgaggagcaaggatacatggaagagctttaagctgggatagcacagtcatatttctgtgttagattatacactctggcagcagtataaaagataaaagagtgcaagagtcaagaaactatgtttttagggaacaggccaaaatgctacaacagagaccataatatacagtggcttaaataacatttttctttttctttttgataccttcaagagttgaacagcccagggctaccatggagactgtaccatactggatatgtggcttctaaggttcctctagaaacccataaggaaaaaagaggatggtgggaacaggagaaattttagcacaaatatttttaaggagatgccatgagatttataactgtttgacctgactatagtcagatgggcataccttgggtccaggattagccacactgatagccaactgtgcccttgggaagacaaatcctagttggcttaaaccagtcaacatacctcatgttttggccatagtgcttgtttaggtatggactcttaagccaataaagtcaataaaatatgaagagaagttttctgggacttctgagagaagtttttcttcctctgtaaagactggattaaggatactttctcttcttctgagtggtgtggactgaatcacagcagccattgtgctacttgaggcagagtttttgagggtgctcaccataaagaaactcaggatgaagcaaaatctgtgggtggagaggcggagaggaagaagccttctgtaaaactgtttaagcatctatgtcaagggtaactaacattatactcactctatacttttagttttctagactgatgaaatccctcatgatttttgccaatttgggttagatttttgtttatttttatttgcaagcatctgggcaacacgatttccattaatgtgcgtgttaaacatggtggcagtgggggttccctattatagagctggtgatatgccaagtaatagaattgactgattgattgagacagggtctcgctgtgttacataggctggagtgcaggggcgtgatcacagcttactgcagccttgacctcttgggctcaagcaatcctctcacctcagtcttctaagtagctgggaccacaggtgcatgctaccatgcctgactaatttttctattttttgtagagatgggattttgtttgccatgctgcccaggttggtctcaaactcctgggctcaagcaatcctcttgcctaggcctcccaaagtgctgggattacaggtatgagccactgtgcccagcctacagtttattttcaatacattatttatttctgggcacacaaaagccgtggtgattgagatgggacagttttgagtgtcagtcatgattctgtactcaaaaccactctgcctccccatccacgatttctacatctggtttatttgactggattttccactcttgtgtatttcagggttcctagatctttctgtataatgtgtcgatcaatctgtcttctcctactaccttcttaatagtatattagctattcattgggtctcagaaaataattaaaacagaaaatgtagagagctcagatggttttccttccatttctctacttcatttgctatattttgtctccacggtgaaatagaataggcacttctctcctaattatatataaaacactctgaccacaaacagattatactctgtgttacaattataaattcccaggtgaaaaaatccaattggttctgtctgagtcatatgttccccttcaggtcaacaaactaatcagaggtgtgggttcacattacacacatatggctggcaagtgcttctcccatggacggggatgttgagagagctgttctcagagaaaatggggttattatgaggtgggctgatgccaaaggaagtatctgttgtagcttgataaataattttggtctgagctacatttatcgttgaaggtttctttccatctcacctctaacttcattaccagcaaggtctttagtgtgtatagatcagttgaagcaaatcgatccttgaaaagcaagaggtaatgcttaatttcatgtgccagatggttcagaatatcttcttcagcccggattgcaggagctgtgccatgtgggtatggtttcatttagagaaataatgtgggttgttggttattgagatagtctttctggtgagttggcaaaaaaatataatttgaggtctcttttaaaacttaggggatgagactgcagttaattttctcatccctcatgtagctagatatgctgcttccactgctgctgctgctgctgctgtgtgtgtgtgtgtgtgtgtgtgtgtgtgtgtgtgtgtgtgtgtgtatgtttaggccttttgtcttctaagctggttaacctgtagcagaatgttacttgttgactccaaattcatgacttcaagtttgagaagatattctgtttagcatagttggcttgaattaatgaacacagaaaacatcctttcatattagatatgcttgtgattggttataaaagttaaaacttaagtatgtggttttgtatgaacattaatcaaccattgctggaaaaactgtactcaatctgttgaaggatcagtgataccatttatgtatatgaggggcagtattagctcttctatctgtgaatattatgttgaccttatttgtctgaatttgtcggttgccaagtgttacttatttttattgaatccagaacaataaaaactcataagagctaaatacttaatacttttctgatttttttcattttaatgaataatatcaatatatacttttataggacagtgcctgtattttgtgaagtaaaaacacaaatctctaaattacagcagtatattgttaaggaaaaatatttgtaaaaatataaatacaatagccataaatgctattccaaatggtttactgaaccagttttttgtgtcctcagcaatgtgctcctcttatatatatttaaaatgatctcattcattttgagctaagacggtggcttattaagtttcttataaaatattatatgtgcccttagggagaaaggaaaggaggctaacactttaatgaaggccttttgttccaggtactgtggtagtcacttggaaagaagacaaaggtggttcttatcctattggagctcatagtcttggaagagaagtaataacaattaattacacataagcaaatgttcaggaaagcaaagtaaaacacttgaataaaccatactttttcttaagttttttttttctcctactccattgactgcttcttcccaggctctttttttttttaattatactttaagttttagggtacatgtgcacaacatgcaggtttgttacatatgtatacatgtgccatgttggtgtgctgcacccagtaactcgtcatttaacattaggtatatctccaaatgctatccctaccccctccccccaccccacaacaggccccagtgtgtgatgttccccttcctgtgtccatgtgttctcattgttcaattcccacctatgagtgagaacatgtggtggttggttttttgtcctcgtgatagtttgctgagaacgatggtttccagcttcatccatgtccctgcaaaggacatgaactcatcattttttatggctgcatagtatttcatggtgtatatgtgccacattttcttaatccagtctatcaatgttggacatttgggttggttccaagtctttgctattgtgaatagtgccacaataaacatacgtgtgcatgtgtctttatagcagcatgatttataatcctttgggtatatacccagtaatgggatggctgggtcaaatggtatttctagttctagatccctgaggaattgccacactgacttccacgatggttgaactagtttatagtcccaccaacagtgtaaaagtgttcctatttctccacatcctctccagcacctgttgtttcctgactttttaaagatcgccagtctaactggtgtgagatggtatctcattgtggttttgatttgcatttctctgatggccagtgatggtgagcattttttcacgtgtcttttggctgcataaatgtcttcttttgagaagtgtctgttcatatcctttgcccactttttgatggggttgcttgtttttttcttgtaaatttgttggagtttgttgtagattctggatattagccctttgtcagatgagtagattgcaaaaattttctcccattctgtaggttgcctgttcaggctgatggtagtttcttttgctgtgcagaaactctttagtttaattagatcccatttgtcaattttggcttttgttgccaacgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcgtttccccatttcttgtttttgtcaggtttgtcaaagatcagatggttgtagatgtgtgttgttatttctgagggctctgttctgttccattggtctatatctctgttttggtaccagtaccatgctgttttggttactgtagccttgtagtatagtttgaagtcaggtagcatgatgcctccagcttttttcttttggcgatgcgggctcttttttggttgcatatgaactttaaagtagtttttttccaattctgtgaagaaagtcattggtggcttgatggagatggcattgaatctataaattaccttgggcagtatggccattttcaccatattgattcttcctatccatgagcatggaatgttcttccatttgtttgtatcctcttttattttattgagcagtggtttgtagttctccttgaagaggtccttcacgtcccttgtaagttggattcctaggtattttattctctttgaagcaattgtgaatgggagttcactcatgatttggctctctgtttgtccgttattggtgtataagaacgcttgtgatttttgcacattgattttgtatgctgagactttgctgaagttgcctatcagcttaaggagattttgggctgagatgatggggttttctagatatacaatcatgtcatctgcaaacagggacaatttgactttctgttttcctaattgaataccctttatttccttctcctgcctgattgccctggccagaacttccaacactatgttgataggcgtggtgagagagggcatccctgtcttgtgccagttttcaaagggagtgcttccagtttttgcccattcagtatgatattggctgtgggttgtcatagatagctgttattattttgagatttgtcccatcaatacctaatttattgagagtttttagcatgaagggttgttgaattttgtcaaagaccttttctgcatctactgagataatcatatggtttttgtcgttggttttgtttatatgctggattatgtttattgatttgcgtatgttgaaccagccttgcatcccagggatgaagcccacttgatcatggtggataagctttttgatatgctgctggattcgatttgccagtattttattgaggatttttgcatcgatgttcatcagggatattggttctaaaattctcttttattgttgtgtctctgccaagctttggtatcaggatgatgctggcctcataaaataagttagggaggattccctctttttctattgattgaaatagtttcagaaggaatggtaccagctcctccttgttcctctgatagaatttggctgtgaatccatctggtcctggactgtttttggttggtaagccattaattattgcctgaatttcagagcctgttattggtctattcagagattcaacttcttcctggtttagtcttgggagggtgtatgtgtcgaggaatttatccatttcttctagattttctagtttatttgcgtagaggtgtttatagtattctctgatggtagtttgtatttctgtgggattggtggtgatatcccctttatcattttttatgtgtctgttagattcttctgtcttttcttctttattagtcttgctagcagtctatcaattttgttgatcttttcaaaaaaccagctcctggattcattgattttttgaagggttttttgtgtctctatttccttcagttctgctctgatcttagttatttcttgccttgtgctagcttttgaatgtgtttgctcttgcttctctagttcttttaattgtgatgttagggtgtcaattttagatctttcctgctttctcttgtgggcatttagtgctataaatttccctctacacactgctttgaatgtgtcccagagattctggtatgttgtgtctttgttctcgttggtttcaaagaacatctttatttctgccttcatttcattatgtacccagtagtcattcaggagcaggttgttcagtttccatgtagttgagaggttttgagggagtttcttaatcctgagttctagtttgattgcactgtggtctgagagacagtttgttataatttctgttcttttacatttgctgaggagtgctttacttccaactatgtggtcaattttggaataagtgcggtgtggtgctgagaagaatgtatattctgttgatttggggtggagagttctgtagatgtctgttaggtctgcttggtgcagagctgagttcagttcctggatatccttattaactttctgtgtcgttgatctgtctaatgttgacagtggggtgttaaagtctcccattattattgtgtgagagtctaagtctctttctaggtctctaagtacttgctgtatgaatctgggtgctcctgtattgggtgcatatatatttaagatagttagctcttcttgttgaattgatccctttaccattatgtaatggccttctttgtctcttttgatgtttgttggtttaaagtctgttttatcagagactggaattgcaacccctgcctttttttgttttccatttgcttgttagatcttgctccatccctttattttgagcctatgtgtgtcgctgcatatgagatgggtttcctgaatacagtacactgatgggtcttgactctttatccaatttgccagtccgtgtcttttaattggagcatttagcccatttacatttaaggttaatattgttatgtgtgaatttgatcctgccattatgatgttagctggttattttgcttgttggttgatgcagtttcttcctagcctcgatggtctttacaatttggcatgtttttgcagtggctggtaccaattgttcctttccatgtttagtgcttccttcgggagctcttttagggcaggcctggtggtgacaaaatctcttagcatttgcttgtctgtaaagtattttatttctcctcatttatgaagcttagtttggttggatatgaaattctgggttgaaaattcttttctttaagaatgttgaatattggcccccactctcttctggcttgtagagtttctgccgagatatcagctgttagtctgatgggcttccctttgcaggtaacattttttccttcatttcaactttggtgaatctgacaattatgtgtcttggagttgctcttctcaaggagtatctttgtggcgttctctgtatttcctgaatttgaatgttggcctgcattgctagactggggaagttctcctggataatatcctgcagagtgttttccaacttggttccattctccccgtcactttcaggtacaccaatcagacatagatttggtcttttcacatagtcccatatttcttggaggctttgttcatttctttttattcttttttctctaaacttcccttcccttctcgcttcatttcattcatttgatcttccatcactggtaccttttcttccagttgatcacatcggctactgaggcttgtgcatttgtcacgtagttctcgtgccttggttttcagcttcatcaggtcctttaaggacttctctgcattggttattctagttaaccattcgtctaattttttttcaaggtttttaacttctttgccatgggttcgaacttcctcctttagcttggagtagtttgattgtctgaagccttttctcaactcatcaaagtcattctctgtccagctttgttccattgctggtgagaagctgcgttcctttggaggaggagaggcactctgatttttagagtttccagtttttctgctctgttttttccccatctttgtggttttatctacctttggtctttgatgattgtgacgtacaaatggggttttggtgtggatgtcctttctgtttgttagttttccttctaacagtcaggaccctcagctgcaggtctgttggagtttgctggaggtccactccagaccgtgtttgcctgggtatcagcagcggaggctgcagaacagcggatattggtgaacagcaaatgttgctgcctgatcgttcctctggaagttttgtctcagaggagtacccggacttgtgaggtgtcagtctgcccctactgggtggtgcctcccagttaggctactcgggggtcaggtacccacttgaggaggcagcctgtccatactcagatctcaagctgtgtgctgggagaaccactactctcttcaaagctgtcagacagggacatttaagtctgcagaggattctgcgccttgtgtttggcaatgccctgcccccagaggtggaatctacagaggcaggcagggctgcttgagctgcagtgggctccacccagttcgagcttcccaggccactttgtttacctactcaagcgtcggtaatggcgggcgcccctcccccagcctcgctgctgccttgcagtttgatctcagactgctgtgctaacaatgagtgaggctccgtgggcgtaggaccctccgagccaggtgcgggatataatctcctggtgtgctgtttgctcagtaggaaatgcagaaattacccgtcttctgtgtcgctcacgctgggagctgtagactggagctgttcctattcgggcatcttggctcaagagccttcccaggctcttttgaaggcttccttctctgttccaattcatattggcatgactccggctttgtgttggccagtggttctcaaccagagatggttatacccaagggggggacatttagcaatgtctagagacattttgattgttatagctggtgtgtgtgcatacacatgctagtggcatctaatgggtagagttcaggaatgctgctaagcatcttgctgggttcgagacagctccctgagaaaaaaaagaattatctagccccaagtataaatagtgctgaaattgagagaccttctaaacttcattaactaaactttctccttaggtgatcttataaaaatcttcagtatttgataccataatttgtttcaagtgccccagtttatattttcaatctgcatctttttcctgagctccaaacttgcatattcaaatattatttttgtatctttaactggatgtctaatagtcttcttatttccaaagctgaattctgttttttttccttgcaaacctgatgcttgtgtattctccttttctcttgatggtactcataatttatgcagtttctcaggctaaaatctaaggattatccttgattcccctctctctatcatctgccaagtcttactcaaggcattgctctccaggttatcttctacgttcagtgtatatatctaacttgcccccttcttactttcaccctagtcctaactctcatttgcaatacagaaacaccgattctcaaaataaccattagagtgaaattttaagaaacaaataaaatcaagttactcctgtcattgtaatcaagctgctatcatcattgcaataaaattcttctacaaggccccatgtgaaccaacctcatctcctgttttttctcccctttgtttacatcctgagattcttgccttttccttttttcttagatttttattaatttgactatagtgttcttagacatgattttctttgcattcatttgtcttggggttcaaggagcttcttaaatttgttaatttgtggtgttcaccaaatttgaaaaatttacagtaattttttcatggactattttaccagccctgttttctctcttcttgcctctgggactccaatcttacctatgttacactttttgctattatcccacaggtccgtaaggcttgttcctttcatccatctatccatccatctatttatttttaatctttttctctgtcttcttcagatcacatattttctgcggatctatcttcaagtatactgactcatctgtcaactctactcagctttcaagctcatacagtgaattttttatttcatatataatatttttcagttacagaatttccattttgttctttttcctgcggagaatctctgacctataatttattctgagtttatgttcttttacctcattggagatagttgtaatagctactttgaagcctttctctgttaattctaatatctggggctggccttaatttattggcttatctcttgaatagggtcatgttatatcgactcttcatatgttcagtaattttagattgtcccttggattctgtggatgttatattattctgactctggattctattgtattcctttttagagttttgatatgtttgtcttaggagtaatttaaccggtttggactcaaactgtcactgcgtctcttgggcaacaactataattttcattcagttccttcatccttagcttgccaagagctaggttgcttatagactgcacaagttatgtgaggtatggttcaggggtcagccagaggttgggcagagtttacacagaaactggggttcttgctctcagcccctctcttccctggtattcccccttcactttctagaaactcttccccaacctctgtcttctagttcttcaatccagaaaaactgagttttctatttgagtcactttgtacgtggaatatcctcaggctaaaagccacagagatagaaaactaatcccctgctttttttcttccttcaaatattgactcctcttcagactctcctcttttgtccactctctagggctttcaagtctgttatattttgccagagttaatggtttctatctgtaagatagtgtagccatactgcaagtcagaccctttttgttttttggacatgtaaggtttattttcacttcagggcagggaacttgagtagccattaaagaggtgttatcagaccttcatttaagtataaagttcctttgaattgtggaataaatcatagaagaaagtagaatggtttggcatgctattaccctgggaaatactgttgctgttgtattggctagatttctttatattgcaggtgactggagaaactatggtggatccagactttactctgagcttgaaaatgactatggcatttgcgaatcttgcacctttgtaccatcgaattcattttcagcagtagagaggaagctttgctttcctgggacctttgctttcctggattttcaaagaatattccagcaggaggcacagaggctggctagctctcagcagattgttctatattaatggtcttaagtattttttattctacatagatgaaagattacttgtgtctcagtcaaaacccttctgccattataacatttccaaaactcgtctcagttcttggatgtatacaaagaagatagtctccaaaaaggtaggaggagcaagtttgccaattgtcatttttctattgtgaatttcaaggccctgttttcatctggtgagcatttggtatttcataacatgtaacatccactctggtaaatataagtacatcttgatctcaatgtattggtaccaaagactcttctctatgtctaccatcaataaagctaacatgtgctacaattataaaaatcctgtaagttcactagaggagaggtaaatgttgaaataaatggagaatgtgtgttatcaaccagcaatcctaccttaaaaatattttttattattaaataaagcacagatacaggaagccacacaaatgtatggcttaataagttattataatttgaacacccttgtaactaccacccaggttgaaaacttgaacttttgtcagtatcttgaaagtccttccatgagtcccatcctattaacaaaatattttcttatcactaaagtcaccactgtactatttttataatgatttccttttttgttgttaaaaagtagtttttatcatttccatgtgttgcccatttaaagaacatttgttatattttctatgtctctccttttttattgtgataaaaatatagaacatgacatctactctcttaataaacgtttaagtgcatgttatagtattgctaactgtaagcacagtgttgtgcaacagatctctagaactttattttgtataactcttgtaacataccaggtctccctccatctctttcttttccttatgtatctgttgagaatctggaccatttggctttcagttttccagtctgtatattgctgattgcattctcatggtgacatacaaaaatgttccttagtgctttgtgtttcttccaatttggcagctggattcagagacaagatcagactcatgtttgattccttcggcaagacgttagttggtatttggcagggactataggaggcacttaaggtctggttgtctctgtgattttagcagctactgttgcttaatgcctatatccatcagttccttggagattaatggtgacattcaaagtttattatttctcttattgtttattatgaaaggaggcttctcccatctgctgtttgattatttactggtacagttcatatccaaaaggaaggatacctatttgcttctttctttttatttactattttccaaattaatataatcttccctcatcatcctgtaaagctgacaaactttaaaaaatcaatacagtcccatggatttaagcatatttgattggttgcaatccattacaattattattgaaactcgaattgtctcatatttggccactgcaaacattttgagggtggcttctttcatgaacaaaatcatgtctccccaatatttatattaaagctcccaatgtgattgtatttagagatggggcctttaaacaggtaattaaggttacatgaggccacaagggtaggaccttaatccaacgtgactgttgtcatcagaagaagaggaagggacaccagaagtctgcatgcacagagaaatggccatgtgagggcacagagagaagatggtcagatgcaagccaacgagagaccaacccagtgggctccctgaatttaaacttctagcctccagaactgtgagaaaataaatttctgttgtttaagctccagtctgtagtattttgtcatggtagcccaagcagactaacacagcttctgtgttcttttgatatggcctggtagttatttgatagcttctttgctatctgctacgtaagatgttttagtcagactgtcatctgacagattttctgccccagaagaatgagtcatttcttcaagaagcgctgatttcttcttgaggaaatgatgcttcaagaccataatccaagcatgaggaatgccctttgctatctggttagtcgttgttttggggtcttttcagggaaggtaggaattatatacattttaaaggtaaaattctttatgagttcatgttggtacttataattcaaattcaagattacagagtcttacttaacgtcttctttatcatgtctgtatctccgtttttccacactaaagatccggattttcaagaatacaggatggaattagaggatagaattagaacattccaaaattgcttatttgtttatcccatattagactcacaacaatttcagatgacataaaatacagtttttagtatttatcctgttttttttcttcaggggcttacatgatcaatatctcactttggtatttgttgtcactatctttcaaattccttcattctttttgatttttcaaaatttttatttttcattttctgtttctcttaaggcattacgtttgtgtgattggctcttgtgttccttctagtaaggcttcatttagaattattttcttttatctttaatttttatcctgagtactatcacctcatatctgagttttaaaattctgacatatgttgttctttcatgttttgtgtcattgtctttcagcttgttttgaaatagtatggctaagtttttgatcttttttggagggagcatatcattccagcatattttttcttgtctgtgggatattattctgtttcttattctcttttttattatagtaactctgagtatcgacctcaatatttttgttgttcattttatatgaagttagtgtttgtttttctgaacatttttattgagacaggcttcagcatagcttctgtaacattgcagagcttcctcttctgttaattttgtgtagtgtttaaaaatatggcagctcattttatgttattttctggatttattttcctttgcactttgggctagactttctctatgtgtcttgaatccctgttctgttgaattttgatttcacttacagcatttctcttctgtgtgtggttctgtcctggaaaggagccctgctgaacctgtttgattgtttactggggtggggactgctcttgttccttcttttctatcatgggtcgatagaacacatttaatgattgagggggcaaaattctcccagtttcagctgctgtaggagccccgctttacttgtaggggatatgtttcaagacccacagtagatccccgaagcatcagatagaaccaaacccaactgctgtcagtcagaacatgtttctgttcatgtcttccacccacaaattgaatgccttttccatcttaactaaggacttacgtgctgtggctataacttttcagtttgagttgcgatggcaaaactagcacaaattatttttcccttcttcacggtttcatggatagaagattcattcttatgtagatcttagtaaactcagcatatcgttattttttcttttcttaactgactttcaccttttcacttaagcgaagcactttgggcaaatccagattgctagtattattactcttgtgctttggagccattttgaagtaaaataaaggttacttgaacacatacactgccataccaggacagtgtcctcttgactaccaggagggctagaaagtggctaactggtgggacgcatagacagcggagatctcctggacaaaggggtgatcgacaccccaggtgggatgaatcaggaaggcatgagatttcattgtgctactcagaacagcaagcaatttaagccttatcagtttgtttatttgtttgtttgttttgagacagaatcttgctctgtcccccagactcgagggcagtggcacgatctcggctcacagcaaccttcatctcccagctacaagtgattctcctgcctcagtctcctgagtagctgggattatgggtacatgccaccatgcccagctaatttttgtagttttagtagagatggggttttgccatgttggccaggctggtctcgaactcctgacctcaagtgatctgctcaccttggcctcccaaagtgctgggattacaggcatgagccaccatgcccaagcaaaatcttataagatttttggttctggaatttcccatttaatattttcagactgtgactgtggggaactggaagcatagaaagtggaaccatggttaaatggggagctactgtattctcaagtgggtcgctgtgctttcctgtcactcctgctcactattttggggttctcctgatctcagatccttcagacattcctctgttgcatctttcttctaccctgtgccctgctctgttactgtgaagatcttgtgcctattcctggtttctccccattctgtttgtattttaaagtttgtggggatatcatgtcatctaattttgtttttgttttttgggggtttgttttctagttccatctggttttatgtggagatttggagatagtgaaaactatgctgccactgccaccatatttccagaatacctcctgatgttcctatttaacatattgaaaatatacaggcatgtagatatctgtaaatttcttatgctagagaatggaaaggaagacgtattaaccactactgctgcttctgggtgagaattcagaaacatccccacaattctggttgaagtctccttcattgaggcacattactgttttatttttggttttgttttagtactctgtttcttttggagtttgattttactgtttagaaacatgactgtcactccagagcctgggttgtgtactcttgctgtctcatagaattctaggatcatgccatgttcctcgaagccaggcattgaaatcttcagatacctctagttaccatgcataatagtatctgggttcactctagctttgttttcttatgatgcctgttctatttacaataggagcctgggctttatatcacccaaacatcttattatgccctttgtgctgatactgtgaacaaaatgtaagagatagctctttccctgaggattttgttcatcttgtctgtcttttggattgatatagtaacttagggaacacatttcctgtcaactcttttcccttttcactgtgacccaactctaaattatttaagcttatcttataggcgatactgatggaaatgtgccaaggagagataagtcaatctttgagggtttgctgcatgcgcgcatgagaacaggtagggtaagtgtgtctgagacagagaagagaccatggaaaatggttctgtgacaagagagagcttggtgaacacagagagctgaaataaggccagagtgtgatgggaagagtacaaaggccaatgtttccggagatgagactggagagggagggaggaaaggaaggatcacaacttggaggccttcacaggccatgtttaggaattggtctaacacaacagtgttatatatttaaattccaaagagatatttgctatgatctgctgttattgttctttttattcctcagcagtctttcctacactaaatatgtttatatactttaatatttattcgttagttcttttcctcaatctctattattgcttttctctggatgctaattcctcaatccttcaatttaggaataaagctgagaagatagcttttttttttttttcaaataattttactgtttgaagtagaatttgctcttacgtaactttaggtaagataagtgaaaaacgattgccaaaatgttacctactgtgacacttacgaatattttatgcttcttagcctttgtaaagtgtcaaaattctgtcatttgttatttgtctgacttaaactacagccaaaatcgttagagattttggtgtcccatgttgataggaagctcagagtggtttcatatattttcagctgacccagaaccaacttttggaaatttgagacctgaggccaactctgtgtggaaaaagtaggaagggcttgaaaggtggttgttatgtgcatgcgtcttgtgtgtatgtctgtgtgcatgcacctattttactgatctaaaattagttgatgaagaactaatgtggaacctgtgaaactcacagagattaagggccacaattcttcttgttattctaaagtaaggaaataaccgtattaggccattatgtaaataaaattgtcctgagctttacttataatctagtagccttggaatgccctggggctcacatcagctctctccatcagggtttcctctttgggcactaactctttgtgctccacatctttcctctctgtcctctagcatatctgctgtgcataaaggtgcttgtcctgggtccctaccaggatgaaagtttagtgatactagcaaaggtttttttgtaaccataactcttacatttcatatattaataactttacatttcatgcaatatacatcttcacaggatccttctaaacatgattgtacaactaaaaagtgcttttaaaggaggggattgtctctcgccagctatatagtgagtggaatcttggatgctgagcttgggcccatgggggccttgatctcccagcatgtcattattgcagagatagcctacttcacaagcagcacgagcctgatggcagctgagaaatcaggtcaagttttttgacctttatgtgatgttcaaaattcagtttcatttccccatgaaaagcaattcttttagtccacataattatctataacatatttctttcaagcaattttggctgaattgataaaataagcaaaaaacccacaaaaaacctttttcttgattgagcgctgtacttcatagtagttaatttgctttctattgagtggagatacttaatatttgaccaagaagttaatataatatttgagcaaagagttaatggtttagaatattttgtttatgattgtgttaatgagcaatagataaactttcttatagcaagtactctagcaaatccattcctcacatagtcctttgtgtgcaggactggtcataacgcctgatatataatatgtaatacttgttaaatgaacaggtaatcattctgaaaaatgttgtgtgttccaggacctgatcttcaggtttgcatatccaaaaagcctacatgttgcaccaggaagatggaggagagatatcagattgcggctcgccaggatatgcagcagtttcttcaaacgtccagctctacattaaagtttctaatatctcgaaatgcggctgcttttcaaggtaagtggatcttgaattctgcaactaaggactggccgtgttatgtaatttgcctaagatagttacgttggcaaacttggctgggtttatttccttgtatttacataatattcgggtataaaatgaggttttaactttttctagccttcaaaacttgtttctgaggtcattgtgggagtatatactgagttggattggggaaactgagttggactgttatgttagtgaaatgatcgttggaaatatatactgctatagggttcttccaggtctgccaacattctgactcatagctgtactttaatatgaacagacataattattagatttcatggaaaagttctataacataaaatctcattgctttttactgggtaattatagatttatctactaaaaattttttttggatgtctcataattttattttatataaaattttactttaaattctgagatacatgtgcagaacatgcaggtttgttacataggtatacatgtgccatggtggtttgctgcacccatcagcccgtcatctaggttttgagccctgcatgcattaggtatttgtcctaatgctctccctccccttgcgtcccgaccccgcaacaggcccctgttatttgaagaaatactctttaaatttccttgctctaatctcatatggttttcataagaacaccagtggaatatatcaaagtgcaagcaagtctgataaatagtaaaacaggaaatgttaattggatgtttaagggtcatttaagaccagaactcaaccttaattcaagcaatatgttcagatataaaattaataggttataaaattacaaggcacactgaaaaatacatgatgtttttcttattttagtcatctcttctgtaaaattccttattactacaataaaatagcttaatttatttttcttcttataaagcattagctattctgtatatgactagaatgaaaatatctagattatacagcttttcaaattattacctttggtcaatgcagaatataacttctgttagtattccttttaaataagtacattaatgtcaatctatttgaataatttgcttggtgtacatatataagtaaatcacagagctctttaatttttaaaatgatagttattaaataaaataaatgcaataaatcagaataaaatttaagttaaagtgtagttcatgatgaattaatgcttttttgtagaaagcgtgaaatgtcagattttaaggttttataaatttagctgcttttttagatgccttacaaaacaactttatttctattgtaggatttattcatgtgaaattgttggaggaaaatttactgatatacattttaaaccaagatttgtgatttagctgagttagaagccgttaaccatctacagaaaattatattttcttccaatgaaaaggatagtaggtacaatatgaaatatacattttggaggccacgcagtggatatatcagtctgagcagaatggagtttgtgataggtggtcatatgcttaaaaaggtggactggattcatattgaatcttggatatgtgatcaagatagagcacattacgttcaaagggttaggaaacctggaatatttagacttttaagatggattgaggctggtgaaaagttttggtgatactgctaaaagtttagtgataaccatctcagtagtagaaatatatgttaaggagatcgtctctattgaagtgtcagctaattttatgtaaacctttgttttctgtttactaaattttatctgctttattcattaggttgagttttgctatttaaaaattaattataaaaaatatagagacattcttaaatatgattttttaataataaattataatttcttccttagtagatgtcaagttttatttaagaagctcaagggaagacaaatttaaaagaaatttgcctaaaggctaacttttctggaaccaaattcacttataagaatacccacttttattgaattgaataagtagctttaggcttatttccttaaaaacaagcttaaatatatatgccaaaagcagtacaagagatcactttgctgtaccataagtgagcaggctaccttatcattaagtaaaatgccctccatctaatttctgtgcaattaaaatatctgaaaacaatataaagtctttataagaaggaagcagccaacacattttttttgggaaacgtctacttgagagaaatttgatagagaaatcaattaacttctcaaatgatgttaagtagatgtgctacattttgattttttagttttcaaatagttcatttatatttcctagttcaacaatattaatctgttttccgagttatattgtaggttataaaagacattggactgggatgtagtatggtctctttcctcatggaccttatgtgaccccacggaaacatattttttagagcaaacttttgaatacagccagtgaggatgatcacttgggtctggggatttagcagagggcacactattgttagatgaaggctgggaggttaaaaatgcatgagggagagaggaagccatgctgacagctgttgttagaagagacctaagattatcctatgtgaaactcacactgggctctgtagtccactgcctatgtatattccatttaggctagaattagcctctaggacaactcttctgtttgtttgtttttttttttccccgaggtggagtcttgttctgtcacccaggctagagtgcggtggcatgatctttgctcactgcaacctctgcctcccaggttgaagtgattctcttgcctcagcctcccgagcagctgggattacagatgtgtgccaccatgcccagctaatttttgtatttttagtagagacggggtttcaacatgttgaccaggctggtcttgaacttctgacctcatgatctacccacctcgccctcccaaagtgctggtattacaggtgtgagccaccatgcccagcccacattttcttaaaatgaacaaaacagacaaaaatctgcttttatttattatttattttcattttttctattatttttaatttatgagacagggtctcactctgttgcccagtccaaagtgcaatggtgtgatcacatggctcactgcagcctcaacttgccaggctaaagtgtttctcctactacagcctcccgagtagctaggactacaggctcatgacaccttgcctggctaatttttgatattttatagagatagggttttgccctgttgccccatctggtcttgaactcctgagctcaactcatccacctactttggtcttccgaagtgctgggattataggcataagccaccatgcctggccaaaaatctgtttttagaaggactcatgattatgacctgggacttcactatattctaagggcaatcatccatgaagtattttatagggcagaaaaagaaaactgctacccttatgtcagttgctgttcataaataagtagtgctgtttgcaaggaggaatgttggctttgtcacagtgcaaacaataactgttcttcattttcaggggcttagtaatgttcatgaataaagcagaacagcccaggataatacaagagtttgtttcccattggtggttttgctataagattttctgctttaaaaatattttggaaatatttgttataaatattttgtttctttatacatgacagtatggtgtgatgcatggagaaataggggaaattgatggagagtcatcttctgtaaaaaacaactcttatccagcttatatatttttcaatttttaaatctctgtttaaataaaataatgaaatttagttttttaatttgtaactatgcaaaaatttcaacatgactttcaaaaaataaaaaataatattttagaggacactattggaagcttgtgttttgtgttaatatttggaagataaggttaaaatgttatatctttccttagaaatgaaccttttcttatttctttcaacttcattatgctcatatatttctaaaatatatggtggatactaagtctttattctggaaaatttccagttatatatataactggaaatgcattattctaaaaaaatgttattgctagagtctaagtgacatttagaacaaaaattatttaacttttttttgatttcatctcttggctaattatattttgattccttgattatatgtttttgaaagattggcaagcctgtcctctggggttgaaatgttagattcaggaatttattaaaaaatgattgctatttttaatgaaatgtaggaatatgcttgaaattaaatatatttaaaaagcaggtgaattgagaatatgaatataacttacggatttttatcctttatgctaacagatactggttactgtaaagtgtatagctatcgtatagctgctactgtaaaactaaagtatatatgtatatatatagcaaaagacacaggatatagttaatattcaaatatattaatgaatatgaagacaaatagatttatataaatgttacaatatcaagcatagagcacattaatcttatttaagtcacttcagctatactttacagaaatggactatatttaaaatttttcctaggaagaataaaggcgtattgctatttttaacattaagaattacttgatcaagattaagagaacaggcagcctaggctggtagtgttggggagacttatttctatgtgtagcactgagagcagatatacagcaaatgtaagtaaattaactatatgaataaaggaatgaatgaatgaatggtacttagcaagaaaatggttcagaaataaaatgagagattcatttcctctctcctccctccctcctccttcttcctttcttttattcctctgttgatgcatttaatatatcttttgagcacctactgggtgccagcatcattaggtacttagattgtacacagtgtcaaaatgttaaatccattatacttttactggatcattcagactcctaatatgccgacatatttattagtttattaatttctaaactataaaggggcacatgatagtgtttatgtcagtggcatgctgaatgggattgcattcttttccttgttcagttttaggcagtgcatggtttagtgtgttatctaatacagcagctatcagtgcaattggtctttattcaactgtcctttatctctgcaatgttaaaaattgtttcttttgaatcggcgtcaacaggcttatattaattatgagaaaccaagcaattttcctgttctagataaaagttgcaagagcttaaattacttttcagctggaaataaagcttgcttcatatgaaataatatcaatagtagaaaaatattaactatagatctaagatcaggtttacttttccaagtttcttttttaaactctaagaagtaaacttttagttgttttaattctgacagatgatagttatgataatatcacctatggctatggtaatctcatcttgcaagcacagtaatttgcttatagctggtgaaacagttcttgattttatattaaatacactttcagttaaatcttttcaatgtaagaactgtacatctattggctagatgaattgacatttaatcagatatttatcattttgctatttgtttttaatttttgaaactcagagcagatactcagcaaatataattaaatgaactgcatgaataaatgaatgatacttagcaagaagacttgtgaaataaaacaagagattctctctctccttccctcctttcttcttccctaacagtagctagtatctgttagcataaaggaagaaaatacataaattatatttatattctcattctagattcacctgctttttaaaataagatattcaatttctcaaacccctgggctcaaactctgttgctcaaataatcctccaacctcagcctcctgagctgggactacagccatgcttatattcatttaatcttatgcagagggaatcatagaaatgactcttgaacgctacttatgtgttgagtaaaggacaggacatttgggagattacaactagttatgtttttgagattaatctgtgtgtctatctatccatcccttttatccatttaatttgatttataaaattcatttttataaatatgtgacgtttattcattcttctgttgatggatattttaataatttgtaacctatttttgcacttaaaatgttgcagtgaacattcttgatatctccgtgagtgcttgtttctccagggttcacacatagaagcacaattgtggtttataggctatgcacttgtttactttactagatatttactaaaattgctcttctaagtagcaaaaccaattgaaactcactctagtggtttgtgtgcattgtcatattttcacatttttcctaacacttaagtattgtcagaattttaaaagttttactgaactgataatgatgttgtatcttgttttctaaatgtgtggtcctctctgattattagggtgtctgcatatcacttcacatgcagttctttattttgtattttatttattttcccttatgaataaatcataccaacatgtgtacacacttagaggatgtataccatgttgtattttgtatgtatttaaaatttctgtcctaggtacagatatcacattggatttctacatcttaaagttttaactaaagtaattggaatttctttttatgtgctatagaaatccaagctccccacgaagtttctgcacatcccaaggcttgcagtcacatagtcactcctacctctgctcccttgcttttaaaaaatttgctgttgtctgcctctttcctgtcatattagctgtatatgatttttttctcaatttccagttcccaaaacacacacacattatatacatgcaacccactcatgatgtatgtgtaaaataacttttatgaaatgatgattatagaggaagacaaagtctaaagaccacatactttcaataatttcaaattgaatgttgatttctatttttgcaagtctttttcagccctccaacatcaatccatgaagccgccattctcagctcattctctctggcccagagatctcccattcttgtgtgatactctcctctcctccccagatagtgagataatgtatcttccagtctcttacatttattatataagcagagaaatattaaatacccaccgcagggctctgaggatgaatgtaaactgaatgctttttgatcagcctgttgtctgttagatattttgggagtaacaatttttccaaaccaaacatacaaagtatggtgatcctgtataaggtatagacaaagtgtataatctttttttttagtattagttaaattgagttcattttatatttccaaatgttaacttttttttttctttttgcaaaatgttaacttttgcaatccatggaaagaaataaacaattattagcttcttttaaaagagaaccaatttatcttaggaatgtttgcttttaaaagcaataataatctgcaaagttaataatttttttaagatccaaaatatattgtatttaaatgattttttatttcttatactaaatattttaggaaaaagtaaaatcagcttaattaaaatagcatttttctaattaatgtgtgaaaatatatatcaagggaaaattgtaatgtaagcattgtgtggtatgacactcattttgtaattcaatatttatgaattctttaaaaaaatttttaccccgtggaacaaacttaaaaattatattgataatgatatataaaacttgcatgctgtaaaaagtaaaattcacgtgggtgttttgttttgttttctagtttagccctgtgcacttagcatatgaatatgggatttttttttttttttgccaatggtatcaactaacatattttgcaaacacgtgtcatggaattattatttctatgcagtaaaatgttttaatattgaaagtagggtatttccctatttataagaggctggtggaaagacaaagactgagggagcatttgaatacatttaagtctattttatgtgaagaacaaagttacagtaaaattgcgtaataatttgatcacaaattattactatcctattactattataaattctattaacaaattttgttaaaatgtatcttgatgtattacattacttgccagcttttttgatagggcttttttcatagctatttttgtatcaaaatatttagtttttggaagcatggcttaccctgttaaatatccaatgtaactaattagtttaaaaaataacattttcagtattttgaggtcttatggtttgttttttcaagaccctacaaaattttatctatgatggttagtgaccacattaattagttttacagtaaagataaaataatgatactataaaaaatatctaagacgttattttaaaactcaataatgtatctatttttaccttttactttatcatgagatgttaatttgcatttgtcatggttattatgtggcatatagcacatgacagcatcttgttcttccttctgcctgttgtcagaacactcaatttttggggtgaccacactcaatagccatgtgcatagggacaatgcaccctgccgcagcacaggggatgacatgaaatggaagtgcgtatgtagtttgaaatagtttttgtgggaaatagaaaaggtaattaaccaaaaaccaggtagaaggttaacattggagacatgtaattaatagtaaaacttgtatctatgatggtgtgactgctttcgttttcatcctttcctagtgcctagggagaaagtacaagtagaggagcactgacacgtggttgagcaggtacagtggaaggctgaaggtggtaggaggtccattcatccatccaacaatcatggggcagcctgaatgtgccagcactgtttaaagtgcttggatgcatgggtgaatgaaacaaagatccctgtcttgatagttcccatttcagccaggaaagatagaaaataaacaaacataataacagatacaagttaggatgtattaaatgtttagaaaaatatatagagcagagtgagggggatggaaatactagagggctgcaattttaaattggataatcagggaagaagtggcatttcagcaaaaatttgaagagagtgaaggagttagtcatgtggatacctgggagaaacacattccaggaccaggaaatagctgtaaagtagaggtgggcctcagctgtcagaggaatagcagcaaggaggcagcatgtgtggggcatacggagggtgatcggaaaggatatcaccgaggccaggtcgtctggggcctgttaggcatttattctgaaacaggagtttttatgataggtgtgatttgattgtaaaataatcactgtcttcccacagccaacattatattgaatggggaaaacttgaaaacattccccgccaagagctggaacaagacaaggatgcccactttcaccacttctaatcaatgtagatatacaaatgatgaacaaacatgaaaacatgctcaacatcacgaattatcgggaaatgcaaatcaaaaccacagtgtaataccactttactcctgcaagaatggcgataattaaaaaataaaaaaaaatagatgttggcatggatgcggtgaaaagggggcacttttacactactggtgggaatgtaaactaccctgattacattgatccagcaatcccactactggatatctatccagaggaaaagaagtcattatatgaaaaagacacttgcacacatgtgtttatagcagcacaatttgcaattgcaaaaatatggaagcagcccaaatgtccatcaatcaatgagagggtaaagaaaatgtggtgtatatgcatgtatataccatggaatatgactcatctataaaaaggtacaaaataatggcatttgcaacaacctagatggaattggagaccatttttctaagtaaagtaactcaggaatcaaaaaccaaacatcgtatgttctcactgataagtgggagctaagctatgaggatgcaaagacataagaatgatacaatggactttggggactcgtgaggaagggtgggaggggggtgagggataaaagactacactgggtacagtgcacactgcttgggtgatgggtgcaccaaaatttcagaagtcaccgctaaagaacttatccatgtaaccaaactcctccacctgtaccccaaaaacctattgaaattaaaaaaaagaaaagaaggttggagtgagccatgattgcaccactatactccagcttgggagacagagcaagaccctgtcttaaaaaataataaaatgaaataaaaaataaaataagcactctatctagttgtctaatctatcatagcctacagaaaagaggcaccgtggtgacttgggtgtttgcagtggaggtggcaagatgtggtcagcttctatatctcttatgatccttagtgggccctggacatagtaagaaaagaattgaagcccagggcatcctgataatggtaaaatatatcagggttgcatcagtgatgtaggtgcctggagggtagtggattaaagaagcccaggctgtaggaggggcttccacatggacttgagtctccaagtctgttggtagagttggagtgagacaaactgtgacctgtttctccagagttctcaaagaaaggaggaaattggtggtgtgacagagacatccagtggaggctaagcttatacagggtagaagagtaattaatggtcttggaagagccaggagatttccagtgtccctctaactgtctggctctgtaaagtgatagacatatttctgtaataaaatatatctagatatgaaaatacaattgattttgatataattcacaattctacacaacaaaacatattgccaatatttagcataatttaagagtaaagggcattcaagaaataatgcaaataaataaatcaacctgagttaaatttataacaaactttgaagggggaatatgtataatgcgatagcattgtataaagttatatgatgaaaatcatgagtttgtatatgagaaatttgttttcactttataaaatatacaacatgcttatgtaaaaattgaaaatagaattatttattagtcaataacccagttagcaagtaaagttctatggtgaacttaagactcttgggactcaattttgaagtcttagtggtaattctcataataggaacacatttgctcttcttatatgaatcaaattcttttaaccaaacaatattaatagttatcaatcatttaaataatatctctttgttgtcttttttttttttggtggggggacagagtcttacttgttgcccagcctggagtacagtggcgtggtcttagctcactgcaacctccacttcctgggttcaagcaattctcatgcctcagcctcctgagtagctgggattataggtgtatgccaccacacccggctaatttatttttgtgtttttagtagagacagggtttcaccatgttggctaggctggtttcgaactcctggcctcaagtgatccacccacctcagcctcccaaagtgctgggattacaggcatgagccaccatgctgggctgatatatttttattatattatttcttatctaattagaaatatttgcagtttgtgtaagtgacattactgtcaaatttaaaattataaaatggcataataacttattgtaaactatgaaacatagtttattaaaaatgtagaagtgttcttaatatttcagcttttttttttctataggcttgggggaatatcagattaagatgaaaatattacaccatcatccataatattgatttggtaaaaggataagataaaatgaaaaataagatacctttctttcctcagacaaatagaggacttaaattttacaaccatttctcaatgtagctgttcatgctgggaaattacccatgcatatctttatgcttttatcataaaatatatgtagcaataaatgtggtatagatgctatagcttttatgcagaaggcaaagggcttgaaatggcatctcaagacccagagagtgagaacagtaaataaagggtaattgttggatagctgtgctgagctcatttttttccagggtaatgctgcctatgggctaacttttgtataaacaaagataatcgaacttttgcaccttaaaggatattgttttcttgtactctttatttgacttcattccctcagggcatagacttaacttgaatgttaacttaggaaacatattcaatattattttccttaagtagaaataaattgaagatgctttgtagtagaacaaacattggtctttggtgtgggaaactgattttgtgataggatagggaatatgcctaaggatttaagaacaagggtctagagttaaagggtctgggtttggatctggtctcaagacttgccatctgggcctcagttttccttgcttgtataatgggataacaatagtaacttcttctagctggacctcaatatccttgcttgtagaatggaacgataatagtaccttcttctaggctacaattaatgaggattaattgaggtagtccctgtaaagtacttggtttggtgcctcgtacataatgaacactcaacatatattagctattatttatttatttatggaggatattttttcctcaatatttgataggcagtaaaacatttcatggcagaagttgtctgatagcttttctttaagcgtgttatggcaaatggtatgaagccaattgtcacattataagaagtgctgcagggcccaggcagaagaagggtgttggtggtccaaactcctagatcccttcttggattactgtgcctgatggggctgccaagagtcacattgtgagtgcttaggattatgggcaaaaataccctctaaattcgcaaagaccagccattgagaacaattatttgatgaacaataataattggtgcatttttaaagcagacttttctgctgcccactggtaataaaatgaaatttcagattgtattaagtggtattaaattgctatgttttgactctcactgtaatggaaaccaacgtgaatactaaaatctaaggtttaactaacagactcatgcagaggtacagagtccatgagaaattattcaatgactggcttaacaaacgccgtggtcttattagtgtccttctccaaatgagaatatatagaagaggctttaaagttttgacgtcacttattcattctgatcacatttgggggtgtttgtagtttatgttggtatatgtcttcctaaagctaagctttttgattatgctttgtgagttattagatagtatcattaacttcaaattagtccttttcaaaacagcacagaataaatacatgcagagccctcagaataatgtgagaggttttgtgcatgatagaatacggcataaaatttaagatgtcactgaattactgtgaagggcaatttttattttggtttaaatgttgctagtcatagtttcataaaattatctattggataactacatttcctacccgctgaaaatgtgaaatatcgttgcgtatctgtaagacattgtagagggtttcctctttacataaggaaagctagtgtagaaggaggtgggcccttaaagtctctggaaagtataatttgggaatcctcttctcaaatcatacttaggacgggtgggtcaaaagtgtccattggttcaagaaggaatgataaatgctgtgttcacattctgatttctgatgtgcttacatactagctatagtcccagggcaatgctttaggatgatctaggccaactgctttatttttattataaaccttcaaagtagacttaaattatctatgtatctggcaacttctactcaatatatttagtatattttaatgaaattatatattttgaatgcagattatattaaagaatatatttaatgattggtaccactgttctagaaagcaatttgacagcactaggttaaatatgtattttctactggttatatacagtcacctttgatatctggcagtggggggatttgttccaggacccccttgaatacccaaatccacagaagctcaggccccccatataaaatggcatagtatttgcatataacctactcaaatcctcccgtatactttaaatcatctctagattacttaaaatacttaatgcaacacctctacatcacttcatttgcatggtttcaacatagtatttggtgtgtggcaaattcaagttttgctttctggagctttgtggaattctttttttctgaatattttcagtacatggttggttgaatccatgggtgcacaacccatagatacaaaaagccaactgtatattggaaaatttttaaggagactataaagatacacgtccaagcatgttaattgtagtgtttgttcaagtcaagctttttctaaaatttatgtggaaaggcagaggacctagaatagctgaaacaattttgaaaaagaagtgggaagaatcactttacctaataataaggctatacagctatagtaattaaacatgtggtattgacgaagggatagacacgtagaacagattagagaacccacaacagacctacacaaatatgcctgattttgacataggtacaaaggctattcaatggagaaagaatatccttttcaacaaactgtgttgagaaattgaatattcataggggaaacctaaactttgtacattatacaaaaatgaacccaaaatagatcatatagtttatgtaaaactgtgaaacttttagaaaagaaaattgaagaatcttagggacctaggtctagaagaacagttcttagattagacaacaagaacacccatgtttcataaaagggaaaattgggccttgtgaaaattacaaaccatgttcagagaaaggttaagagaatgaaaacactgtaagcaaataattgcaaactgcatatgtgatgaagtacttgtatctagaatatattaaaaattcaacagttaaaaaaacccagtttaagtagaaaatgaacaaaatatatgaatagacattttacagaaggggtatgcagatgacaactaagtacatgaaaagatatgcaacatctagctttcctggaaatataattcaaagctataatgagatatcactacaccctatcaagtatggtgaaaatgaaaatagtaataacaccaattgttgacaaggatgtagagaaactggatcactgaggcactgttcatggtaatataaaatggcacagtctggaaaacagttggcagtttctattaaaattaaacctgcacttattgtattgtccaataaatgcacgcttggacatttattcagagaaatgaagtattatgttcatgcatagaactatacacgaatgttcatagcagctttatttgtagtagccccaaacaggaaattaatgtgcttcaacaggtgaatggataaacaaattgtgttatgtccatatcgtggaatatgactcagcaataaaaaggaatgaactattgatacatgcaaacaattggatggactttaatggaattatgctgattaaaaatataacattcttgaaataacaaaataacagagatggagaaagataagttgtggttccctggggttagggacgggaagagggaaaggtggacgtgtctataaagggatagtatgagggagctttgtggcaatggaacagttctgtgtcttgatagtggtgatggttacatgaagctacatgtcataaaattgcatagcactacacacacacaacacacacacacaaatgcatacaaaatctgagtaagctctgtagattctaccaatgtcagtttcctggttttgatactgtactatagttatacaagatgcttcccctgggggaggctgagtaaagggtgcaagggacttctctgtacatttttttttctttgcagcatcatctgaatctatatcgtttcaaaacaaaaagaaatataagctgaataattgctcttgggacatattcacttaccttaatcaatttttaaactagacctgtctcagctctcaagttactggtatttttcttaacaatatattttttcaacagtcttactttttaaattgtctataatcttcttgctttcttgatctcattcacactcacttgctcttcatctttaatgtcatatttattgtaggggcaattaacatacagtaaaatgcatactttttaggtgggccttctgtgaattttgacaaatgttatttagtcatgcaatgaccaccacaattagagaatattttcctcaccccgaatagttaccctagatctttgtctctttaattttgccttttccagaatgttatgtaaatggaatcatacatcatgtagccttctgtgtctggcttcttccacttaagtactacagtttttttttcatctaatcgcaaattggaggtgctgcatttttcttgtgttgtgttgttgtgaatacatttgaaattgttgacaccttcagttgacatttctctgtagactataatatagtttgaaaaagattttctttgtaactcttgtattttgtaagctctgggctaattccatttaattggtggttttaaaagtctaatacttttgtattgaaatgtcaaaatatttcaccccaattttcacaagtagtatcttttctgcctttcttcagagtacttatctttaactttttttcctcaaagggaaaacttattaaataagttatctctgtgattcttttgaatattttacccaatttaaatgctgcaaatcattgatcttctcaattccagtccattctagtagaaagcataaatttatttaaataaaaataacagcttcatctaaagattcttcccacaagttgaattaatccaaatcaaacttaaattatgaacactgagatctcactatttaatttactcagctcctctattgcttttagtagggactgaactgtgatgggtcccccaccaggttacttaagggtgtatgtccactgcctgaaccctgaaggccaggccacgagccaaggccatggtgcccagtcaaggagcagatgtccctgagaactcaaacatcccatagagtacctgagaacctaccaagggaaacagttccatcacacacacacagcaggcaaagagccagaaaattagcgtaaaagtgcttaggaataggaggtgatgtgggtctctacagcttccctgctgccacccaggagtgcgctgtatgtaagtcctattaaactcatctactctccaagggggacttgtccaagtcattctttggcctctcagcaccttcctagttagggggcagggggacgttatggtcccaagttttttttgtgacaggaacaaactttacgtttttatttttgtttcaactgctgttctcaagaattgaaagagtatatgttaaaagttttaaaactgaggtttaattggtgctgttttattaaatattttgacttaggattccaggtcatttcttctagctgaccaggaatgatcagggtggtgagttaatatattttaatagtctgggtgagagaaaagacaaggaagtgagttttggtagtgatgatagagagcagaggagaaagattctaagtatattgagaaggaaaatttcagaggactaggtaactggtgatggagtgggactggggagagggaggaacctaggatcaacatgagtcttgcaagagagtactttcagggactgatttacaatgtcctcattttccttctatcttagttttaacgaagttcttttgaaaattctattcaactctaagactgtgggtatactactatggagagcacacacattccttcatcagtgtttatttagtatatattgaatgctgggcactgtaccattttcaggcagtccccgctttgcacaattttgggttaattgaaatgcatccaaatctgaaccgggtccttgctttacacgcctgcattgatcttagttaccagacaactgtgcagtatgaggactgccagtatttcatctagagctaggactggaaattatgactgcttttaagaagtttaaaatctattgtggaaaatagacaaatgcttacaattcaatgtgctttgctatgatggagttaagatgtcacagagaagacatctgatttgaattattggggaagaaagttggaaaaaagtcctgaaaacggtgacattaggtgaaaaacaatagtcaggtgatccctgtcaccacagagggagaaagggtctggagagctaagtgatccacgattcctccaccaaggccacagccaagtgtggggtgaggatggttgggaagttagcttggagacatgcaattccttgcgattaatttaatttcctgagaatctgtgctcatatcctttctcattcctcattttgctttcttttctcattcttatgctttccttcccttcttatgctctcagttctctgcccctttctcttttctctgctttcctctcactgtcttaatttgggtttttgtctatgttgatgctgtttttccaagaacattagttcagatttagttatcctttatccttttgtttttagtaacatctgtttaaattttcaaaacattaaaaccatttttaaaaaacaatgctacatttaaaaattttatttcacttttctgatttattaagaggaattaatttttgaccttttaagttgtcttcttggcaatgaaagtgttttagggaataatttttcctttgattatagcttcactgtattgcatatgttttattatgaagtgttattttcattttgttttagtttgcaattttactttgcttttattctttgagattatctagacaggttttggtcaggattggccaggtttactgcagttatgttgaccccagaatatcgctggctcacatccatggagaagattaagttctttatgcataggtggtatcgcttcctgcccaggctgaaggagcagccctatctgagatgtttggctttagtgaaagagagaaagtcagcaggaaagatggtcctggtcccagtgcctctgcttggcagctgtgcatgttgcttccacttacacttcctctgccaatgcaagttctgtggccatgcctcatattgagatatggtgctctctaatattcacagcggaacatagatgttctccctgtagaagtattcaagagcaccatgtctcagtatggtaccctaaagaatgttggtatgggttgaattttgtgtccccaccctgccaaagatatgctggactcttcacctccagtacttcataatgtaaccttatttggcaataaggtctttgcagaggtaatcaagttaaaatgaggtcattagagtgggcccactccaatgtgattggtggccttatataaaagaggaatttgaacgtagagaaatatgtacagaggaaagatgatatgaggacagaggaatgccatcttcaagtcaggggttgcctgaggttaccggaagtgaggtgagtcacctggaacagttctccttcacagccttcagaagaaactaactctgcttacagcttgatcttagacctctggcctccagaactgtgaatccataaatttctcttgtttaagccccttaggttgtagggctttgtaacagcagccccaggaaaccaatacaaatgtgtttaaaattatatgcttggtctgattagttttatgtatttataattttgttatattttttattagaaaatttagccaataaaatctttactattcaatatttaagttttcttcgtagctaagataatggtctttttttttttttttttaaatgagacagggtttcattctgttactcaggctggattacagtgatgagatcacagctcactgtagccttgacctccaggactcaagccatcctcccacctcagcctcctgagtagctgagactacaggcatgcaccaccatgcctggccaattttctttgtctcgtcttgtctcttgtctcttctctcttttctttttattctcttctctctcttccttttctttctttttttgagacatagtcttgctgtgttgcccaggctggagtgcagtggcatgatctcggctcactgcaatctctgcctcccgcattcaagtgattctcatgcctcagcctcctgagtagccgggattacagacatgcaccaccatgtccagctcatttttgtatttttggtagagatggggttttattgttttggctgggctagtgtcgaacttctggcctcaagtgatccacatgctttggccttccaaagtgttgagattacaggcgtgagtcgctgcacctggcctaattttctttttaatttttttctctttttttttgggtaaagacagagtcttcctatgatattgcccaggctggtcttgaactcttgagcaccagggattctcccacctcagcctcctaagtgctagtcttacaggtgtgagccactatgcctggtcaatcatataagtttcaaaaatttgtttaaaatgggaaattctctactttaaaaattccactttaatttcaaaggttatatattttttctattcagtaatttaaaaacatactctcttctgatttactgcactcagaattttgtaaacctttgttatataaaaattcagattcatctttttgaaaaaaaatacctggctggatggtggctcatgcctgtaatcccagcactttgggaggccgaggtgggtggatcacgtgatgtcaggtgtttgagaccagcctggccaacatgatgaaaccacgtctctactaaaaatacaaaaattagctgggcagggtggcgtgtgcctgtaattccagcttctcaggaggctgaggcacgagaatcacttgaaactggaggcagaggttgcagtgagctgagatcacgctattgcactccagcctgggtgacagagtgagatcctgtctcaaaacaacaataacaacaacaaaccctccccactcccaccacaggttttgaagtatgcctttgtgtgagttttgtcacttgttgtattaagttgcagcagccagaacaattaaaagcatagtagcttggttatgtcatgtcttcttttcctcctcatttcttattttgttaaacattttcctttgtatttcttatcctataagtgaagcagcacagagattttcttccttcagacagctctctacaaggcctgtctgtgaaatttctccatctctgtcaaacgtcctttcaaaggttagaaaaaagtgctcataaccactgagattttccttttcttacaaatggggattagactgatatcagtatcacagttcagctgggaaaggtgatgggtaaaaaaaattggaagtgggaagcgagatggaaagtgtagattacatgctgatttcttttcagtgaaaatttttatggcatcggagcgcatattggatttaggtgtatgatttgtgacccattgaagtcatctgcattattctgaatcatgcaaatattttgtgatgtgattttgaatcaggtaagagagtagttctagcttatgtgtgtttttccctttttatctcaggcaccataaccttgatactattttaacttacctgtttatacatgtaaaagtgtctgaagtaattaatataaccaattttgtgtctttaagattagctgcttgcaaacagcaagcaagcctctgtaagaaactggagcgagtctttccagttggactatattagaattccatctacattttaatttggttcctgctgtgtggatatattagactgaatctattacctggctcaatggtcctttcagacaatttccctttctcattctgattttattgtaagtgatcatcaacatactgttgaagtctgacaatccaattttgatcacttccatgaagtgctgattacgaagaccttatgttaaaaaaaacaaacaaccccccaaacaagaaccgatggagtattgtgatatttaatagactatcttttggttaaaggtgccggttatggagtgttgtgtaagactccattcttggacacttctgtactgattcttcctttgggtgttgtgcagaagaaaattctgtaacagtcacccccttggggcaggacctgcttttacataaaacattcctgctgtatgtttaatgccactttgagttgcctcttttcctggtgatcatgaaccacctgctgttttttttttcatttggagataatgtttctctgagaatttactataatttcagctttaaatatagtcctttcatgcatttaatacatttaatccttactatgaaacagattaatggacctttggtataaagcttaggaacattgatttagttcactctggtttatttaacggtgttgcgattgtactgggatatactttttcaggacatgtctagaagttagagaggtgctgtcagatggtaatagcatggtatttcattttctcatgctgcccaacagtttgatgaagagcaccattagaaagaaataaatactagttattcattctatttgaagcttgatgttctcttcctcatcttcaaaactgtctcaacaccactttgtggctagtaccttgttttgactctttatcctgactcggagatcatttcttcctaggtctcttcctcttttctcttcctatttttgtttctttggatatttcattcttaatatagaatttactctttcctccctgttcctcttgacccttttgttaccgagcagcctcttgattgaactaaaaagtctagatagatttagttctctgctgatcccaagtaacctaacagattaggattttagattatgtcgttcatatgccattctccaatttgaaattctttggtgctttgcattttcttgctgcttaaaatgctatctaatattcatagctttaaatgtcctctataatctctattatatctattcaaaattagttcctgctcatttcactcattttccttctgcaataggtcttgtttccagaattctctgttcaatcaattgtgttactttctggagaataaaaaagttacatcttatatttgtaaccatgtgtatatcactttccttaggacaatgtataatctatggtagatgttcagttaatgtgatttttgtttttagtttttcagtgtcaattacggtcttctttagatggatgggataaagattgatcttttattctctgttttagactttaagggcatgatctctggagtcctatcacctgggtttatctctaactcttgttttgctactttagacagtttacctaatgtctctgtaccttagtttcctcatctgtagaatggagacaatggctatactgaccttaagagagatatgagaactgagtaagagaatccatatcaagaagattttgtgtatgtaacatatatttctagattaatattgctaagaatatttccatgaactaaacaaactaggaagaaaaattttatttgggaacccaattttttattttattcctagtcattgccaatacatatgttatttttatagtaagactgtttgtaaatatgtaaatatgtttgtattattaaatcagcatctgaaaatattattgaaaatgctgaggatagttttactgctttgtaacagaactgaaacagttttctgaaggctgaatttgtgccttcgtacttgatcccatcaaaatgaagagctgggagagtaaaggatataatttcactgttgaattcaaccgagtgaacttgttatcatttttttctggacctgagattctgctaggtgctgaaaattcagggaatacagagatgtaggtctgaattagtccattttcacactgctatacacatactactcaagactgggtaatttataaaggaaagaggtttaattgactcacagttccatatggctggggaggcctcaggaaacttacgatcatgacagaaggggaagcaggcatgtcttgcatggtggaaggtgagagtgtgagcatgtgaaggaggaactgttaaacacttataaaacaatcaaatctcatgagaactcactcagtgtcacaagaacaacatgaggaaaccacccccatgatcctatcacatccctcccttgacacgtggggattatagatctctcctataatcctgtaaggattacagttcgagatgagatttgggtggggacacagccaaaccatatcaaggccctgttcccatctaataaggaagctaatgaataattacagtagacaggagtcaacacagcaatagaagtatagttcaatcaatggaatgattacctaattaggaggagaaatataacatggttggttatagaatgcttcctatgaggggtacagtacagggttcccttttaaaaagtaattgcaattttgtttgtatgtttaatttccatatatctgactgctgtaaaattgttgtaccaaatcttcttagttatgacacagtcatataccttactgtaagcttcagttttatctccttctcaggtgatatttagagtttagcatccatcaacacagcttcaaaacagagtaccactgccaagaaaagaagcttaaacaggcagttcaccattttatttatactctaagaatagtaagaaacctgtttatgacagccatttctctcctttcaagctaagatgcctcatcttttagcagtgttagttgggcaaggatagtatggaaaaatagtgtttttcttcctcaagcactctaagctatcaattttatagagtctgtataattctcaacaagaatgtagtttgaagcaagctgttatgattaattattgctcattaactggatcttcactctgcatgaaacaatattgtagtttttattctagaaacattgttgcttatattaaatttgaaatgcatttggggaggttggaagttgaaatgtccagtgtaggttgtgaagacatcaggaatgttgaaagctttgcttatgtagtattgctttgatgccactgtgattattcagtaaaaataaattagattattcaacagaaaaatttatataatgtcatttttgatggagacattttgcatatttgtgctttgtaaatctattttattcttggcaagagtgcttagtcattatgtacatatattatacatattgtttatagaagatcttggaagaatgctataccaaaaatatttgagtccctgaagtgaagttggtttcttgtctttagaggatattagctaaactattaacttggtttatcaatatctgaagaagacctagaatagtagcatgtaattttcctaccatttttcttttacttatgtaagggtaggagtatatgattatatgagctattcttcctttgcagttgaactgaaatctgtcagtttctcaatctctttccacatctacctttgagagtctgatatatatgattacactgatctaaacaatgaaaatcacatgagcaaattttctagtttctgacttacagacaaaatttgtatatacctaattaaattgcccatttatagcagttctaatcttctgtaagtgctacaaaaaaaaccaagacaagaagaatggtttcctagcattggtatattagtggggccagttttcagaggctacctcaaatatagttgatgaaaaacatttttattaaataagaaaatttttgatgacagtaataagaactagggagagtataaaatatgatcgacaaggtattttttcattaataaaacacttacacttattggatatttactatgggtgacactactattaaagtatatagcatttaagtccataaggataatatattaatgctctggttaatgtccttaatttgtaacacataaacaagaagtcaagcatcaaagaaataggatatagaataaaagggttgtaatataaagaacgttactataacttaaaaatattctgagtagactcactttattgtttccctccagagaaattaatcttaaatgtatatctttttttccctaattatgaggtggcaaaagcacatgccagctgttgctttgttttttattctatccttctcctgtgctttttctgaatactttttgaattaatagccaaattttggtcactttttggacccatcttccattggaaataaaaacccttatacttaaatatatacacttgaacacaaagtgaagaaaaaaagcacttagtaggcaatgccgatgctgttattgtgcattcctctatgagagatttgattctggtcagaaagatgtcttggggttaagttttcttagctttcttagtgtggaaaaaattgtgtaaaaatagtggtcaaaaagcatatggtttattggtcaattatcactgcataacaaccacaaaatctcagaggcatatggctgaaagcatttatttcttgttcatgcgtctgcacatccattaaggtttggctgatcgaggcttggttcatcttggcttggctctgacctctgagtccaagcagacacaactgctccagggcctggctggtggggatgtgtgtagaactcttcctggtgtatccattttggggcccagatgaaggggaggcagctacttcagaggactcttcttacagttgttggcaggactgtgagagagcaagtggaaagataaagtgcctcttaaagatgaggctcagaattggtacacggtaaattctgtctgtatttgattggtcaaagcacattggtggagaggggcagtgcatatttctcccatggagctagagaatgcagagtcagtgcttgctgaccagtgatctaatctgccacataagaaatgtgatgaaggaaaaacacaatttcaaatcttgtaagaggctggaaataaacgaatctgctattatcaattactgtcatgtaccaagcactaaaaaataggtcatgtgatatgctaaaagcatacctgcattgtttgatggctttttcaacatggcactattgacactgggaccaggtaattatttgttgtgagggactgtcctgtgtatggtaggatgcttcgcagcatcttgacatctacccactagatgccagtagccccttccccgttcccagccatgacagcccaaagtgtctccagacactgctaaatgtccccccagggagcaaaatcaccccaagtttaaaaccccagttgacctatcttgtgctgataatcttcgaaggagggaatcacttcattttaatagtggagaaaatgagactcagaaaggctacttcacccagtgttacattgaagtaaataacaacggatttgagattgaaacccaaatatccttcttacatgtggttcatgtgagaccaaaaaaagaaaaatccacataaataaagtcaaaatcttttatattttgtatatattttgtaatacaaaatacatagattgaaccatattgctaagggctaataaaaagatgccttagaattgagttttcttcaatagtgatgcagaaaaggcagtaacaatttgcagacaataaggtccgtaaaaggtatgctcagggaattatgagaaactggtgagaacagaggaggattactctactcacaccaattgagacagacggttgcagaattaaatgacctactaaagggcaaatggtaattaaccagatgaaggaagacaggatgggcctcactaagcagaggcagcatcatatgtacagtattatctacaaagaactgtaagaagatacaaatagtggaagcaaagaaaatggctgaaagtgaagaaattggctgaaggcagaggcaaagccagcagtgatccataccatgttagggattctagactttaatccagaaagcgatgttggacccccacacagaaattttaaacagagaaattacggagtgttatttaaattttgcaacatcactccatcctcctgtggctgtgctatggaagcaagaaaattatgtgaaaggatatatattcaaatattagaaatatttatctttggatgaagattatggttttaatttttattttgaatatttctgcagtttatatatatatatcttttgtaatatgtaatacatttcataataatatgacattgtagcaatacaggcaagaaattataaggccctggactatagcagtggcaggattgatggagacaaggagggatttatctgacagtgattttaaaggtaaaattttcagggtttggagaaatgttttcagcggtattactggggaaaacagaagagtccaagatgccccttgggtttctggcttgaacaactcatagagaaggggatctaaaaagatgggaaggtagttttggggagaggatacattctgttttgacagtggtatgaatgaaacgcttctggggcatttgcattgaggaagcagccaattgtccattgaaaaaggagtccagtattcaaaataggtttagttggacatacaaattttggaatacccataaaagagagtgaccttttcaggtaaaactgtctaggaagaatgtacatgttgggaaaagggctgcagatggattcctagtggtaaaagtgaggcatacaaggggcctgtagagtgtctaacaaaggcagccagagagccagggcaagagtgaattctcagagggagcgggcaaccatgtgaaatgagaaggagaggcccaatgctatgcggcatagtctttctatttagcatttgagtttttcaatccaggcacaagggagagttataagtcagatagcagtgagctgtggttataaaatagagactgagacaaacagtctttttaagacatttgcttggtttttggaaagtgggaaagtagatggtcattgggtgcacagaaggctttccaagttgtgtttttttcatgtagaacatttttcctgagaaactattcttggaggaaaaaaaaacagattcatatttagatgatgtaattcagtgttcagagaacctttcatatgaaaattgtcgttagttttttttttgttttgcttcactgttaaatttatatgttctttaaaatgcataaaactttaaaaaaaagttaatctttttaccagacacttaaaattactcttttcattaaataagggaatcaatctactaaaatgaaaagaaatgtacacttttgaagagtttgccttttgattggtgtatgcattcataaatttatttcatattttccaaaattacaaatgttatgaaatgtacaaatccctttccatttcactgtcttttttctttgagtttctcatctttaaaattttttaatgtcataaaaatgtaaagagaaataaatgtaatttttgtttattagagcattttatatatgctatttattttgtagtttgttgtagttttagcatccaaaatttattacatttattgtttttacattatttttcacattttatcttgaaatttgcttttaaatattgttactgtaaatgattgaattttgaattttcatacagatatatttttattaaagtatttcccttcattttcttctattctgtttcctaatgtaatcagtgcatatatgatgaaaagagcataacaacataatagaaaatcagctatgaatcaggaggattgggctcagatcatgtttgctcactagcaatgtggctttggtgaagttacttatcctccatttgagtttatatatatatatatatatatatatatacacacacacacatatatatacacattatatatatatacacacacatatatatacacattatatatatatatatatatatgcacatatatatattcttttttttttctttagatgcagtcttgttctgttacccacgttggagtgcagtgcaccatcttggctcactgcaacctccgccttctgggttcaagcgattctcctgtctcagcctccgaagtagctgggactacaggtgcctgccaccacgcctggctaattttttgtattttagtagagatggggtttcaccgtgttgcccagggtggcctcgaactcctgagctcaggcagtctgcctggcttgacctcccaaagtgctgggattacaggcttgagccaccacactcagcctttaattaatatatttcatttataatgaaatttttaggattttagcactattagtaatttacacctaaaaattaaatacattttatcatgtcacaaaagcatctaaaccttcattaaaggagtacatttttcaatgggagaagagatgcatgtttgtggagcataatatatgtcagtagagaccaaattgtacactgtatgcatttatgaggtatgggtgcatttagcatttttggagaataattaggaagatccttggatttctgagagtaagaataaagaaaaacaggatctggtaacaaatactagaaaaacagatggttattaaagcttagaaattccccaagaatatagtctacttaaagttttttttgtgaatagctacatatataatgcttgagtcatgtagttgaaatactgttgcatttttggcttcttggtaggaaattaataagttcccagtgcaagttctagggattaataggagctgtgtataacaaagacattgaattaaatagaatataacttcattttctatattcagcatacctaccaatactaattagtgatatatttatattttctactctattagaatgatgtagaatagacatattgcagaatgaaggcaaatataaaataattattttccgtggcacttaatattctcagtggaggataaaatttaatggtaaaaacttgctaaaattatttgttataaaaaagaaatatatgctttggactatataagtttaccaaattagaaataagtatagtttttatgctctaattactgtttaaatggacactgcacccctactacattatgctatgagactagaatctctgtgcttttgttgggtgtatttatatcagagtgaaagatgttctcattagaaagaatcattggaaatttttgaatacaaaggggaactttatgtagttcagttaggcagactgtatacatttgatttgttttaggctgtaaaatgtatgttgtataaaatataaacacgtcttcatttatgggaccacagatagctccgctatggacagggcatttcttctaaaacagatgattacttttgcagtatgtagagaaatagaagaccaatcaattaattttctaaaattcccctgctatgggtttctttcagtgttaagtccttcaccacatgtacacatgtctctctataaagagcgatgagtggtgagaggtagttgagctgccgttacttgaatgcataggaaaaccactttctataatccactgccaaatccagcgtgactatccattacttactactaaaaggctcttttgtaaaactttctaaataattcactacagcctcagtaaatattgcacatagatttctatcaagacatattgcatacaatttctactaggttctttcttgaaaaggtaagctgaagatgggaaacaggatatttaagaattgagaactagcttggacacaccttatttctaaagagcctgagcccttgatggttatacctatggagcgctgcactagtataaggagggttcacctaggttatacccttattcttttgagttctgagagtattcaggcaaccttatttttccttgttggacaggaccagttactgtaaccaacactgttactctctttcctactagttctttagtagatgagaatccccaaatggtcaggtggcagtccccattgagacagtgatatttctgtgttctatcttggaggtttttttttttcccaaaacttccagataaatagaaccccaagtttcggggttgctgataccagggcaaatgggccgtggtgcatgatggtccatgtttgtgcctaatcagctggcttctttcttcataagctcattatacaaacatctggctctctctgccatgtgaagaacatccttagactacatttgttttttctgcagagaatgtcttgtggtgagcattcacatgagaaatgggacatcgttattttaaagctgtggtccccaaatctctttgtagtatttctaatcttgttcttgctccctccaagaaatattagttcaaattagttcaaacatgaaccattgtgcaggcatcttatataaattctgatttcaacttattgctcttttggggtgaagtggaagatcctgaatgactgctcacattttggtacatagaaaatattttccctctccattttcttcagtatcatccctatgacctgctaaactcttaaagtagaacaattttgtcttgtgccattatattgtacgactgtaaacccaatttacattaggggactttgctaccatgggtttgggttaagggaggctcagaggtatgactagagtcaaattcctggcgatgtgaacaacctcttgcaacttactcatgcctttgtgggctttatcagtcctgaatgcataaattgcttctacttaattatcgaaagctgctgggtaacctgggctctacagctaaagtgatctcatagcacctagtttttggtggcagtctgggttgaatggtcacctaatgtctcatccagcattggaaccaagtagcaaactgaaagatgatacctgtggaaggatgcatgtccttaaccctatatcccaaatgcctgttcttcattcttctgtcagggcttgtcataagcttcatatatcatccaggaatgagtggcagaaccatttgtattggaatctgggtccactagacactctttcgcattacacctgattcaaatttgacagccttttgaaagacatagtaaaaggatactaatagaatatcccatatccaaaagtctatctgtcatggtgcctccttggttacaatgatttattttggagaatgctatggtttgaaggtttttatcccctctgaaactcatgttgaaactttattctcaataaaatagtgttgagaggtggggcctaataagaagtatttaggccatgaggatggtatactgctacaaaaagggcttgtaggagtggatttgctctctctctctcactcgtctgtttatgcgaggaacagtgttcttcctcttgggagaatgtagtgttcaaggtaccatcttggaatcagagactcagccctttccgggcaccaacctaccagtgccttgatcatggacttcccagcctctagtactgtgaggaatacatttctgttctttataaatcaccctgtcttagatatagcagcataaaatggactaagatagaggagacagcccacctcgtcagctatgcttctcatagtgtaatccaaaatctagcaaccatcatttaggaacatgttagaaatagataacagactcaattccagatttactaaatcagaatctgcatttcagtaagatcctcaggtgaattgtgtgcacattaaagcaggagaaccagtgccttagctgatttgaccacaggaatgtcatcgccgtgggaggcttcttgtttcccagggattaatgtcaccccctgccacgctgcttcttgctgtttagatcttatcaacatggcatctgtaatgcaatagatgtgtgcggtggtctgaaggaagggctgagaaacactgctcttctttaggttactgacagttgcttttcgtgactcttgcatatgagaatgcaggttttttttttttttgccatatccattattggcagctctataaatttacttctgttagaaatctacatttaggagtacagctgaaattgaagtcaacctctgattgtgtttgttataatatagtagtaatttttatttagacttgctagtattttaccttatccttaaattgctaaattggagcacagtttcccaagatccataggaattagttttcacgtatatttgttatccagcatgactccaaagtttggtcattcccctttttgaaaaaaacagtcatctaattaaaagttctttatggtaagactttaggaaggcatcatagtagagcctggtaaagataaaacgagttttcctcaatacctgatcttctctttatataagaggctccaggtctgtgacttgggaattaggttagaacctttgttctctaggctgatggctcaaataaggcctttgtatgttagcgctggaattgttttgtcttacaacaattaatcaagaccttagggaatgtgtaatgaatttgtttctggagatgtcttgattaattaattctatctaggaatctctgcatgtcagatatttcatgcaccctgatgactactccagccctgttgcctattatgacgctcatcctcattttgttcctggtaattaaatgctgcctcctgagcttggccatccagagcttccgtgatttctgctgggattggggtttacattaagcctgcccactgacatttctgacctagaggtaatagctggttaagcacaattaaaaatttggatttaaaaaaatattattcttctaatttcaagaggcagtggcaaacaatacagattattatgaaataatacacagtaagtcctcacatcacatcattgataggttcttagaaactccaaatttaagcaaaatgatgtatcatgaatccaatgttttttctcatcaacattacagtgaaacaattgtgaacaaaacagaattattctaggatgttattctaggtcatttcacttaaagtcgcagtttccaagcctatgaataatgttaagtggagatttacactatatcataccttcctgaactttcaatttatcattaatattacatccatattaatttttagagccagaattgtacaagctatttttttctttaaaaagtggcaacttaattatctattatagttgagttattttgtagaacgtactttttttaaaatgagctcttttctaacatgttttgacatttttcgagtgtgttcacactctgatatctcatttgctacttaagttaattttcattgcattgaagcgaggactttgacatcgtgagaaatggtctgataaagaaggaacatccctagggccagggacaaagcaccctgaaagggttctcaacctttctacctaaattccattttccaaaaaatgactaaaaatgttctgtctacctgataggattattgcattgattactgaaggtaaatattaaaaaagcatgttttatatataccaagaagtctttattgagcatatactctgagccaagctctaccctaatcacttaaaatgaatgtgaagcactttgcaataagcttttcatttgacatctaaattctgagaaagtttaagtttgcaataatttaagaaacaaaattactttgaagacaattacaatatgtgtatatgtattttcgtatatatgtatttgtatattaataatatatttatattttggataattctgttttgatttgaaagaggagttggagagactgtggcaaagaagtgacatttttcttcttgctttcacatattttgttggaaagtttataacttttagttttaaaatagtggagatatctttagggatggatataagttcctcccctcaaagaaagccctctagaaatggaaaacagtgtaccctaattgagaacccatcagttaaataaagtattaagtgcttgctttatcctagatgattttggatatagtggcataatgtgtacttttcctgcgctgcagaaactcttttgagaaagtgtctccacaatcagtgaacattgctgtattctatgattgctactcagaggtctacagaccagtaagatgtgtatgatctgagagcttgttagaaatgcagaataaaaaaaatgcagaaccccaggcccaggccataccccagaactactgaatcagagttttcatgttaacaagatcaccaggagaaatatgcacatttttttgagaaacactgttctagatcacatatacaatctgaattttcctaaataatctgctatgtttgtttctgtaccatcataatcttggtcccttttttttttttttttgagacagagtcttgttcttgtcccccagtctggagtgcaatggtgcgatctcagctcactgcaacctctgcctcccaggttcaagcggttctcctgcctcagcctcctgagtagctgggattacaggtgcataccaccatgcccagctaattttttttgtattttttaagtagaaatggggtttcaaagtgttggccaggctggtctcgaactcctgacctcaggtgatccacccgccttggcctcccaaagtgctgggattacaggcgtgagccactgcgcccggccggcccttcttttttttatatattctttttaaacactttgtttttgcatgttggaacagaaaagattaaaaacaaatgaactgaataatagtaatagcaaacaactgtgctcttttttttcttccagttaagatttgtcaatcttaaataatgagatttaggaaatatgattaagtatacagtttattcaggctgaaaagaggatggtcacccaggaaaacactgattccaaatgaaaatagggtcagcattttcaaaatggagaagttaaagtttcaattatataggcacagacagataagttgtaggaggattacaacatttttcgtatgaagcaaggtgcatatgccacagcaattggtttgattgattatggatttctgcattccaagggaagttactttattactccatgaggatgggtagtgatcttaggggtcttatctctggcaccgtttggtctcaattatttacaggaaaaagaggcttttaaaaaaggcaaaagttgcagctgcctgccacctggctcaggctgcagagccacattcctctcaaggctcaggataacttaaagttccaaaaactgtaagtttaaactatttagtttcacagctactataatgttcagtttcctatctttgtatagttacctgggtaaccaagactctaaccctagtaatttctcttttctcttcttgttagaccatccgctgggctcattccaattcctacccgaccctgctgctttatgatgaattggcctttaccaatgaatcactttttaacattaccctgcagttgacaatttgcctctctgtaagccagattgcttcttaactagacattggccttgtcgctgaacctccttcatatatttgagtacaacttaattgtagcaaaatagtttcaactgtgttaaacccattgggttttctttaggggtctttctggagaccctaaataataacacatagtcagctgcaagattttttattgtaagactaactttgataccagcttgccatgtctaagaaagtgaaaaagctaatgcataaatagaaaatttctaaggctagctgtctcttgatcttggtatctttggagccaagacaagaaaggcaggataaaccttgctcaattaagctatctttgaggaaccagaaaacaaacaaaaatcccaatatagtgatttaaaaataaaccctaagcaggaaggatgaggatgtctattacttagtatgagaaagaaattgagcagattggaacgtgacaccaattcttggactcagcgagttgattctggagaggtaaagcaaagacagttctcttcaatgcagtgaacagagaacaggtaagggttgggttgaattgaagaattgctttgagagtctcttatctgctgcctggaatgattgtctgtatcaaggccatattcctaaaatatgaaatctgtgactgatgtgggggctagggaattgaagcttgtatggggtgtatctgagaaataaaaatatccaaatcgagctttgattcaggctcaatattgtaggtttgaggagggaaagtttcctcttcaccttctgagggtttgctgaaaatgaactgacaaaatgcagattaacaggagagaaagcatacaaaatttatttaacgtgcacaaggggtggagatggggggaagtcacgggtgtgattacccaatagcccaacgatgcttatatactcttcttcacggggagtggggatatggggaatgaaggcaaatcttttgaggagtaatagatggttagtagggagaatgaatggatgctgaagatggaaattaacttataaagaattttctttggaatttcaatgcgcctcagagacagacattatcctgtggaaacatctgtccaggtgtggttacatttctcactcttattttctgtgatagataatgacatttgggggaggggatagaaggttttctctttggcaggtccagtcttcagatagaaaagggaatactagggtagggccccttccaagatctgatcaccttcaatggccttgcatctaaaatagtataccgtggtgttatattttggggtgaaattctctgggagcctttagcatctttatttagcattgagtgtttcatggactagcttatttttgaggtaagatgttgaacttttaactacatgctacatgattaaaaaatctattatctctacttctcctttatagatcagatgtttatgtcagataaagcttgtctttaggattccttcaggccccattttcggtccttgtttttatcctcactgaaggaacccatatgttaggattatcctaccaaatatagtaagcagaaagtatttgccaagagaataccatgtgtacatttgaacactggacatttaaacaggttttttttttttttacggggatacttacaatatgactaaggagatagatgtataaaaaatgaacaagatagcatacttggagaaaatgcattatatgcacatttaattccactataagttttgagtggagggatggataggaagagagaaatacatatatgtatgacccagagggtatatacaatgggagaaaggaacctgttgttccaagtttctattatggcatatatggtcatgatgattttctcagtatgaagcatctcctagggctaagtttgatgtaaaactgatgttctgtattttaggggtaagttaagaggtttgaaagtgttatttagactgtactatgcttgattttcaatttataaactaacccgcttgtaagtttctttataattccaaaaaaatgtcatttgctaggggagattagaagagtgaagtgattccccaaggtaagttgaaggagtttcagttaggtcctatgttgcggaaagtcagggaccccgaacggagggaccgcctgaagccatggcagaagaacgtaaattgtgaagatttcatggacatttgttagttccccaaattaatacttttataatttcttatgcctgtcattactgcagtctctgaacataaattgtgaagatttcatggacacttaccacttccccaatcaatacccttgtgattttctatgcctgtctttactttaatctcttaatcctgtcatcttcgtaagctgaggaggatgtctgtcatctcaggaccctgtgataattgtgttaactgcacagattgtttgtagagcatgtgtgtttgaacaatatgttcagggaacaagagagataaccgtaaactctgactgctggtgagccaggccaacagagctgtatttctcttctttcaaaagcaaatgggagaaatgtcactgaattattttcctcagcaaggaacatccctgagaaagagaatgtgtccctgaggggaggcctcgaaaatggccgctttgggggcggctgtcttttatggtcgtagctgtgggatgaaataagcctggtctcctgtagcactcccaggcttattaggccgaggaaattcccacctaataaattttggtcagaccggttgtctgctctcaaaccctgtctgctcatgagatgttatcaatgacaatgtgtgctcgaaacttcattagcaattttaattttgccccggtcctgtgatctcaccctgcctccatttaccttgtgatatcttattaccttgtgaagcatgtgatctctgtgactcacaccctattcgtacactccctccccttttgaaaatcactaataaaaacttgctggttttggggcttgtggagcatgacggaacctactgacatgtgatgtctcccccggacacccagctttaaaatttctctcttttgtactctgtccctttatttctcagaccggctgccacttaggaaaaatagaaaagaacctatgtgaaatattgggggctgaattttgcctgatagtcctaaaagaaagatagaaataagtagtacagaataacgtctgaggtctgtcacttaataaatatggttaagttaggtccaacaaaattctttttactttaaaaattatttcagtttgaatagtgaatgttcatagaaaccattcacattattttacaggctacttcaacttttctttgtttattccaaataagcacattttaaaattgttttagttgccatcataatggcatcttatagtctaagggagccaaatagcctccccaccttccttttaataagacaaatgttcatattatgaacattttagcaaaacctaattgctctgagaaaatggaaatgtagttacagatacaaaaatacttgcagttactgttatcaatttaattgtctcagagtagggaaataagcaaattagaagcatagatgggaaggagactgtttttcatgatcactcttaagcatctttggaaatttgtaccacatgcatatatatgaattattaaaagaaaaaggcggaggggggagtgagtcacctaggttgcacctagtgcaactccttttgtatacccacttgttctgtatatttagttaaatgccacgtaatcactacaatgattatttggtaagagattattattattatggtaaaggatagggtgtgtaaatcagaacatttattttcgcagaagaatgaataattggagaggggatgggttggggtcagggagtttaagaataagttgctatagtgggatgatggatggaaatagaattaaatcggtgaatttgagtgagatacagcaggatgagtcagtaggtacttttcttgaaggtgaagagaagaaatttctagctttgaagactggactcagaaaaacaagagtgccacagagaaataagaaatttcagaattaggtttttagaggaaaggtaatgattttggatctttgagttaaatagacagatggtagactaggatatttaagtagcattctcttagggttttaagttttttattttgtttttatttaattgataatccttatcaagactttttagctcttagatttaattatttagcttgggtgagtattagttaagcaatatggcaagctaatgataaataaatattcattgactgctggtgttatgacccaacttgcattttaaatcctggcttcaatttcttaacacaataggagttgagtatacttgtttgaagaaaagatggatacacgtttaacttacgttatgacctgtctaggtccagcccagagagaaaaagctaaatgtacaagttacttcactcagggaaaatagtcaaacaactttcttctttgctgcttcttcttgtttcttctttttattttgaacattagtaaatttgcagtttatagtcaccatctctctatagcacttcaccttttgaaacctagatatgaatttccacccttacccctaccaaactctttttttttccacatttgtctactagtttccccttcccccaccataggtccttcaaatttcaaaatgaaaatcatattctgcttcaacctctaccttaacctgtttcttgtcctacaagatggaaacctctgtgtttaatttaacttctgcttctcctctgagagccatctagtcatgaaatgatattagttatagcttaccatgatctcttccccagcctgtggcctctgtgtcagactaggccattaccattactttcccggctaatacaccatctgtataactggcccccaagtcaccagatttttttaaaatccaattcctacttcatattattatgaattatgtttactcctctctgcctttatccccacagttattatatgactctctttaaaatgttcattgctttataagaatctttgagaataaaatccaaacattttgtcttgctataaatgttgcaaactattcggcatataacctacttttatattctagaaccacatgtcccttctttattccttactttgaatatactgcctggaataatattccactaaccacattaacttcatgcctttccaaactcctgtccttttttattcctttcaataacaaatcatcacataccgaatagcttaaaataataaaaaattattttctcatagttgtgaaagccagaagtccaaaatccagaagtcagcaggacttcttgcccttgctcctgaagctctaggggacattccactccttgcctcttccagcttcctctggtgactgcttggtttgtgactgggcatccccagtctctgcctctgtcttcacatcttctttgtgtgggtgtctttgcctctcctgtcttctataagtaatgcatttaaggcctaccttggtaatccaggatgttcttatttcaggatctttagtttaattatagctgcaaagactctttttccaaataaagtcacgctcacaggttcctgatagatatgtctttttgggagaccactgttcagctcactacacacacaaaacacatagctcattcatgctttcactcatgtctgttgaatacttagcaattagtttttttctctattattacatggtgttcagttgatatctctattttagcccctattacattaaatttatatattctgcccacttggttggaaagttatttgttggataatattcaatttatccttttttgttacttgaaaattgaaattcctggctcactgccaattccaaactctacttcctggtgatcataatttttagtgacttaaataacaaagatgtctgtattattcagtgttctccagagaaatagaacaaactggatatatatacatagctgtataaatgagatttattacaggaattggcttacacagttatggagaccgagaagttccatgatcttccttctgcaagacggagaatcaggaaagctggcagtgtcattcagtccaagtcagaaggcctgagaatctggggtggggaaggggccacagtctaagtcctggtctgagtctgtaagcttaaaactaggagtactgatgtctgacagcctgtctcagctaaagcagagagactgagttcgccttttttctgtctttttggtctatttagtccagtcttgagagactggatgatgcccacacattgtggagtaccagctgctttgttcagttcagctcaccagttcatatgctaaaatctgccagaaataccctcagagacatacccagagataatgttttccagctatctgggcattctttagctcagacaagttgccacataaaattaaccatcacgatcatccttccaatgtgttaactttttgactgctcagtttcctttcttccaatgatcttgttctctttgttctgtcagccacccactccgtggacataccttgtttctcattattagaaataaccaaaacaactccaaaatgttagtttaagtatagcaacctgctatcgtcaccacctctttccccccagtgcttctcttgctactgtttcggtaacaattccttgacctcattgattcctaccatctcttcactgtttctcaatcactcatgaactcatgtccttactgacctagcttagatctattgctaattattatcatcatcctcttcttttgctttgtcatactgttttggtcaaagcaagtcctgttgaactttttatttactccatgcctgcataagtgcagcagaacagaggaagaagaaaacatccattctttaacttttaaattttgtgggtacatactaggtgtatatatttgttgggtacatgaaatattttgatacaggcatgtaatgtataataatcacatcatggaaaatggggtatttatgccctcaagcatttatcctttgtgttacagacaatccaattatatttttagttattttaaaatgtacaattaaattcctttgactgtagttactctgttgttctataaaatactaggtattattcattctttctaattatttttttgtacccattaaccatctccatttctcccctactccccacaacccttcccagcctctggtaaccaaccttctactgtctatctccatgagtctaattgttttgattttagaccccacaaatcagtgagaacctgtgcacacgtctgctcttgaaataaaaaaccaactcgcaagggggccctcgaggctgcctgaaattgtgctgtatctcccttgtccatttgctcttccatgttcccagacattcgcttcattccttattctctttcctcaaagttctatatccctttcatccttagtcttagctgatgacttgttcctattttacatagagaataaaagcaaatagaggagaatctgcaaacgattctaccctcatgtttatcctcttgcctgtatctgttatatgctgcattctatttttttttatttaagacagagtctcactctgtcaccaggctggagtacagtagcacagtctctgctcactgcaacctccgcctccctggttcaagcaattcccctgcctgagcctcccgagtagctgagactacaggcacccaccaccacacccggctaattttttttttattttttatttttgtatttttagtagagatggggttacaacatgttggccaggatggtctctatttcttgacctcgtgatccacccgcctcggcctctcaaagtgctgagattacaggcatgagccaccgcgcccggtctgttttcttttctgttgttatgaatgacctgtttgtgcctcttgcaaaggccagcccttgtttttgtacacaagatctatctcctctctttttcttaagcaaattgttccaggaattttcccctttctctctggctccattattattattattattatttttattaattattattattattttacttcttcctatcagcatactaataagctcttatttctttcatcaaaaacaccaccaccaaccaaacaactctagaatgtactttctccagctgctgctccatttttattttcctttcatggaataaaaaatgtctttaaaagggctaacacccttgctgtctgcaatttctctcaccctactctctttgaatccactgcaacagactttcacctgtgtcacttcagagaaacacttcttatcaatatccctagtgatctccacatcgttaaatccagcagccaattttctgtcttcatcttaatagactagtcagcagtaggggacagggtgatcactccttctctttgaaatttgtttcttcagttgacttccaggatactaaagttcttgctttttctccccccttattgactgccctgccttagaatctttttctgatttctccttatctccttcagtgccaactctaaactgtaccagggttcatttcttacttattttcttcttttcatctgttctcactttaaaaacttatctcaccaaatcatacagcttcaaatatcagaactgctatcttcatcccagacctctattctgaactgctgactaatatatccaacgaagtgcttgacatcgctatttgaatttctaatagatatctcaagcactaaactgagctcctgattttattccccaaacttgcttcactgaaaatcttgcccatcttaattaatgggaattctattctgaagtcatccttgattcctaattcttttctcataccctaccttatatgactacatattactggctctaatacaaatatatccacaatctgaatacatctcaccccttccactgctaacagagtcatccaagccactgttattaatattctttttaatctaattagacagtgttgcctggcctcccagtttctgtccttgcctctgcagtctattcttgatgcagtaggcgggaagatcttgaggaagcatcaagccatgtcactccttttctcaaagccctccaatggcacccatttcacagggtagaagagtcctgctgtggcttacaaacctatactcaatttgacatcttctctgatgtcatccataactcctcttcacttcctcactctgtcccagcagcagttaccaccttgctttcctcaagcactaatgcaggctgcagcttctgagctttgcatttgctctttccctgcctagaatactccccactccccatcaggtagcttgcagtgctttgcatctttttgtaatgtcttctctgtctattctgtttcaaattgtattcagaacactcctttccaaaatagggaaaacaaacactgataacaaatgaatcttgttgtggcggctcacgcctggaatcccagcactttgggaggccgaggcgggtggatcacctgaggtcaagagttagagaccagcctgactaacagggtgaaaccccgtttctactaaaaatacgaaaattagctgggcgtggtggcgggtgcctgtaatcccagctacttgggaagctgaggcaggagaattgcttgaactcgggaggcagaggttgcagtgagccgagatagcaccactgcacttcagcctgggtgacagagagagactctgtctcaaaaaaaataaaaaataaaaaataaataaaaaataaaattagatcttgtaatcttttatagctgactctaatatgactgggaagtgcaatattagtattaagtacgaattttaaaaacaattgcattatgcaaaggaatacaaataaaagcttaaaagtaaaattataaacgatttcaacatatgtgttctaggaatattcagtaggtggcatgttattgacttgaaattgggtcttctgattcccatggctaggtatattcacaaaagaagataaatcagtatatggaagaggtatctgcactcctatgtttattgcaggaccattcacaatggctaagattgggaagcaacctaagtgtctatcaacagacgaatggataaagaaaatgtggtacatatacacaacggagcactattcaaccataaaaaagaatgaggtcatgtcatttgcagcaacatgaatggaactgttcattatgttaagtgaaataagccaggcacagaaagacaaacttcgcatttcctcatttatttgtaggagcaaaaaattaaaacaattgaacttatggacatagagataaaaaggatggttaccagaggctgggaatggtagtgggggtgttggggcttggtggggtggtgaggatggttaatgcatacaaaaatagattgaatgaataagatctagtgtttgacagcataacagggtgactatggcaacaataatttatagtacattcaaaaataactaaaagagtataatcataacgcaaaagatgaatgcttgaggggatggataccccattttccatgatgtgaatgttacacattgcatgcctgtattaaagtatctcatgtaccccataaatatatgcacctaatatgtacccgcaacagttaaaaatagaaaaatttatttaacaaagtccttattgaaaatcccccgttactgtctttttcttcaaatagttattgcttttctgtttattttcttcccttttatatatacgtgcaaaaattaatatgcttttttcctgtcctctaagttgtttttttttaaagatatttaaaacaaataatggccttttatggaacaatgcttgttttttactattaagaaagatgtatgaccagttataattatactttacagttttatatatagatctagctttgagtcattttaattgtatttctgtccaaacaaacttgatttaaacctttctgtaggtaattatgtgtcagctattatactgaagtcagatatagtttatgcttcagatatttttttttttaaaccagtgaattttctactaaaaaggaaaaaagtcatcaaattaatctggactagcaactttgttaattcctgtactgttctctaaataatggctcattatttttctacttgttgtaattcccacagaagagatgacaattttttagttgttagaaatgtcttatctcttcttcatgcctcccaagtcacttattgattgcattcagcctgactgtaattggggtatatactcaccttcctaaccatgcacaaattagtctatagaaattagtccatagaaacctgtatccttttccatttaagtaccatctattgaggcacagagttcagaggcagaaggtaatgaattgggaatgttgccctctaaggaaggcagggcagcagttttggggtcatgcttgatggtatcaacatgaggatttataaagagctaaattcaatctgtttattgtggaaatgaaaacaaagttattctttctgttcttttaaattatcgtgggtacatagtaggtgaatatatgaggtgcatgagatgttttgatacaggcatgcaaggtgtgataatcatatcatggaaagtggggtatccatcacctcaagaatgtatcctttgtgttacaaacaatccaattcttgccatttcccctacttttgattttaatgtaaagatttattcccctgtctaatactgtccagggacttctaattgcacctagagtgatattcaaacctcttaccgtggcctctaagccttttttaatcttagattttttttttctcccgcttaatgcttttcacccccctacctctaacccacccgccgccacacacacacgcctggttttgtcttggctgtttgcttttcattcttgggatttttgcttaaatattgtcttttcagaaatctctacccaaagattttttttttttttttttttgcttagttcatagtatttatcacattcttaaataaagttttaatttattgctttactttttgttctgttgcccccaggaaattttaagttgcacattttgttgaccgactgagtgaacgagtaaaggagaaaaaagcaacctgtcttgtgggctgggaactggttgagcagggatttgagcacaatgggtccgcatgtgatggtttatgtaagaagggaaggggaaggacttcaccataattaactagggtgtgaactgggcgtaggatagccaggagcatgtggagatgaaaggtcagaaatgtagtaggttggggaatctgggagatcatcgtgtttttaaatatggcagtaaaatatccatatttgtgtttttaaaaagataactctaaggagggtggaagggagtgaaatggtggtcagggtagctgtaggggagccagttagaaagctattgcagttgcactttgggaggctgaggtgggcggatcatttgaggtcaaagttcaagaccagactggccaacatggtgaaaccccgtctctacaaaaaaatacaaaaattagctgggcgtggtggtgcctgcctatgatcttggctactcaggaggctgaggcaggagaatcactttaacctgggaggcagaggttgcagtgagcgaagatcttaccactgcactccagcctggggaacagagatggagtctccctctcaaaaaaaaagaaaaaaggaaagctgctgcagtcattcaggtgatccatgattagggatggggctcagggagttccagaggaatgaaaacaaatgagactaggatgagttggatgagtttttggaggtagagttgggtggacaaggacactgttaagctatagtctgtgtgggaggaagaacaagtcaaaggtggctttgggtttccacctcaggtaacaggatgctgttattatctccaagagcaggaagagggtgttgggtataaggagttcaggtttggtgtggttcagtttgatggatcagcatattattttgttccataggtagtatgtgtttagattttgggagacaaaaatctgagtcctgagcaaagaagtaaatattgaaacaagagagggagagaaaagtgagagatggagaaagtcaaggataaaagttagacaagagaaagggaaataccacagtttctgctcctaattctccaaatacatcttagtcagttttggcatatcttcctgccctagtaaactttgaaaacgaagctttcttaacattttagattcagcagtttttctgtcccttatttttgcatacggttcacaattgttttttaaaataactcctgcctcacttctgctgagccatgtaaatcacgatggcaatgaaatgtgttcttttgcattttagcgctctccaggtggttacctcgtctttcatcaggtttgtcccatacagttactcttctgccacctttcagagacagcctgatcaggcgcagccagtctcaaacagcctcatctcaactcctaagtttggtaatttctgacacctcaatctaaaacagatacatggagccacttcctaaaacatcatcctgtattgatttacatataaaaattgccaatgtgcaatatttttcaagggtttatttattgcctgtctctacaggaagtgagctgcatgagagcagtcactaattggtcttgtattctggagtcctttttgtgtttcatttgtgctgaatgttttctcttccaggaaactcttctcttaggtatccccttggaccatgccctcatttccagctagttctttgctccaatatagaccagctttctttgtctgtcctgtatcaaatagacttccactcttatgctcctcattttatttaacaccactgacatattttttatatatttgttgtctgtctcttgccattagaatacaaatccttgaggatagggacttttcttcactaccatgtctttagaaattagaatggttcttggcatgtagcatttagtcaattgatatttgatgaggaagtaatgaatgtatagaaatagagaagtctctttttccaggtaggagaggaagaatcttggtcagccaatgtggctggccatctgatatttcctactggagaatcttccctttttcttgggatccattggatacacagaagatgggtattagggaggattcccatgcaaggaaaaatataggatgctcagttaaacttgaatttcagatcaacagcaaatcatttggccatgcatacactatgtagctacatattttgtgtagctcatttcctgttggtgccattttgaggttatctttggagctgaataggcatagactgatattggccaatcctggagattttatttatttatttggcaagtctgtttcctcagatgcttaaagggcttctaatctctacagaactataaattttacagctacagatttttgtctcgatactgtattacagactgatatggtttggctgtgtccccacccaaatctcatcttgaactgtagctcccataattcccacatgttgtgggagggaccaggtgggagataattggctcataggggtggttcccccatactgttctcatggtggtgaataaatctcatgagatctgatggttttataaggggaaacccctttcgcttggttctcattttctctcttgtctactgccatggaagatgtgcctttcaccttctgccgtgattgggaggcctccccagccacatggaactgtgagtccattaaacctctttttctttgtaaattacccagtcttgggtatgtctttattggcagtgtgaaaacaggctaatacacacactcacagtgtttacctcttcacatcagtgcaccatctgttagcttttagtttaatatcctttgtcctgaagttattcgtaacagcaacttcttgcaggaaagctcagctcttaagactttgttttttttttttttttttttgtaatttaagttttaggatacatgtgcacaacgtgcaggtttgttacacatgtatatatgtgccatgttggtgtgctgcacccagtaactcgtcatttaacattaggtatatctccaaatgctatccctaccccctctccccaccccacaacaggccccagtgtgtgatgctccccttcctgtgtccatgtgttctcattgttcaattcccacctgtgagtgaaaacatgtggtgtttggttttttgtccttgcaatagtttgctaagaatgatggtttccagcttcatccatgtccctacaaaggacatgaactcatccttttctgtggctgcatagtattccatggtgtatatgtgccacattttcttaatccagtctatcattgttggacatttgggttggttccaagtctttgctattgtgaataatgccacaataaacatacgtgtgcatgtgtctttatagcagcatgatttataatcctttgggtatatacccagtaatgggatgcctgggtcaaatggtatttctagttctagatctctgaggaatcgccacactgacttccacaatggttgaactagtttacagttccaccaacagtgtaaaagtgttcctatttctccacatcctctccagcacctgttgtttcctgactttgtaatgatcgccattttaactggtgtgagatggtatctcattgtggttttgatttgcatttctctgatggccagtggtgatgagcattttttaatgtgtcttttggctgcataaatgtcttctttgagaagtgtctgttcttatcctttgcccactttttgatggggttgtttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgctcatgcctatgtcctgaatggtattgcctaggttttcttctagggtttttatggttttaggtctaacatttgaattaattaactttggttgtttgctcactccctttgtttaactagatagcttaaaaggaggcaggtgaacagcactggagggaggggagtagtgttactttgctacctctttcttctgcttcctttagcttggcttatgacagttgaattttccaacctggcagggcagggttagaaaatcagaatggaatcccagaactgcagtttcaagatatttaggaagtggctcagtgagaatgctatatatcaagtgaataaaataaagctacagctctaaatgctaggaccaccctgaaccacccagcaccactcacgacagctaaaatgcatggagcctttatagcatggcaggtaatgtgctggttacttttagtatcatctcatttagccttaccttcattagggaaatgctattttttgttttcattttatgagcaagaaaaatcaaagctcagagtatgtataacaaaatggtgaagccaagatttgaaccttggtactgtgactccaaggctcatatacttatgctctcagatctggtgtatttaggagaatggatatggtcttaaacacttttattattcagcaagaatgatttaaagtaaatcaattacacttcaagccaagaacttagaaaaatagtaatgaagtctagaaaagagagataaagataaaagtggagataacttagaaaaacatcaatatatttactatgcatgcttcattaaaaaataaagcaataaaatcagtacagcacagagagaaagagagagaaattccaggcatgagaaagtaatatacaagacagtgaatacactcagaggaatggtagagcttttcagaatgatgagagattatgtctttactttttgactaaaatttctagaaacaatttgaaccaacaaaaatgactcaaggaaaggaagaatcatcaataactctgcaatttattaataataataaagttgaccaagaataccatttattttccagctccaccccttctgtaaaacaagcaaataaaaagacttttaaaaacccagatgaaattgtgagcaatttaattcagatggttaggaggctaatatttacaattaataattaggctgggccgggtgcagtcgctcatgcctataatcctagcatttcgggaggctgaggctggcggatcacgaggtcaggagatggtgaccctcctggccaacatggtgaaaccctgtctctattaataatataaaaattagctgggcatggtggtgtgtgcctgtaatccctgcttcttcgtaggctgaggcaggagaattgcttgaaccagggagttggaggttgcagtgagccaagatcataccattgcactccagcctggggacagagtgagactctgtctcaaaataataataataataataataataataataataataatcaggctgttgtggcacattagggaaacaggcttcccaagtaccatactattctggccaagaatatgatagagaattcacagaaaaagaagactaattcttcagtaatattgatgtaaaaatatgtaaataaaattcagtctaataatatagtaaatggcatatcatagttaataggatttatttcaagatctccagaacaatttaatgttatgaaatctattgataacatttcatcatagcataacaaaaaacaattgttcttctcaatatgttcaaaagggtttgtaaaagttaacttcaattcctgatattgagaagatatttccttatatttaatctttaaaaaattatacatctctgaaatgaacattaaatatgaaagcatccttgtatctaccagacagaattttaaaaatgtaaagcacaaaagggtactgcttatgtgactttaaaaatccaaattcattattaggatcatttatatctctgaaataccaaaagaatttttaataaagtcaggaagaatatcaggaattccataattgttattcattaataacattattctataagtggttattaatattttggataaatatattgaagttatagttattagacagtagaattattaatttctaatataaagcctacaaaatcaaattattagaaataataaagaatatagttagatattagcattgttcttatataacagcaactacttcgaaaataaaagcaaataataaaggatgttatgcagagtggtggaaaataaatacgtaaccttaggaattaatataaccttaaataataagacattatgaaaacaccgtgtggtgtgaaagaaacttatgctgggtatggtagctcatgcctttaatcctagtgctttgggaggctgagggaagaagattgtttgaggccaagagtttgaaaccagcctggacaacatagtgagacccatctctaaaaaaaaaataattagctgggcatggtggcatgcacctgtagtcccaactacttgggaggctgaagtaggaggatcgcttgaggtaaggagttgaggctgcagtgagctatgactttgtcactgcactccagattgggcaacagagggagactgtctctgtaaaacaaacaaacaagcaaacaaccaaacagaaaacctggaaacttgaacaaatggaaggatatatcacatggtttcataggaataatcaagaattgaaataagtcaatttcttacatgcttgtgtatatatattgaatgtaactgtttccaaagttttaaggcgcgtattttttttctttcaaaacagaacaaataatcctaaggtaaacctggaaaaacagattgataaaagtagctaggaagatcaatcttaataaccttgctctaatagatactgaacattcttacacatagttaaaatagtatagcacaggagtatgcaatagcgagatatatcaagagagaaaaaaagaaagactccagaaatagaccaaagaatacatagaataataattggatgattacttgttcaattgagatatttaaatgtaatagatgtaaacccaattccaccatctgcagaagtctaaggctcttccccaaaatttctgtaaacccacaggctggtagtggggacatgatgtgactttgtcccctctactttctggacttccaacttcctgaatactggtcctaggctatgtcatgtcagtcaagatgtggaactcagcactttgttcaagtttcacaaatctgacaaccaacaagtcaactctcctctaaggcagttactactcttccatgctatttttatcttccaacattttgttaatgattcctaactgctgttgtcacttctctgtattcattgcccgttttactttttgtgtccctcactgtcattttgtggcattttggtaggggaaatccataagtgtatggatgtaagataccactttaactggaaaccttttcctctgtaactccttttttataaaggagatattatgataatttcccagatactcttatcttctcaaacgctgtcctttgattaaatctcagagaataccaaggttttaagcagtttaaaagtgcaatatattattttattttgctttttttttgtagaataggatttattatgaaagaagaaacaaaggtgatatatttgtgtttctattatgtgatacgggtttgcacagattctatcatttaaaaattcagagcaactccatgggggaaaattaaggatcagagaagccaattactttgcctgagacaggagagtaaataagtagcctatttaagtcaaggttttctgattcccaagttcattctctttcactatattctatttgctcttaggagtaaactacttctctaaagttgagtaattattaatttactagagcataataaatataatttaaaataaaacatatatttaagcatgagaagaaaatgaaaaatacagtatcacaatgcttttgttatgccttcagtttcatcgcctttattgaatatttaaatccattaatcttgttcccttgtttctatagattttagtaatgactttccctgttctattgcagtatagtctggtttccagatattttatcttgattgtctcttactcatcctattaatggtatactgccagatattacaaaattgcataaaattctgaaagcatgtaagatctatatgccaacaaactctttgagtttatggataatacagagacaaagtagttaacaaagaaataagtaaaaatcacttccctctgatgaagttgaaaatactcaaaatatcagagtatttgaaaaagtctaaagacttaaatgacatagaaaaaatgactttgaataaaatatttttaaacatatttaaagtaaaagcacatgaatatcaagtaaattaaaaatataatgaattatttatggatgactttgatttataatttaaatcataaaccttgattttccaagttttcctgcttaataatttgactatttgattattatggtgattatccaattaaaagtttaaatactattataaaaacaaaacatgccaatgctgagaaaaaaataagaaatataaatgaatagcattgaaaacataagtcccaatgccccaaagtaaccatggttagtattttggtatacacatttttatatatatcaaatagacatatactagattttcaaatatgtgtatatatcttagtttttgggggctgctataagagaataccatagactgagtggcttataaacaacacagatttacttctcatagctctggaggctgggaatttcaagatcaaggggctggcagatttggtgtacggtaagggcctagttcctggttcatagatatctgtcttcttgctctgtcatcacatggcagaatgaggaagggagctctctggggtctcttttataagaatcccattcatgaggacctgtattagtctgttttcacactgctgataaagacatacccgagactgggtaacttacaaaatgaagaggtttattggagttacagttccacatggctggggaggcctaacaatcatggcggaaggcaaggaggagcaagcacatcttatatgggtggcaggaggcaaaaagagagcttgtgcagagaaactcccatttttaaaaccatcagatcttgtgagacccattcactatcacaagaacagcaagggaaagacccacccccatgattcagtcatctcccactgggtccctcccacaacacgtggaaattatgggagctaaagatgagatttgtgtggggacacagagccaaacaatatcacagccacactctcatgacttaatcacctcccaaagactgtacttccaaataccatcacattgaggggttaggtttcaacatatgaattttggggagatacaaacattcagtctatagcagtatatttgtgagtcagcactcatattccaaggtgaaattatatcatatatacttttttgaaactttgctctcttagcttatcaaaaaatgtttaaagtgggttgaatactgaaaactctgaaagtatacttaattgaaaagtattatttaaaatattcttcaatcttaaacaatgatactaaaataatatatatttaaagaaagcaaactccttagaaaatgtcttgactttgaatgagagatgtagcaaaaatatatgataaaggataagtgacctttcttcttatttttagatttttggcatttttaaagatcattatcagataccaaaatacctaatgttttcaaaatggacaacatttggcttaaaaacagctcacataaaaaaaggaatcatggctttagctaacaacaaaacttactgttagtataacgtagtatgaattagatgtgagagatgctaatataaaattagactgcatttaaagaatggaggtattgagagcaaaggtagatattatttcccaggcccttcaattgtgaaaacatgtctggtagaaaatgttcagtccaatgagccatattgttagacgaatagtggcaattatggcttatataaaggagggcagacaggatggcattgtactggaaattatgccatgtgaagactggctgaagtaggggtatttagttcattaaatgagttttgttggtacactgacaggcaaaatagatcaatggaatttataggaaagcaagttttaactcagtagaaggaggacatgaagttctatttattaagtgcctgctctgtgtcacgcccaggagatatgataggcatatttgatcaaggtggaatttcaaataaatttgcaaaaagatggatcaaccatgacaaatatgctacagacaactgactataaacatatatctaattcagttcttcacatcttcctgtaaaagtaacataaaaatataaaggatttaaatgtaaaaaactctatgtcaatgtgctatatacaatcacagccattccataaatttaacccattttaaacataggcagctgaggatctgggctgggacattaaggaatttgccccccaaaaagcatcattaggttagaaaacagcagagctcgagttagccctggcctgacctcaaagcttgtgttccccatcccatactataatccataagataatcaaatccaaatgtgtcatagacagtctggtaaaatgttataaaggctttttgagccttgaaggttgagacaaagactggaataccagttcacagttgatactggaatctttcctgtaagaagcaggagtagcataaggctaccactaatattccctataagtcttaaatttattattctaatgccccaaaattgcaggtatagtagtgagcacttcttgaatattttattattaaattgaaaatataaaggatgcaatcctcagagctcataccaggtcaaactactacataactgttgcaaacaaaaaaaacttttgcaaacaaacttgggttcactgtgagactatctcaaaatattctatgaagttacttcaattaggtctttaaaagtgctcataaagaaggcttaacatattcatattttaaggatcaaatagtgagatagtcatatttgcataggcattcttatgaaaagttttactgtttaaaaagtcatgctataatagatattcatgaaaagttgatgtgattaataacctaattttagaattctgggaaagcaatatttcattttgagaccttgtttttcatgttacattaggacaatattaatataacactaaatgctcaaaagagttttatattaaactattactaatcatatttcttaactctttctaaagtaacatttttattcaaagccattttagtcacatgggaatactaaaaattagtcatgatctattttattataatctttgtatatgctttatattgggcattggaccaggtatctagtttacctggatttctggtacttatatcagatgtatctaagaagcttgagtacacaagattactctttagatataaaatgaattaataatttagttgtagtatttctgatcctacctggtaataaatgtcattacctaagcaagccaatatggtttgtcattatcacttgtatatcaccatttctacataatttctaatgatatttgaagtatttacctcatatattttcctctgtttatacattcttacatataaaacatactatatataaagttttgtttcatttttgttttatcatgttaaatattctttggaaaaatatttcacagctatagaaaattatgtacatatattattattattatgaaagtcatgctatttccattgtttaattataaatacaataatcatagctatcatttgtattgtgcaatcatttatattgtgtgtattttgtgtaagagctgctctaatgttttagatatatcatcttgtttaatgcacggaacaagctcatagatagatgctgttattttcacatctacacatatgaaaactgagcacagaaacgttatgtgatttgccccaagatatccagctgggaagctgcaaaatttggttttgtaaccatgctgtctggttccagagtccccactgataaccataatgccaggcagattctttaaacatgaagtaggataaacatttatagatatataatttctgtccatattttcatttttcttttggaaaacatttctaagcatttttgatagtcttgctgaatacaatatctgcccatattttaatttgtctttgggaaaaaatttctaaacatttataaaagtcttgctaaactgtttcccagaaaggttgtgttaatttatatcccaccaagattgttccacagattccagcttcactgtatcccttccataatggatataactatttttagatttttgctaattttactgaaaaagtttctattaattaatatttgttgctacttttgaggaagttaactttttcagttgttttattaactaattttattttgtgggttattagttcatttaatgtctttctatcctactggagaattaatgaggcttatcttattcattgtgtattatattttgcataactagataccagtattttcctttgatttttttatactgtactgcttttacacatggaaaggttttgccaccctgaaatcagctctttattttagtatgatcctttctaggctatttatattaatttaaaaataacattttatctatttaggttaaatttgagtttgtagttaaatgattgtctcagaagcatttcctttcttgatacagaattccaatatgatgtttctttttccctcttcggtactttaaagatgcctttctattgttttctggcctcaattatttcagtgagaagatagctgtaattcatatatatttttccctatatggaatgcattctgtttttctctaactgcttttagtatattttctttctctttggttttcaggaatttgataattatatgtccattatttggcttctcttaattttatggctgatatttttggctctctgggttgatacatttcttttggtttggaaaattctcattcttttttttctgcttccttttctctttctccctttgcaccaattacaagtgttttactgtttaacaatgtctcacaaacctcaggctttgctcatcttcctccccactcccccagcattgttttcttctttgagtttcagcgcggctgatttcaaatgacttatctttaagttcgttgatcttttcatctgctctttccactctgatatcaagactattgtatgaattcttcatttctgatcacatattttccatttatagtatttccatatggtttttttttcaactcttataaaatttcccatctcttcatgcatgttatctaccctttctattatattacttaacatatttgtcatagtgtcttgtatgataatgtatacatcttgggcgtatatgaaccttcttctatggactatatacttggatgatggtgggcctttttttgtcatgtctcataatttttaattttataaaagaaactatatataaaagaataggggagactgaaataaatgagaatgtacccccacaaaggagaatatcccttctccagttaagctattaatgtgggagtctgagtcaatgtaacctgtggtagaactgggtttaggtttagtgttagttagatggaaatcaccacaggctttaaatatattttttgccaacagatcaggatcttttcattagcagagcttgtgatcaagattccatcatcgcaactccagaaatcgctctatgttttacatcgaaactaccaaagttcacgaggctaattccacaaagcaaatttctctgctttacgtagtgcagctggtagtatttggagaacttggaagttcttttacttcctctgtccttcccgtagctttctgcacctttggagatctctttctgtcctattcttctgtctccagtcatcagagggcaactccagtgcacttgaagtcctagagtatcttggggggattttttcagctttcctctcatgctcagcatttgtagagcagctcctgtgcatttcgtgaagccctggcatactttgagggattctctcagctattctgccctgctcctgatttgtactgggccatgtccctgcacttggcaaaggccctgcacacctcgaggtgggtcactttcaaacctcctgcccttccctggcctttggtgtataggcccttaacgcttggtagaggtctcttggctggggctcctcagtatggtaatctctcatgagagcctgtaaatggctgttaaaggtatgctgaaagtccatctggattattcttgccttcattaatggtggaatcatcttcttgctgtgtttcaaggattcaaacagctgtgggtctgttgtcttctaggagggtctaattttctagtaccattagggttttttgcatactaagttctgtgatgtgtgttttaatctatagttttacagcttatccagcttggttctcattattattaagggtagaaaaaagtttttcttgataactttttacatcttaaccagatacaggtctcatatttattttcttcacattacacttttaaaaaaatcattgttattatttaagctccagggtacatatgcaggtttgttacataggcaggctggttacataggtaaacgtgtgccatggtggtttgctgcacctatgaacccatcacctaggtattaaacctgacatgcattagctctttttccttcattaaactctttatattgtgatgatgatagattcacaggccgttgtaagtagtaatatggagattccatgtacactttacctaggtttccctgcttggtgagatttttatgattgtaataaatatcacaactaggataataacattgatacaatctactggtcttatttagatttcactaattttacttgttttcatttgtgtgtgtgtgtgtgtgtgtgtgtatttagttgtgtgcaattttatcacacatgtatgggtttgtgtatgcttgactcaccactgttaagatagagaacactgggctgggcgcggtggctcatgcctgtaatcccagcactctgggaggctgagatgggtggatcacctgaggtcaggagttcaagactagcctggccaacatagtgaaaccctgtctctactaaaaatacaaaaattagccaggcgtgatgacatgtgcctgtggtcccagctgctctggaggctgaggcaggagaatcacttgaaccccggaggtagaggttgcagtgagctaagatcacattgctgcactccagcctgggcaacagagcgagacgccatctcaaaaaaaagaaataataataatagagaacacccctacaagggtcactcgtcttcccattttatgaccatacccatctccttccacagctttttccttgtaattcctgaaaaacactgacttgttctttattactattttgggaatattgtatgaatggaatcatgtagtatgtaactttttaaaaatccactcagcataattcccttgagatttattcaagttgcatgtattgatagtttgtcctttttattgctgagtagcattatattgcatagatacatcacttttcgtttaaccattcacctgtaaaaagccatctgggttgtttctggtttttggttattttcagtaaagctattgtgaacattaggatacaggtttttgcatgaatataagctttcatttctctggtataaattcccaagaggaaaattgttgggtcttataataatagcatgtttagttttataagaaattacaaatttttttcctgaatggctgtaccattttatattcccaccagcaatgtgtaaaagattcagttcatgagtatgagtgagccaacatttgatgtcactaattttattctagctaatttgataggtctacagtgctatctcatgtgtttaatttgcatttccctaataggctaatgctgttgaacatattcttatatgcttatttactatctgtatatgctcatcagtgaaatacccgttcatgtcctttgtctattttataattagattttttttgctatcaagttttgaaagtcctttatgcattggagatactagtcctttgtttgatatgtggtttctaaaaacgttatttctaaaaacatcaacaattataaaaaaaatccatctaggaagtaaaaagtaactgagattttatcacccagtggaatccaatgttaatattttaaagaaaagtctttcaaaatatgtacaatattatacttatctcctcatatctctattctcatctgtaagctctggcttagttttacttgctctaggaggtctttcttttgtaactcctcttacctggattggtcaccattatttttatctaatgctcacagtttttatatctcatactttctatattcttattgacagctttctatgtatttcactttaaggtcaaaaataaataaaataaagtctagaactaaagaatactttatatctgcgctatttaaaaccatagccactagcctcatggaatcatttacattttaagtgatattagttgaaaattaaataatactaaaattcactttctcagttgtgttaaaccacctttcaggtgttcatgtggctaggggctactgtattggacagtgcagatacagaacatttctgtattcacagaatgttttagtagacagaattacttaaaaatgcataattgagacttcttagagtcgcactatagttatcttgttgatattttaccagatatcaactttatgctgtaatttgaccttaaacaatctacttttatgcaaacttgttcattttttttaaagcaattgagattaacaatagatgacctgtattaggaaacttcaaaaaactaaatgtacattttttttgaatggagcattctttatggcaggggctcaaagagaatgggaattaataagcctctactttgtgccaggcatcttcctcttgagatgacattcagtccttgaataactgcatgaattaggctatgttttcttcattttacataaaaggctacagaggctaacagtggttaaataacttgcctaaggtcataaagttttgtttgaccccaaatccctgtagttttatcttatttgaatctgtgttttccataaaaatacctttctatggtacatgagtcaaatctctgtcttcctctcatgatgacaattatgatggcatttagaccccaccaaataatccaggataaatgtgaaaaagctttgtttgtactatgatattcctcatctcccatttgggatagtcttctgtacttttaaacagcactgaccatctgttttagtctgttttcacgcttctgataaagacatacccaagcctgagaagaaaaagaggtttaattggacttacagttccatatggctggggaggtctcagaatcatggcaggaggtgaaaggcacttcttcatggcagtggcaaaagaaaaatgaggaagaagcaaaagagcaaacccctgataaacccatcagattttgtgagacttattcactatcaggagaatagcacaggaaagactggccccccatgattcaatacctcccccttggtccctcccacaacacgtgggagttcagggagatacaattcgaattgagatttggatggggacacagccaaactatgtcattccacccctggcggaaccaattatgcctccccagcagtcccccaaagtcttaactcatttcagcattaacccaaaagtccacagtccaaagtctcatctgagagaaggcaagtctcttctgcctatgagtctggaaaatcaaaagcaaactagctagtacctggatacaatgagggtacaggtattaggtaaatacagctgttccaaatgggagaaattgccaaaacaaagagattacagggcccatgcaagtccaaaatcctgtggggcagtcaaattttaaagctccaaaatgacctcctttgactcaagttctcacatccaggtcatgctgatgcaagaggtgggtttccatggtcttggacagccccactcctgtggctttgcagggtacagcctctctcctggctgctttcatgggctggcattgagtgtctgtgggttttccaggtgcaagttgcaagcttttgctggatctaccattctggggtctggaagacggtggccctcttttcagagctacactagggagtgccccaacagggactctgtgtgggggctctgaccccacatttcccttctgcactgcccttgcagatgttcttcatgagggccctgcccctgtagcaaacttttatctaggcagccaggcagttccatacatcatctgaaatctaggcagaggttcccaaacctaagttcttgacttctgtccacccacaggctcaacaccatgtggaagctgccgaggcttggggcttccaccctctaaagccacagcccgagctgtacgttgtcccctttcagccacaactggagcagctaggacacagggcactaagtctctaggctgcacacaacatggggaccctggatctggcccatgaaaccattttttcttcctggacctctgggcctgtgatgggagaggctgccttgagagtctctgacatggcctggagacattttccccatggtcttggggattaagattaggctccttgctacttatgcaaatttctacagccagcttgaatttctccccagaaaatgggtttttcttttctactgcatagtcaggctgcatattttccaaacttttatgctctgctttcctgataaaactgaatgcctttaacagcacccaaatcacatcttcagtgctttgctgctcagaaatttcttccaccacgcaaagtgaatcatctctctcaagttcaaagttccacagatctctagggcaggggcaaaatgctgccagtctctttgctaaaacataacaagaatcacctttgctccagttcccaaaaacttcctcatctccatctgagaccatctcagcctggaccttattgttcatatcattatcagcattttggtcaaagccattcaacaagtatctaggaagttccaaactttcccacattttcttttcttctgagccctccaaagtgtttcaatttctacctgttacccagttccaaattgcttccacattttccagtatcttttcaacaatgccccactctactggtaccaattttctgtattagtacattttcatgctgctcattaagacatacctgagactgagaagaaaaagtttaattggacttacagttccccatgggtggggaggtcccagatcatggcaggaggcgaaaggcacttcttacatggtggtggcaagagaaaaatgaggaagaagcaaaagtggacatctctgataaacccatcagatcttgtgagacttatttactatcatgagaatagcacaggaaagactggcccccataattcaattacctcccccgggcccctcccacaacatgtgggaattctgggagatacaattcaagttgagatttcggcgaagacacagccaaactatatcaccatcttatagcaaaatgatatagtggtggatgtaatcattcacactgttatagggtcctttacattacacaaggaacacagaattttaaaaatagcttaaattattcatttgtacataattcaaaagcttaactgttttaagaaacatccaattagatatcaagtagcatgtataagaaagaaaattattaggtattctggcacatgcctatagtcccaggtacttatgaggctgaggcagggggaacgttttagctcaggagtttgaggttgcagtgaactatgatcacatcattgcgttccagcgtgggcaacagagtaagacccccatctcaaacaacaacaacaatagtaacaaaaaacaaaagaaagaaaatctaaaattacatgacaattcgtatttaaataatttattttaaaagtttatttctaaataaaaaaccaaaaatattggacagctgatactcagaacaatgcattcaggcaaagctttatagctccatgtactagatggagaatttcagatttcttttttctttttttgagatggagtctcgctctgtcgcccaggctggagtgcagtggcgtgatctcagctcactgcaagctccgcctcccaggttcacaccattctcctgcctcagcctcccaagtagctgtgactacaggtgcctgccactatgcctggctaatatttttgtatttttagtagacatggggtttcacagtgttagccaggatggactcgatctcctgaccttgtgatccaccagtctcggcctcccaaagtgctgggattacaggtgtgagccaccacacccggctcaatttcagctttctaaagaggcagtagtagtcaggctaaacaatgagcaaattgtaaatctgcaagcagttctcacatcatctgactttagtcttgatactcttcccactgtgccatgtccttacaacattttaatggcattttactatcctggagatctagtttgaaatacgggacgtgtgaaaggaattcattaacgttcataatgttttccgtgaattagctaaagtggaatatttatttgtttcctttttttctggaagcaattggcctattgaaagtaattagtgacttgtattcaagtatcctattgtacagtgtcttgggatagatgagcaatgtccaatcactgtaccttatgcctctatttattcgttatccctgcaccagtgggaagtaaataaaaactgaatcatgacccttttctttctttatttgtacatttgtatcttaaaggaactatttatatatttatgatatggtgatatggtttggctctgtttcccccacccaaatttcatgttgaattatgaccccccagtgttggagcaagggccccttgggaggtgactgaatcatgggatcggactttcctctttctgttctcatgagagtgagtgagttctcttgagatccggttgtttaaaagtatataacactccccacttcgctctctgtctccttcttcggccatgtgaagatgtgtctacttcccctttgctttctgtcatgattgtaagttccctgaggcctccccagccatgtggaactatgagtcaattaaacttcttttgtttataaattatccagtctcaggtatgtctttatagcagtgtgagaatagaataatacatatggggattatatactcattaaagataggagccagtgaattcataatgaggatttgtatattgggcaggttactgtttacttttagccaaagctggaatgatttttataggaaggtaatcactttgtaattgcaaactcattttggttaactctagagtacgttaggttgaaaatggaaaaaaaaatagttccaaggaaaaaaagaacttatcaaaaaaaatcagtgaaacagaatttatcaaagaaaatgtaataaaataagatttagaaaaattggaggtctaggagcacaataaatagaaattgctaatgaaggatatgttgacttactggggatggatggaggcaagctagagatttgatcctgcaatccagtcatactggaaatagtggaaccataaaaaaaaatttataaaatggtcccttggcttacagagatccatacattcacaacttgatatggggtgaaatataaattgattttaaagatgttaaatgtgtgaatgaaaaataaaaagggttatagaggtttaaatgattattagataaattgctttcataaatattaagaaaatgataggtgtgtggtggtcatgtatcaccttggctagtttcctggtccccagatgtgtgggtaaacatcagtctagatcttgctttgaaggtatgttttggacatgattgacatttaaatccatagactttgaataaagtagattacacttcataatttgggtgggcctcagacaatcacttgcaggccttaagagagaatgaggttcaacaaggaagaagaaattctgtcactatactgccttcaggcttatgactgtagcatcaactcttctctgagcctccagcctgcaagactgcctttatagatttccaacttgtcgcttactagaatcccataagataattccttaaatctatttccatatatatatatgtgtgggtatatatgtgtgtatatatatgtgtgtatatatgtatatatatgtgtgtgtgtgtatgtgtgtgtgtgtgtatatatatatatatatgttttgtttctctggagtaccctgactaatataatgcagataacttatttttaaacaacaataagatctgtcaacacttgctaaactagaatagtttaacagataatgatttcctgtagaaatgatgattggggggttttggtaactttcaaagaataactaaacatccttacaatttaatgattatattgagatttgggcatttcaattgcctttggtaatctaattttaaattctcatagttacatttctgtattataaaatataactcttttattgatattcttatggaggtttaaaaaaagatcccaactgaattgtattgatggttacattatcctttgttatgtggaacagggccaaaccacttgtttacatttcacatgtaccatgctgtttctcttttatttttcttcacatgaatagacagaagaggtttgctttctaaaattctcaggctggcagtgttttataagaactgaaaccaattcagaaaatgtaatgtaaaacaccatctaaacacaatgaaaatcttagtggggcttctctgcttttcatttaagttccacaatattcaatgttgtagggattgaagctgaagcatcttctggagtgtgagagagaaatagaaacacatgccaaagaacaattccagtgcctctttatacaggtatcttagttaaattcaagaggcatcatacagataaatagaaatactgtttctttccttcttttcctccttggttaaatttttcacttcctgtcaacatagaattcctttatacagttttgtctataacaatgacatttaacttaaaaaacatgttctgacaaacatgttctaaacaaactcaaagtgttttatttttttctattctttcattcaacaacaatcaacagaagaattctgcgatgaaatgtgtgagagttttcccaccaacaagaaagcaatcagttctgcagggaacaccagttgggtgtcttctgattcgattctgacaccatctacctaaagatagtgtcagattccaaaaggtgagggctcagtccccaagactgcctccctcgacttcagatgccagttaaaagctccaagctgtctgacttgtgcctataactgactggctctaaaatggggttcccatgccactgccctacttgggttcgattaatttgctagagcagctcatggaacttagggaaatatgtctgtctaccagtttattataagaatattacaaagagtatacatgaagagatatataaggctgggtatggaggaaggggtatgtatggcacctctgtgccctccccaggagtgccaccatccaggaacttccatatatttagctattcggaacccttccaaaccctgtcctttttgaatttatggaggcttcattacttagagatgatgtaaacctttggccattcatgatcaacttaagctttagcccctttcccctctccacaggttgcgggtggggctgcaagtctcaactctctaaacgtgccttggtctttcctgtgaccagtccctatcctgaagccccctatgggcttcaattccttagcatacaaaacgacatcacgttggagagtctaaggagtttaagagtgatatgtcaggaaatgaagtcaaagaccaaatatgtatcttataatagcacacatttacagtatctgtacaaatcaattatagttttccccatagctgcgcactcttttttcttttatttttattttttctgtttacacataatttactgaatttttaaaaattatactttaagttctagggtacatgtgcacaacgtgtgggtttgtcacataggtatacatgtgccatgttggtttgctgcacccattaactctctacgttagatatttctcctaatgctatccctcaccctacccccaaccccacaacaggctcccgtgtgtgatgtttccctaccccgtgtccaggtgttctcattgttcaatttccgcctatgagtgagaacatgtggtgtttggttttctgtccttgtgatagtttgctgagaatgatggtttccagcttcatccatgtccctgcaaaggacatgaactcatcctttttttggctgcatagtattccatggtgtgtatgtgccacattttcttaatccagtctatcattgatggacgtttgggttggttccaagtttttgctattgtgaatagtgctgcagtaaacatacatgagctgcacgctctttttcaaatgacatatcatctttctggtgtacaataaaagaaatgtaaaatgagaattacatagtttaggatggcgattataaaaaagacaaaagataacaagtgttggccaggagatggagaaatggaatcccttgcacactgttggtggaaacgtaaattggtatggtcattttggaaagcagaatggaagtttctccaaaaattaaaaatagaactaccatatgatccagcaatccagctgctgggcatatatccaaaggagatgaaatcagtatgttgaagagatatttgcaataccatgttcattgcagcattgtatacaatagctaaggcatggaaacaacccaagtgtctgtcaacggataaagtaattttctatagacacatgaaatattactctgtcttaaggaaggaaattctgtcatttgcaacaacatgaatgaatctggaagacatgttaaataaaataagccaccacggagagacaaatactgcatgatctcacttatatttggaatctaagaaagtcaaaccacaaaagcagagaatataataatggatggttaccaggagcatggatggggtttagaattgggggactgtggtcaaagttttagttgtgtaggatgagtaagttctaggcatcaaatgtaaagcatgactatagttaataatactacattgtatacttgacatttgctaagagaataaacctgaagtgttttcattatacacccacaaacacacagcacccatgtgaggtgatggatacattaattagcttaaatgtagttaatcactttatgatatatcacattatacaacttacatatatacaacttttatttttttaaagagtgcataatacgagtcactcaaaaagtgttttgagttcacctttaaaaccaagtcttgattttcctttaaagacacagttttatggtttctctttgcatgaatatattataattttaaaaatatattagaaaactacatttattatcctaattttttgtaataatgtgaatactataataaatataaatacatttttaaagtcaagggagaactacaaatagaaacaatctttgtaaagtctgtaaaatgatttttcaaaggaataaatcatttctaaggtcctttaaaatgtacatctgttgtctaaccaccaacattttgacaacaaggaaactgaagcccagaagtcttatactgcattagttgtagagctgggattagaacctgtacatctttggactcttggtttaacagcttttctctgatgctttgcagttgaaattttcactctaaaacatattataacatggggtgtttttttatgtttttcaatttagtgtagtattattttttgattgatgcagttacaacattaagatatcaaaatttcatttcaactaatgaagatatttacctatatatttttttaaatttagataattaatgaaaaataaatttccactgcctactaccagactactagcaaacagatatccagatatgtacatctatcttatttttcaaggagaaacggcattatttatattctgttcatatactgattagtggcttattttctttgggttactttgcttgcttttagctttacgtcatcctgggccagaccagaaattagttctgtgggtttctacacaggtattacttgctgctgcagctaggaatcaactgctgcccctgactgataggagctgagggccactctcaggttatagaggagagaacataattcaccctttcccaaggcatttgctctccgtggtatcctgtactttgtaagaatgaaatttgaaatgaatatttgtttcattaaatccctgttcccattttctttataaaggtcaacacaattgaaattacatgcaaggctaccacattatgtatttatcttttaaaatgttccctcttgtattactgatgaaaagatataatttcactgttgctgtcaagttaaagtcatgtatgcaaatgttgatattgaagttcctgtagcacagtacgttgagtgtcagaaacatatttattaatatttatagacacaatgtcctcttttgtattcttctttccttcccctcgtagaatgtgtgcagcttgttcctctatacaaacgaactatgtatttttcacttggaaatagaaagtccataaatttagaggaatcttacttttccccccaagaaatgttattagtagtctgttagtgaaaattttttagagcatcctgaaagatttaataaattatgtaatcaataaaaatcttaaaggaagatgtttatatgacaagatcttatatgccttactaaattttaaatgctatttggtactgaatattgaaatccattggtggtatataccactgcttaggttatatatttcattaggagcttatgcagtgattaattatgttcaatattagcaccagcaaaatttatgcttctgaaaccagctaggtttctgcctgatttcttgaaactgtggttattacagaactggggagttgagtattaatttttacttttaatataccacctctttctgacaattatttgtggcatttccacagaggtatgggataaactggtgggtagtgaggaaagaagtaagtgcatgttgtttgcccagaaatccaatccttcagttggtattgtctcaatttcttcttaatgtatgtgtttcttttgatttaatatatgtagagctctggattcatttttcacttcactgcaattactgtagtgtttttctaacaataatgtcgcacttagcagttatcataaaattgggcttccagtcagtgattaggtaaaggaaagtaaatgatctgaatgtatagtttacaattttattacaaaaatgatcctaaattattctggggatcagaagtggaacactgaacatttgtcctctaccactacaggtgtcaaaagttgaatttatgtagcaagaaatagagtattctgctgggggagtaagtagttgagaattttggggattgaggacatgataatgataaaatggaaaggtgatatggaaaaatttctccccaggtaacatcaaaaggtatagttctttcaaaattttagtttagaggttccaaatacgatctgaatttggtcatttaaaggaagaaattagtagggacagaaggagagacgattttaacagatatgtgagatacattgctgcatcttttacaactgtttcacaagttgtcgttagtttttccaacatttattaaactcctgagaaatacactatgctagatacttggaattgaaagatcaatttcatttactgagttgaagaagctttccccttcctggtagggaagggtgatgagacaagaggcaatcatagccttgtgtatgagtactggtctgttgaaatgcagagaaggaagcacttatttcttccaagataagaaaaaacaggtatcagaagtggaatactgtctcaaaaactggttagagagaactagattagaatattttgagcctagaacttatatttaatttttgcttttatcttagctttatgtgattggcaaggtatcttgcctttctaaagggactgagggacttgtcaaaggaatacaagtctctacatcagcggctatgacacttgtcattttcagagctgtttttctttgcttgacgcttgtattagtccattctcacactgttataaagaactgcctgagactgggtaatttatgaagaaaagagatgtaattgactcacagttccacatgtctggggaagcctcaggaaacttgcaatcatggtagaaggtgaaggggaagcaaggcatgtcttacgtggcagcaggagagagagagagcacaggggaaattgacacttttaaatcatcagatgtcatgagaattccctcactatcacaagaacagcatggggggaactgccaccatgagccaatcacctcccaccagacaccaccctcaacatgtgggaattacaatttgagatgagatttgagtggggacacagaaccaaaccatatcattctgcccctggcccctcctaaattgcacatccttttcacatttcaaaaccaatcatgcctttccaatagttctgcaaagctttaacttattccagcattaactcagaagtccaagtccaaagtgtcatcttagacaaaacaactcccttccaactatgagcctgtaaaataaaaaacaagtcagttacttccaagatacaatgaggatacaggcattgggtaaatgttcctgttccaaatgagagaaattggccaaagcaaagtggccataggccttatgcaagtccgaaactcagcagggcagtcattaaatcttaaagctccagaatgatctcctttgattccgtgtctcacgtccagggcacactgatggaaggcttgggctcccaaggccttgggcagctctgcccttgtggctctggtgggcacagcccccacagctgctttcacagctggcattgagtgcctatgacttttccaggctcatggggtaagctgttggtggatctgctattcgggcgtctggaggacagtgcccacttacagctccactaagcagtaccccattagggactctgtgtagggtctccaaccccacatttcccctctgtactgccctaatagagattcttcaggagggctctgcccctgcagcagacttctgtctggacatccaggcatttccatacatcctctgaaatctaggcagaggctcctaaagctcaactcttatcttctgcacacccactggcccagcaccacatgcaagccaccaagacttggggcttccactctctgaaacaatggcctgagccatatgatggccccttttagtaacagctggagctggaggggctgggaggcagggcaccatgtcccaaggctgtgcagagcactgaggccctgggcctgacccatgaaacaatttttcccttgtaggcttctgggcttgtgatgggaggggctggtgtgaagatctctgaagttccctgaagacaattgtcttggcttttaatattcaacttctcattatttatgcaaatatatccagcagacttgaatttctccccagaaaatgggtttttcttttctactgcatggtcaggctgcaaattttccaaacttttatgctctgcttcccttttaaacataagttacaatttcaatcatttctttgtgaatgcatatgactgtacgctttcagaaaaagccaggtcacctcttaaatgctttgctgcttagaaatttcttctgccagatatcctaaattatctttctcaagttcaaagtttcacagatctctagggtagaggcaaaatgctgccagtctttttgctaaggcatagcaaagtgacctttgctccaattctcaataagttcctcatctccatctgacaccacctcagcctggacttcattgtccatgtcgttatcagcatattggtcaaaacgattcaacaagtctttaagaagttccaaacattcccacatcttcccgtcttcttttgagccctcaaactgttccaatctctgctcattacccacatccaaagttgcttccacattttcatgttatctttatagcagtgcctcactcccagtaccagttttctgtattagttcattctcacactgctataaagaaccccctgagagtcagtaacttagaaaggaaagaggtttaatggactcacagttccacatggcttgggaggcctcaggaaacttacaatcatggtggaaggtggaagggaagaaaggcacatcttacatggcagcagaggagaaagagagcacaggagcaactgccacttgtaaaccatcagagtgcgtgagaacccccttactatcatgaggacagcacaggggaaaccacccccatgatccagtcacttcccactaggtctctccctccacacgtcagtattacagttcgagttgagattccagtggggacacaaagccaaatcatatcaatgctagagttttgagaataaggaaaagctgatattattttatattttggggatgaaatgtcagtataattagtacacatagagcaaaactacttttggcttctagaataaggcgttctgttttggttactgatgtttaactatttgcacaccttagatatttgcacacttttttattttattcatgcatatcctgccttcataaaaattaagagcttcatgttagttaacattactttaaaactattttaaaatttatttaaatcacttaaaaagtaacacaaatatataccccatattttgattttctcaattttattaaatttatcttaaagagaaaataaggaagagaaagtaaaatcattaaagatacaagctttggaatgatacctagatttcagtttcagctgtcttagtttccagctttatgctccgaagacatttatctctctttgattcagcttttaaatttgaaaaatagaatactaaaagtatatacctcgtatgggtgtttaaggaaaaatcaagtagtttgccattgtgcctttgaaaaagtaatcatgcagtaagtgctagtttttaataaaacaataatagcagcattgttagcgttatagatagataatacacctgaaaagtgaagaaggtagttttcccttatgttaaaaaatgtattctttattctgcttttctccccatactagtagtaaaatagtagtcaacattcctcataagagtcctggggattttcccctgggagcattaggctgtggaacaaggtcattgtcacctcacttttttttgttttctactatgacctcatgtgtctcggtcacaagtgggtctgagctgggacttcagctcctggctctctagtcttgacctgggcccttcagaacttgaaagttgtctctctttttttttctcattctgtttagggtccttagtagtgacatatcataggaagctaagctctcaagtcttcagatagccagtgtctcacagcagcatttcactgaaaacagtctctgccttctctttaattacaagaaaatgtcttgggaattgctgtacagttgcaccattttgcgaaaccttcttcaacatctgcaaacttcaacatacatggagaggatctttatcttatgtaacaaatgtgacagatcatcattactcttcacttaaacagtgattctgttatgcagtcatgtttggatatccctggagagtggtttgccagagctagcttacaccagcttgctggaggtcatcaggaattttgtgagcaggttgatgtcatcttggtaggttgaaatgagccatagtgagataatttacaccatgaccagcagatgctataataaatcaagtttcctccctcagccagaactggttcaacttctagtataagacctctgacaccagtattcgaacattttgggctggagtagtagtagatgcataatatgcctccttcattttaaacattgaaaaatcctacaaaagtcctaacattttcctctaataatttcacctttagctttttccaccactcctgcagtaaagagccagcacgctctttttatatcttttcaacctatttaataatagcatgcattttggcatttgtgaaatcgttacatttaatttattataacccaaagcagactgtgattatatttgtccctaaatgatgtgaataaccaagggagcgagatattggaatatttagattgcttttcttaagtaaaagtaaactttgcagcaaatattttatttcatttatatcaatatatttaaagtgtatgactataacccccaatttggccatattcttaattctgttaatttattattttagcacgaaatcttattttgaggatagggttgaacaatagttctttggtatcatggtatggatagatctctcagagattctggtttggtagattctacttattacaattgctctttcttactgccaatattgaattctcttacgttgtacccacttagggagatattttaaaacatttatctctagttcttctgtgactattggctccagctctgaagcataatactgaaagagtagtctgactgaggtaagcttcacaatacctttgagtaatgatttgatttagagcttaaatggaattgtagcacattgtatgtatggtcttattttacggtattgaagtttgcacagaaatgatttacagatagtggtccattgttttacttgaagggaccttgatacttactgaatagctttagctatccaaatcattctaaaatgattttatagaagtcattgtggataaagcgaagaacataggggttttttttcctataaaaattcatggcaagcctattgactttctttgagctatggggtaaagccggctgttagataaaatccctaactctcttttaaaacttacaaaggaaagatactttttagtataaattttgaaagctgtaagtagccctagactcctttaagaacttgttcttcactcttgcagaagaaaacagaagggagtgtgccgttattaagtattaggtatactagaaaaaggtagaagacaaacgtctttatactcagttcttattcaaagagtagctgtgtttatgtccttcactttctttttgttctttatacaaaagtagcagcttgaatagaaactgtgagaagtgtactctaaataggaactggtatgtgtgataaagctttaaagggtaaatactttggatctgacttttcacttttattcagtttcactgtattttgtcattcaacttgatgttttcttgtgcttccagattgggaatggtggctgaaacactctctttcattgtttccatgagtctcttagatctttctgctaataagactaaataaatgtgttactcgcagtgacatgatttagtcacaaaaacgtttttctggggatccagctaactgaagttttcaaatctagtcaagcagttattgagcatttgatgatttggcatgggaattaaacaagtgattgtaagaaactcaaataactccttaatggaaaaaaaatgaaaaaaaggcagattaaggaaattgacacttgaatgaagagtttaatatgattttgacaaaaatcctgaatattcattttatatatgttattgtcaaagctctggctaaaaacgattaaattgcaaatggtattgaaaagggaagcattcagcagttggataatccaaatgcaggaaggtgctcccagatcagtcagccgaatgattctaaatggaaacaagtgccaaagaaacctaaggtcccaaataaatgaactaattgcagctttcatctcatttattcatgtacaattatggctttttgtcaaaaaaagtttctgatgatcagaaaccttttaaagtcttcattttccatggatcttggtatatccatttatatcagttgtttcacaatctgctttgaatgtcttatgaactattcttgggtctgaagaaattagttggtaaggaaaaataaatgatgaaatgatgcaaagtaggccgggcacagtggttcacacctgtaatcccagcacttcgggaggctgaggctggtggatcccttgagctcaggagtttgagaccagcctgcgcaacatgctgagatcctgtctctactaaaaatacaaaaaaatagccagcatggtggtgcgcacctgtggttccagctactcgggaggctgacgtgggaggatcacttgagcttgggggcggaggttgcagtgagccaaggtagccaagatcacaccactgcactccagtctgggtgacagaatgagaccctgtctcaaaaataaaataaaatgatataaagtaaaagatcttgacctaatggagaagaatggaaaatatggcttatgtatattttcagttctcattgtaaattcagttcttattggtaaattaccaatggagaaaggatgtataagtgtgtggatgatcagaattactcatgtactctggaagataagaacttttgagaatctgaagttagatgaagtctgtgaatttattggaaagatgatttttgaactatgaaatgaggcttgggaggtaagaaaaccatgtaggcagattcaaaaggaggaatggatgtggtgactctaggaagagctaaatgtggagtgactctgaggtgacaggacccaggtgagctttcaaagacactgtgcttcccaagtccttcttgttctttccaatttatttccagtgatttccaaaggagtgttataatcattgggcttgagaaaattagttcaaagactggaattgtcattaacaactctatttttttattttctctatgaatcaccttgtattaatatttctgaataaaaaaccccacataataatctgtaattaaaagcaactgagtgctcatctttgaactaagatttgggaccatgccaggaagcaaaacaatctcagcctttggccttgtggaacagacagtggcggggaagatagataatgaacagcactgaaatgctacacaagatagataatgaatagcagtgaaaatgctacacaacagaacttacagaggagtctgggagcattaaaaaagggtgctccaaatgattagcacaggccaccgaaaggaagcaaaacttaaacaggtctgtgaatgcaattgagtaacttccataaatctttttccaacaccttctcagtctactagatattctttagaggtaattaggtacttgaatcatgtatgtgattccaaaatcaatgatttagagccatctacaacatactccttccaagtctgaatcagagacttgacatctggaattgtgcagttaatgaaaattggggttggggatatttcagatgaaatattcttggtgctttattatttttaatgaaatgagaagcagcatttctttttagctgctcccctctgagaagttgcactgaagcataataatacaatttttcttttttgtgagaaaggacagtctgccctgctgagaagacatagtggctttgtcttggaaggccattatagattatatattgctcacctaaggttcggatatttcatgattatatattatgatttaagtataaattaactttagaagaacagaaaataattttcttattaaagttgaaaaacatattctcccctttattctctctatccctcattattcatagaaaccctatgtgttacccatatgtacatatatatatagtaacaataagtttacaaatacaattgcactctttttcccttttaaatatattatcttagatatacattgcctatgcaaatctagccaagttaattctttatacctcagttttcacttctgtaaaagagaaatgaaatgattttataatgtaaagtgtttgagcaatactatgcatgcatttagagtttgtcagatattggctgttgttagggcagtccatactgagaaagttgattttgttgaaaatcagtttgctaaagttaaatactctgcattggaattaatcctcagaaagaaaaaatggtggatcgatggagaatgattgagggtatttagaaatgttgaaattcactgaagactactttaaaattgggcattgggagagttgtcccatccttaattttttgaccacactcattaaccatatctaacacatcactgaatcctggaaattgtaattcctcaatttctctgaaatcctgtttgttgtttgtttgtttgtttgttttgttttgttttgtacatagcccagtccatggcattatcattttttggcttggccattgctgtatcttctagacttcgacagccatattctgatccccgttcttcttcacagtgtggccaggatgctcttttataagtgccattctaaatatgttaattatctagtgaaacccactgagtgaccttccatggccttgtgaacaaattcaaaatccattaaatggcctgtgaagactctgagatctctcaaatcacttcttctcaggcttcatttttagctctacgcctttgctctcttttctcagtgtctgacgtgtatcacattctctcatatcccaggaaaattacatgtgctattttctcagtctgggattttctctcttgtttctctgacatttgttacatatgatttagggctcagttaagacatcaccctttcattagagtggccatttctgacattcttgataggattatcatgcctgcattatgtactctaaaccctgatttctataaaatatattggtcctccagttgtctttgtctgtttggctagagcaggtcctgctatcttgtgttgtattaggaagcttgaggaacgtgtcatgaagataaaaattttcgattgcctgtcttcttgtctgtcaagagagtgaccatttaacacaattctgcatatgccttcaaaccacaagactaatgaaaatattatatacacatttgttcatttatttattcatttatttaaccttgatcattcaaaaaaccaattattcctggggtgcctactcctttgaagcataggaattatcaggatatggacacaggctctcttctcagaaaactcgtcttttaatggaaaatcaaacagtaaaacgaatatacataaaaaaatggacgtgtctcacctattagggaaatgcagggaggctttgggtctttagggagagggtaacagggagatcccacccagaggcctagtacttaactagttaagcaggagggtgttggagtcagaattacctgaatttagaatattcagtaaatattagtattcactaataataataataactggtgaggactaatatgtatactagtgctaatataatatttgtgtgaacattgacatcttaaataaatagctaatgctattttcttgaatcttgaatcatgatacaaatatgaatatttctatatatgattaatattttcaaatcattttaatggctttacagtatgtcattatataagttgactaccatttatgttttcatttctctttttaaatatcttcacctttttatactattaccaaaaggtgctttgataaatttgttttgcatatggtatcagtctaatgttggaggaagaacatttgaaaatttgctcctctataaaaacaatacaaaatctggcaaaaatgtcacaatcaaatttttcagaattttggaaatgaaccagtggttttcagcaactcagggagcagttgacgaaaaatcactgcatacaggtaagaacagtgagctttgtgaacttcccctagtgtcatcttctgctctgcctctcactagtggcctcgagaaataacagcctacattcctggcaatgaagatagcagaacagatctagtctcttaaagtcttattccccaataattgccattattggaccaatttggaagacattatttaaaaggtttatcttgacttgacctgaaaagtattgtctcacagtactggaggttaaaagtccaaaaccaaggtgtcagcaggcttggttccttctgagggttgtgagggaaggatctactttgacctccagcatcagcttgtgcacggctgtcttctccctgtgtatgttcacattgtctttcctctctgcatgcctgtgtctatataagtacatcagtcacgctggactagggtccaccccaatgtctcattttaactagattgcctttgcccccagaactatgaaacaataaattgtggcacagctcactttgtggtaatttgttacagaagacttagcaaactaatatgaaaatcatatgctctctgatcacaacatactgaaattagacatcaataacacgggacagtttgggacaatcatatgtccatgtaaaataataaagacactactaaataatgaacgaatcaaagaaatcacaagggaatttagaaaatattttgcgaagaataaaagtgaaaatacaatgtaccaaaacttattggatacagtgaaaacagtactcagtggctaatttatagctataaatgcctacattatgaaagaaaaaaaggtttcagatcaataatctaacctcccaccttaagaaaaacaagagcaaactaaacccaaaatgtacagaagaaaagacgtaataaatgattttaaaggaaacgagttaaacagagaatagaaaaagaataaaatcaacaaaatcaaaagttctatgagaatattaacaacactgataaaacttttagatagactgaacaagaaaaaaaagaaagctcaaatgattaaaatcaggagtgaaagaaaggacttaactactgacttcacagaaataagaagcattataagggaatgaaaaattagaaatcaacagattacataagtgggtgaaacaaacaactcctacaaagatgcaagctaccaaaatttagtgaagtgtaaaatccgaatagacctagaacaagtaaagagattgtattggtaagcaaaaaaagtcccataaagaaaagtgttcaactagatggctttcatgatgaatgcttccaaacattaaacatgaattcctactatgttacacaaattcttcccaaaatgaaaggatgatggaacacttccaaaacatttggtgaggccaatattaccctgatacacaaaccagacaaacccattaaaagaaatgaaaactactgaccgatatctcttagtaaatatagatgcaaaaatcttcaacaaaattctagaaaactgaatttacaggacatgaaaatatacaacattaccaagtggaatttattgcaggaatgcaagcttgatctatcagttcaactcgtagatacatacacaggagaattgaaaacgtatatttacacacaaacttctacacagatgttcataatagcattatttacaatagccccaaggtggaaacaactcaaatggtcatcagctgatgaactgacaaataaaatgtggtttatgcatacaatgaaatattcagttataaacagaaatgaaatactggggtacatgctacaaaacaggtgaaatctaataaattcttcattaaagtatgagctgcatttgtccatagattagaggtatgacttttggatattctaatttgaaaaagagcccacttcattctatctaaccagcagtggatgcttgatgctggatatcacagttgagcaaggagctgtacatttttggatatttggaagtctaagtatgacttccaggttttgatccagggataggagacttttatcccaattgcatagggaggagttctaacaacattccatccatattgcaaaacatgtagttgtaacctttttgaataaaggaataacttaagaaaaagtattgaaaacatcaaaatatcgtaaaactgcgtactatttttatgatataatggggcaaactacctgagcctctccaggtacatgtaatattttttagatgattttttattttactattgctaaaagccataccaaatagatgttaatctccagaacattgattcattgcaaataatttttttttttttttttttgagatggcgtcttgctctgtcccccaggctggagtgcagcggcatgatcttggctcattgcaagctccgcctcccggattcacgcccttctcttgcctcagcctcctgagtagctgggactacaggtgcccgccacgacgctgggctgattttttgtatttttagtagagaccgggtttcaccatgttagccaggatggtctcgatctcctgacctcatggtccaccccgcccccccctcagcctcccaaagtgctgggattacaggtgtgagccaccgtgcccagccccattgcaaataatttttgtcctgtagagttgtaatttatttttgtctggttggaaacaacaaacccaagtatccctgaaagatattaatcattaaaaatactaacattaagatagtattccagctttctttctgtcactgtgtataatgctagtctcttgcattttttatttcaagaaggtttattgtgttgcttgtttcctaattacataactaaacagaattttcacaactgctcattacatattagttttagggacctatgcttcatctttttgaaaattatgctttgacataacatgttgaaaagcttttttttaaaagcgttaaaacaattagttcttgtaataggtggatttgtgtgtggggggcagtgatagaaactcacattcacttaaatccctttaaaaagtgagtggggaaattattggatcacatgatcacaagtgcagaaactgaaggtctgacttgatctagttcgtcatatgttatcaggaatcttttctacctctcaatgaaactttagtctctgtgggtttctttcccaggcaggctgcctccaagtgggagcaaagtacctcagtagctgtaggcctaaaatctgccaggttagcaacattaacaacaaaaagatcttatttcccatcaattaaaatctcctgtctgctctatgaagcatctactgaaactctcactggctgtttttgggtcaccttcctaccctagagccacatgtggggtcagctgagctaatgtgtcagctgagagtgaagaaggtgggcctagaggataaatatagggcagtgacaaaaagaaaaaagcaaagcccctgagaaatgaggatgtatactttataataataaaagatacaatccataatgcatatctaattgttcagtatgtgtcaaatagcaacaatatatatgtttagatacaacatcatggaaatacaaatttaaaaataaaaataaaaacataataggaaaaaaaaaacctgacaagttggtgaacttttgtataatgccatcagcataatggggacgtgtttgctttaaaatcggaaataagacattcctttcatgtattacatgctccaagttaatgtttaacatagaggcactaataaagcaacaaaaattttaaaatgtatgtcttgctgggaaataattacatcaggctgtataacagaaaccaagattattctttgtcccttgttcaacagtactaggactaagcaaaagcaacttaagtgcatattccaggaaatacttgctcctggaagaaagactgtgaaacagctagtttacttatcaaaactaacagctggcccttccagactctcttcagggtcctcttcctgctagattcaccaatccaaataaactctgcccactcacaacacttctctgccttgtaagacctgcctcaagatcactctggccaggccttagaattctataaatatctttcctttacaggccacatactgtatgattctatttatgtaaattttatacaagaggcacatttttagtgggaaaataccttaatttttgaataggcccagtggggctggagagaaatgaagagtgactgctaaccgatacagggtgttttttgggggtgatgagaatgatctgaagttgattgtggtgatggttacaacactgcagacattaaaagcctttggattgcacaattgaaatgggtgaattgtatggcatgtgaattatacttcaataaagcagttacatatctaagaaatgcagtgtaaatagatggacttggaaggttgagcaaaagtcatgtacatttggaaaatttcttcttgtcatttgtttagttaactgctgtttttgtttggctgttccatttttggaactagattccctgtgatcatgatcctaagtacaggaaagaaatatgtggcccagatgacagctgattacatgtacttactttacatcctccagagtccatgataaggataaagacatacagaaaaaaaaaacagtggccacaacattatacattgttgattaaaagtctaattgagtcagaatgtacagtaactgcatttttggtgaacgatgagtgaaggttcacattattatgtattttaaaatggtgaattccattttatatgaattatatctcaaaaaatgttaaaattacctaatttttgtgtttaaatgcctacaattaaatcagtgttaagtcataagcaatttgaataacattctaatgctcattcacatgattaaaattttatctactattatagaaattgagtttttaagtgactacatttaaatattttaatatttttgctacatattttttgttcttaaagtctctatgtaatttgtccatttcttttctactgtgtgcagttaatttactgtttagatggtaagaaaattaaaatttggttaatttctttggtcaatactttcccctagttattttctgtctactattcttgaataattcctctcttctgcacggacttgcagtgcctcctttattataaactgcattcttagatatactaggtttcatgtgagggcaatctatagtattcccaattttgtcaagtaagtgccaataccacattgtttaatttatgttttaatatctagcaggaaaatattccacttgttacatttctttcccatctcttaaagaggtattttcacctgtttattcttcagtataaatattagaattatgtagtcaagttacaaaggaaaaaaaaagaacaaatctcacaggtagtttgttaaattcatgtactggtcatggaagagatgataattatatatttttttcaaaaactgcagttcttaaattatgtttttgttaatacacatataacttctagattaatcataaagagtaatatgttaatacactgagaacttccatattaattaataataaaaaagcagtgatcattcttatttctgactttaataagattccaggcttttactgtttttttcgtaaatggtggagtctgaaataaattttctttattctatgttattctagtttacgatgagatttagtcaggaataggtgctgcatattgtcacatattgtgattttttcccatttgagctcttaatattaattaatattaataatgtattaatattaaataacactcttaaatcaaccttaaattgctcgtattaaactttatttcatcataggacattctttcagtatattgttgagaaaatgttccatctatattcttgcatgaaattgggttttattctcctttttaaatgtattttttgttcactttatgtatcaaaattacatgcattgggatatagtcacaatttctctcataatattgcaacaaaataatccaggcttctcctatctcacaaagaacaaaggaaatgtgaaatcataaaaagaggccccatttaaggaaggaattaactatttattagaagaaactgtgaggcaaatctcttagctcataaagtctgttctgtcacaatatgagactctcaaatgagaattagctgacacacatttggtaaaacgtgaactatgtcagtgtaatgtcaaagttacattaatgtattcatgattttttccagtgttagtttttgcatcagagccagtgtatgtgtaggacacgagcgcagttgactgagcaagtgatgaaggaatacaattctgaatgcagtgtccagagtccttgcatccctccttagggctcgtcatgtgttccatccggaaagtgtgattgcagtcttcctcaattttttttatttttttatttttttgagacagagtgttcctcttattgcccaggctaacacgcaatggcgcgatctcagctcactgcaacctctgcctcccaggttccatcgattctcctgcctcagcctcctgagtaactgggattacaggcatgcatcaccatgcccagccaattttttttttttttttttttttttgagatggattcttgctctgtcgcccaggctggagtgcagtgccgcgatctcagctcactgcaagctccgcctcctgggttcatgccattctcctgcctcagcctcccgagtaggtgggactacaggcgcccaccaccacgcctggctaattttttgtatttttagtagagacagggtttcaccgtgttagccaggatggtcttgacctcctgacctcgtaatcggccctcctgggcctcccaaagtgctgggattacaggcgtgagccaccgagcctggccactaattttgtatttttaatagagacctggattctccatgttggtcagactggtctcgaactcctgacctcaggtgatccatgcgccttggcctcccaaagttctgggattacaggtgtgagccaccgctccggcccccaatttttgtatactttacccttgtctctgttatttatataatcttacatcaaggtactttcacatctttaaaaagataaattcctatattaaatgaagtatttatttattatgaattttacatgtcttttaagctaattttgtcttttatatgatttataattgcttttgtttttttcccttttattaccacttgcatatttttctcagtctcttaatcttactacatgatttttcaaagagagagagagagagaataaggtttatttttatgttatagtaaaaatacctatactctgtctacttaagtagaatatgagaaatctcttctgtgcattgataaagatgttgaatctatacagttatgtgctaaagtgacttcagttaatcgttcaggttgaaatgaaggtctgaaaatgtttaaatttgttcattctctgttccctgcagtaagtgaagattatgtctctttttgttgttgttgaattaattgtaaagagatagagactcttggcaaattattttactatagagcctatattttccttatcaaaagcaaccctccatgttgttatggatatcaaagtttcttttgaaatatgtattaggtaattgtgctaaattataaaatatagctaacatggaagaaaatgagagttcataatttttattgttcatcacttaatataaacttgctgtatatttgaaattttcctgcctgaatccccatttatttgttctcaattattatcacagcctcagttatttctagtacctgaaatatcagtctgatgcattgcctgttctttacagtggttaaaaaaaaaagacatttctggtgaaatgtaaataagttggtataattggcttgaatgtattttgactatttgaaaaatctacttataaaatcattggctaattgacttaggaattttgttttttgttaaggttggtcattttatgtatttaatattttaaatttagagttttaatttcttcttagacacaatatttttaaagatttttaaaaactttctaactattctaattttcttgaaaatactacagttattgtctagttatattgtatagtggttagagattgtgggcagtttgacttttgctttgctgcgtgtctgtgtttgtgtactggtctttgtagtgtctagcatatgatacaattttataaatgtttcatggacattaatattataaatgttctaaggtacacatcaacatacagtcattaaatatgtttcactaaattgttgttcaaaaagttgtattcatatttcttcatctgaaattcttcttttttacttcagctattgtatctaaagagttatatctttcattttctccctgtgctttgacatttttgcatgatgtatttggatgctttcttttccaacactgttctagttatctgttactgcatagtaaattaccctaaaacttagcagctaaaaacaagaagttttattatctcgcaatttctgacagccaggaatatgggaatgcttcactggctgtttctggttctggtatctcacaagcttgagtcaagacgtgggcctggattgcagtcttggctggagctggagggtctgcttccaggaaggctcactcatgtggttgttgactggcaaactcagttcctcactgtctcaacagccaacacaggaggcctcaattcctttccccaggggtctaacaatagggctattcacgacatggttgttggctttttctacagtgagcaaggaggaaatatttgtgccttttgtgaactagtctccaaaattgcacaccatcacttctgctttcatctatttattagaagtgagtcactaagtccagccatcattcaatggcagaggattagtctctacctttgaagggaggattattttaaaaaattgtggacatatttaaaaactgccataagcaaaggctcatgtctgtaaatctttattatagatttaactttatcattttaaaattcgttattgagaaatgaacctctaaattcaatgtaatgcttttggatgtggactgtgaactccctgataatttttttgtttcatttaactaatacatatttacccatcttttggttttaagttcatatcttaaacacatcattaaaattcaatctttgggttacattcaagtttttgtaggaggaattaaatttatttactctgattttcataaatttttttcattactattataaaaaattattgtggtgagaacacttaatactgtatctacccttttatcatattttaaggtgcacaatacattgttactgactgtaggtacagtgatgtacagtagatctctcaagcttcttaatcttgcttgactaaaatttttatgcctcttgaatagtaacttcccatttcctcctccacctagcccctagcagccaccattccactgtaatcccataaattttattattttagatacttcatataagtagaattgaatgatatttgtcttgctgttattgctataatgtgtgtaagagtgctgtaaaataatatgctatcatgttttcagatatatttttcctatatgttcaatgactattatttagataatatacttggttagtatatttcaatgtccttgtatttagaataatttaatattaacttggtggcttgtttttggataatatcactgtggattatcatctcctgaaacccttacacatagcacagatttatataatgtaagaggtcatgttaaaatgtctatgacaatgaaataataagttttcaatgaccaatgtgagcattgttcttgtacatcatttaggataatatcatgatctctgtaaagtgaaaattaatatattctattctgcctttctggctacctatctatagtagaagaaaataggaaaacagctgctgcatatttacttttgaaaactgtaaattaacattacaacataaatatcatgtaaagtgaaataaacacagaaatttcaatgtcctcaagtgactcttaagtcatgtttatgtctaggtgagtaaacaaaactggattaaaattaacattagatatgcaaaaaaggccattgcaaattataaggcagaccttaaatcaatttctcttaggaaatatagtgattttgccttcaggaattttgataagccaaacaattccaaacaattatactgcctttagccatgtgatttttaatcaattttttaaaattttttcttctcaatgtcagtgtctttttcatgaataggtctgtgacatttaaagataaagttctttgatatgtatgtcatgatgtttgtgttttagaaatatttttgtttcccttcaattaaaaaaagtcagtttctctggagcaattggaaaaatgaccagcaaaatgaagcttgaacaagtgcaagaagatcaagaaggattcttttaagcgatatcgaggattttaaactttgacataaatgtagttgaaaatcattgaaagaagcttattaagtgatcactttgcctttaaaaaagatcaccttgcttagaattaagaatgaattgaagtggatacagtggttaggtagaccaattttcagactgtttttctagtcgtagcagcagtaatcttccttggaataaggtaagaatggtgagaagggaaagaagaagaaaaattttagcaatgagaaggtagatggataagttctggatgtgtggagtgacagaaaaggaagtgaaagaatgaatcataggttctacattgagcaactgggtgaacactggtttcttcttagaaagtaaacactggaggaggagtaattacatttggaagagaagtagagatgctgaattgagtactggaaaaaattagatacatcttgtgacatatccaactagagatgttcagaagatatttagcaatattggtctggaactcaggctgctggcctaaatggagacagtgtattactgtctaagagaaaacgagacacaaattgctaataccagaaacaaaaaggggacataattgcagattccatggacatttaaaggataataaaggaatactacgagcaattctatgcccataaatttaataacctagatgaaatggaccaattccttgaaagacacatgatatttatatgaaaagaagtagacaacctgaatatgcctatatctgtttaaaaaattgaatcaattaatagtcttccaaaacagaaagcaccaggcccagataagtacactagtgaattttaccaaacatttgaggaaaatataccaattctctacaacatctttcagaggatagaacaagaggaaatacttcttcattctatgaggctagctagcatcactctaataccaaaaacacaaattacaagaaaactacagaccaatatttattgtgaacatagttgcaaatcctcaacaaaatatcaaattgaatccaacaatatataaaaagatatatactctaaccaagtgggatttatctcaggtatgcaccgttggttgaacatttgaaaatcaattaatgatttcaatatgctaaaaaacaaaaatcatattgtcatctcaatagatgcagaaaatgcatctgacaaaatccaacatcaattcatgattaaaactcgaaataaattaggaatagagaggaatttcctcaacttgataaagaatatctctaaaaaacctacagctaacatcatacttaatgaagagaaactagaagctttcctagcaagatcaggagcaaagcaattattttctctctcacctctccttttcaacattgtcctgggagtcatagctaaggcaataatacaataaaaggaaagaaaagacatatagcttgggaagaaataccactgtttttgtttgcaagtgatatgatcatctatgtaggaaatccaaaagaatcaacaaacacaaaacacctggaactaataatcaattatggcaaggatgtaggacgcaaggttaacatacaaaacttaattgctttcatatatgtcagccatgaacaaatgggatttaaaatgaaaagcacaataccatttaaatcagcaccaaaagtgaaatacttagataaaaatctaacaaaatatgtacagctctatataagaaaaactataaaactctgatgaaataaatcaaagaactaaattaatggagagatactccatgttcatggataggaatactcaatattgtcaaaatgtcagttcttctaattcagcctgtagattcaatgcaatctcagtaaaaatcttatgaagttattttgtaaacatcaaccaattctaaagtttacatggagaggcagaagatccagaatagtcaacacaatattgaaggagaagaacgaagttggaggactgacactacctgacctcaagactttctataaagccacaataaggcagtgtgatgttgtaaaagaacagacaaatggatcaatggaatagaatggggaccccagaaatagacccacataaacattgtcaactgatctttggtgaatgagcaaagacaatacaaaggagcaaagatagtcttttcaacaaatggtactagaacaactggacatccacatgtggaaaaatgagtctagaaacagatcttacatccttcacaaaaatcaactcaaagtggatcatagacgtaagtgcaaaatgcaaaaactggctgggtgcagtgactcatgcctataatcccagcactttgggaggccaaggtggtcggatcactaggtcaagagttcgagaccagcctggccaatatggtgaaatgctgtctctactaaaaatagaaaaattggctgggtatggtggcaggctcctgtaatcccaactactcgtgaggctgaggcaggagaatctcttgaacccaggaggtggagattgcagtgagccaaaatcatgccattgtattccagcctgggcaacaagagcaagattccattaaaaaaaaaaaggcaaaaactatgaaactcatagtacataatacaggagaagatctagataactatgggtgtggttatgactttttagatggtacaccaaaggcacaatatatgaaaaacataactgataacctagacttcactacaatttaaaagcccttctctgaaaaagatgatgtcaagagaatgagaaaacaagcctcagactgggagaaaatatttgaatatttgcaaaagacacatctgataaaggactgttatccaaaatatacaaagaactcttgagaatctacaataagaacacaacaaacctgattaaaagtgggccaaagaccttaccagagacttcaacaaagaaggcatacagatgacaaataaacatgtgaaaagttgctcaacatcatatgtcatgagggaaataaaaattaaaacagaagtgagatactactacagacatattagaataaacagaatccagaacactgacccacactaaatgctggtgagggtgtggaccaacagctctcattaattgctggtgggaatgcaaaatagtgcagctactctggaagacagtttgtcaatttcttacaaaactaagcatactcttacactatccagcagtcatactccctgcttttacccaatttagttgaaaacttatgtatgtacaaaaacctgcacatggatgtttatagcagatttatttacaattgccaaaactccagagcaaccaagttgttcctcagtgggtgaaatgtggtacatgtagataatggaatattattcagtgctaaaaataaactatcaaatggtgaaaagacatggaggaaacttcaatgtgttttactacatgaaaaaagccaatctgaaaatggctacatacagcccaattccaactgtatgacattctggaaagggccaaagtgtatagacagcaaaaagatgaggggttgcagggattttggtggagtggggtgaaggattaataggtagaccatggagcaattttagggcactggaaaactctgtatgatactataatgatgaatacatgtcactaagagtgaaccccaatgtaacctatgtactttgggtaattatgatgtgtcagtataggttcaccagttgtaacaaatgtatcattctcatgggagctattgataatgtacaggaaatatatgtgtgggggcagggagtgcatatgagaatttgtaatttttgctaaattttgctgtgaacctaaaacttctctgaatatattggtacaagagttaaggatacatttactcattaattgttgatgttcttgtggataggaagtagagtgaaaatgatatagtgtgaatgggcacatcagaattgtagttcattaagaagtagcgtggccttgaataaaattttttgatttttctgagatctagtgataaggtttggctatgtcctcacccaaatctcaccttgaattgtaataatcccacatgtcaagggtggggccagagggagataattgactcatgggggcagtttcccccatactgttcttgtggtgaataagtctcagaagatcttatagttttataaatgggagttcccctgcacaagcactcttaccttccaccatgtaagacgtgactttgctcctcattcatcttcagccataattgtgaggccttcccagccatgtggaattgtgagtcaactaaacctctttataaattacccagtcttgagtgtgtctttattagcagtgtgagaactgactaatacatctagttttctcattcacaaaatggagcttataataactacatcctgggttattgtgaggactgaatgaagtaactgaaccagagcatttcatgtggtgcttggtacatgatatgtcatcagaaaacagtgattcttggtgggtgagaatcagctataaaataagtagctataaattcaagtgcctttggctatggctcagtgaataaagagtaaatctttaaaaaatcagagtgaaatggaaaattgctcagagatgaaaattattgtcattatatttattgctcagtcatccattttattttatctgaactataaaagagtaaggcaggcaatgtgccaatctctgtttactgttttcccaagtaaggtaaagaagacagggcaaagtttcatggagcttccataaaatagagttgacaagagttaaacagcatatgtcatcaaagtgacaatatatgtgcaaatacttggaatagcgaattccatggtatgtcagggattgatgtgataattgagtcgaaaatatgttaattttgggaatagagattaaagaaaaatgtattaaaaatgtattgtacaatggggatagcaaataatagccctgagaattctagatttatatactgcggagtcagagatgacctttgtttcttttctgtttgttctgcagagacatcgaaaaagtagaacttttgaatttgaatgaattgatttaatgagaatgtatttggttcttaacactaggagagaaagagcaacattattcatgaaaaattatggtcaggatgtggtgtttctttggggtaacatatagatttttggtagcaaagctgtttatattgaggcaggctattgaaatagtttaaattttaattctggttaatatatagtaagtacatattttacatactggtaagtgatttagactaatacatgaagcctaaaggatcaagacaaatattaacagaaagtaatattggatgtgaagtgaatttcagaatctaattttattttactaaaaaagtaaactggatttttattctattataatcattgtgaacattatgtactgtatttccttgctattacttttaatgatcaatattctcatattagagatgaaatgagtctgaagaaggttgttaattgccccagtggtatggctgaggtcttattctatgctcttgattccttgttgtttttttccacctaaattatcttatttgaaaagcttaggagtttatggcatagttgtgcagaagatggacacagctccgtgaataagcagtattttattgttatatctaacgtgtaaggaattgccgagaccagctcgatctgggagactctaacccagtggcgctagaggaattaaagacacacacacagaaatatagaggtatgaagtgggaaatcaggggtctcacagccttcagagctgagagccctgaacagagatttatccatatatttattaacagcaaaccagtcattagcattgtttctatagatattaaattaattaaaagtatcccttatgtgaaacgaagggatgggccgaattaaaggaataggttgggctggttaactgcagcagaagcatgtccttaaggcacagatcgctcatgctattgtttgtggcttaagaatgcctttaaggggttttccaccctgggcagaccaggtgttccttgccctcattcccttaaacccacaagcttccagcttggtcgttagggccattatgaacatgttacagtgctgcagagattttatttatggccagttttgggaccagtttatggccagattttggggggcctgctcccaacaggaatgttgtattttatggattctaatacacacattttctggaaaatattttaccatctccaaaaccagaatacatcttaaagttgaggcatggtattaaatttaatggtgcatcatggttcaactggcagtatttttgtttttaaatataacataaaataatagtgaatattacagttaattgtgtctttgatttgatgaaatatggtacctgctgtgtgtgtcttgaagagtaaatataaatgatttggacaaaatgtatgaggggtatgtggtaatcagggtcaggctgggtaaatgagtttgaagtagacaatatttttcctgaaatattttctttcactctcacaaggttgtgatgcaaattgaaactctagtttaattcagccaccattacctgtctttctcatttctcagaagagaatggagaccggtttatgcttggattttttggaaggcagaaatagcataactaacatgtaaactccttgcaggcaggaagaatatattaaatttatactccttctcctttatttttttaaaacacagttagagctcaataaatgcctgtagaaatgaacctagtgcagtgtgcatttaggaataaaaatgagttttctaaatgagttttctgtcacccagttcaatctgtatatgaggtaaaatgttcccagaatttctggaagttttctgctacggcattagtttgtctatgaaactgatggattaatttttgcattctgtatttgtaaggcatcgttttatatgagacttgcaaatcactttacaagttccaaagtgaaataaatatttttacatattctttcattaagcaaagttatgtatttctaatgtcactgtttagcaataattacttactctcattaaaagaaaaacaattctctggaaactgcaaaaggaataaaaagctctcttaataatgtgcagctgagatcagtttgatttttaagaagagtgaaattaaggagtatatatttaatatagcccaaaagattagcaatgaatgaaagatgcaatagtcaagaccagtgatgttatttatcgttataggagtttttgttttgaaactttatttaaatgaagtttggaacattggatatcttaaatatttattaaatttccctctacattcaaatttaatacaatccatttccctttgtcctatcattcccttttaccaccactttttatctagtaactacatatctaaccaaaataaaactggaccttctagtttgcattctagagcttgacaatgattttaaaaagacaaaagcatttaaactttttctacaccaagtttgtttacctgtcaggctaggaaacatgcacataaaggtgaatatacacatagacacacacacacccccacacagagatacaacagagacacatacacagactcacagacacagagactcaacacatgcacgtggacacatacatgtatacacacaggcacatatatgtacacagacacagactcacagacacacacatacagagacacagacacagcaccacagacacacacaccagtggagaaattcactaaataatttgctgaaggggcaaagtttcagttttaagtggtaaaaaagcagtttgtgatggatctgctaattaaagattgaaagtttactccctaaggtaggacaaacgaatccacagatctgtacataattggttaaaataaatccttttcaaaacaaaagctattgttctttcatcaagaaagagtcttcttaggtccaatgggagtctggtatattagagtcagtgcaagtgctgggtccttctgtaacttcagcttgttagactctgtcgtggtgaagcatagtactccgttttcatgtaacctctccgtggtgttgaatttcaaacaaacccacatctaattttaaaaggccttgaaaaataagttattacagaaatctctgaggtggcagagagagacataacacacaggcggaagccctaacaatcctcttcacttatcttctctcttagcccatctcccacttttatgtcttcaaacaagaaaagaataaacaagcaacaaagccttagcccacacaggcttcccttgcattgagggaaaaatgactgaagaacagtatcttcctttcttttagtggcttcttgccttttaatttttttctaatcaaacttttaattttgagataattatagattcacatgtagttataagaaataatacagattccatatgcccttcacccagttccccccagtggtaacattttaccaactagaatacagtatcaccaccaggatattgattgatacagccaagtgtaggaaaacggcctggcccgtggaaagagggacactatacgtatgcaaaaacatgatagccgatgtttgactcctgcatgccaaggtgatcacagcaaagtcaagaaccaatgcctgtagtataaattactcctcaaaaagatgcttatctaacttccccggtggtaacaaattttgtaagagcatctggtacatgactaactgcacgtgttttaccagaaaagctcactatatagaaggatgttttctgggggcgagtacagagatccaccatttcttggccaccagagacttgcttctcttattaagttcctattaaatgtttatttctgagaaactagatttgtcaacctctttctttggcctcttagctcccttggcctttgcgggtaggtttgcatagaccagctgtattagtctgtactcatgttgctaaagatatacccaagactgggtaatttgtaaagaaaaagaggttaaatggactcatagttccatgtggctggggaggcctcacaatcatgacaaaaggcaaaggaggagcaaagtcacatcttaccttgcagcaggcaaaagagaatgagaaccaaatgaaaggggtctccccttataaaaccatcaaatctcctgaaagttattcactaccatgagaccagtatgggggaaaccgcccccgtgattcaattatcttccattaggtccctcccacaacacatgggaatcatgggagctacaattcaagatgagatttgggtggggacacagccaaaccatatcaccagctcattggaacaccaaggtgtagaatgtttccatcaccatgaggatccctggtgttgccctttcatagccatacccctatcccttccaccacttctgacccctggcaaccactactttgttctccatttcaattattttctcatttcaagaacactatataactggaatcatacagtaagtgaccatttgagagtggctttaaaaaaaaactcagcataattcccttgagattcatctaagtgatcatatatatttagtttattcatttctattgttgagtaccatagtttttttgggtgccattcagtggttaaagatcatctggattgtttccagtttttgtattggaactaccatttgatccagcaatcccactactgggtatctactcagaggaaaagaagtcattatatgaaaatatacttgcacacccatgtttatagcagcacagtttgcaattgcaaaaatatggaaccagcccaaatgcccatcaatcaatgagtggataaagaaattgcagtatgtgtatatatatatatataaaatgtgtgtgtgtgtgtatatatatatatatacacacacacagacacccacacacacatatacacacacatatatacacaccatggaatactattcagccataaaaaggaacaaaatgatggcattcacagcaacctgtatagaactggagacattattctaactgaagtaactcaggagtaaaaaaccaaacgttgtatgttctcactcataagtgggagctaagctatgaggatgcaaaggcataagaatgatacagtggattttggggactcaggggaaagggtgtgaggggggtgagagataaaaaaccaaaaattgggttcagtatatactgctcgggtgatgggtgcaccacaatctcacaaattgccactaaagaacttactcatgtaaccaaacaccacctgttccccccaaaacctgtggaaataaaaaataacaacaacaaaaaagaaagctgctatgatcgtttgtttacaggtttttgggtggacgtagtttttattaacctaggctaaatacccaagaggagagagttgctgggtcttatggtaattatgtgtttggttgtaaaagaaactaccaaattattttccatagtggctgcaccatttaccttcttgccagctatgtatgagcgattccgtttctctgcatcctcgccatcatttcctgctgctccaatttttcactttggctgttctgagagttgtgtactgatattgcattgtgcctttactttgcatttcccttatggctaatgaggttgaacatcttttcatgtgcttatttgcctgccttttaaatataaacaatttatctcttctctttactttccctttcattgtttaccttgattagcagatctactattcagcccccatctattttgtacctgcctctaagcttcatgaaagggccttgctgttatgtctggtgagatgttgctgacccggagagggctgatgtccagccccagggctccatcttctgttggtctcagttgttcaggtgacagagcagagttagattctaggcagagtacagaatttccttgactccaattctctactgaatacagtatgtaagatttttaaaagcactattcattcccagtatgtcacagaatcctttcattcaaacagattcctcatattctctccaaaactgcttgaacaagtacgtggttattagtcgtcagcccagtaataaatacattgcaagaaaaagatgttctcagatggcaaacataatgtgcaaagaggcatttctgccttcaaataaataccttttacattagtcccagagctttagccgtttaaagcacaggttctacagcttctgattggcttatgaattctgttgttgacttaaagtccccaaggactaccagaaaaacgtgggattgagacaagctaagtttattaagccttttgcaataaggaaaaactctgttttgagagagtcttagcaaaagctcaaaagataaaagtcagggggagcatattttttaagttttaggccatgaactgggtggttttaaggtggagcttacagaataggaaaggaattggaattgacagtttctactgaagctgtaactttggaattggttgttgctgagaagtgaggctgtcaaaacaattcttggtgagtaagttgttactcttggtaagtaccatgtgtatttgctcacagtcttatcatctgggagcaggtaattcctggagcatacaactagcttattttacttggtctcggtattagttaacttaaagataggaagtgacattttatcctagtactgttatcaccgggaaagggaagcatattgttttagttacacttcttgcctcttagtttcaatctacccatcattttgtggcttataatattggatgtggaccatgtaaatatttgtcacttaccagcaggcatgatgctaagcactgttagtataaggtgctggagggacattgcaggaagaagggactttgttctggatccagtgtgatcctctgtgcttgctcctgtagcacttggttagtatgtgggacatccagtgacactcatccctggcacgtttgagtggcaataccattgcaagtagcttcctaaagagtttctttggcaatgcttgaggacaattttctagagatacgttgagactgttgccgtcctcagtgtgttctgctttgtcccccaaaaggtggttttcttctcttgtgctagactttttcatcatccatgaaggtcatggctgcgccctctccagtgaggtctggatctcagtcatgagggggttggacttccacgtttgttcctttattgagtgctttgccttagccctatatattcctcctgtgtccactattggtatatttttagagttagtttttaccttttcatattaatagttaatttcttgttcataattctttatggtgaacacttactggtcaaattactatgagggtttttgtcttctgattggatcctcactgatacagaattactactagattggtctcaggagccatatttaaaaagattggaatttgggattggtttggtcatgctctaggatttgaacacagtgttgagctctttgtgtatggaaactgggatgccagaaatctactgcatgcagaatcagcctaacacctatggttgactatgatgaaagccaactgaagcaggtgcgtagcaaactgacagtgctattgcattgaacattatagcagcaatgatggctacaagatgtatgatttggaacaatttctcctagagcacactggagtgcttactgaatgaaaacaatgagctcagcgcttgaactctcagctaaagccacagactgagaaccagggagcttctatgatggccataagtaatagttactctagctagagggctgatactgctaaaactaaaaacaaaattaaattgcttttggtttttgaattttattgccaattaattcacttcttgccaaatttttgtttgaaagttaggttactaattgggaaagaatagaatcctgaatgaacttggaatgtgtacatatacttggacccacatgaaactggctgtattgaacccctaagtcattctgagccttccttaccacttgaacaaaactgcctcctcctgtgtctgaggtgactaccccatctttgcttgaaaattttgtgataacctcaccaggagcaggggctttgaaaatggatgctcattcttctcatgagttaagacaggcagttcaggttgttcctagacccattgcaaggggggaaatttcagcatactccagggtaacaggtacagactataacccaggggtagatagtttacatacaaaaataatgtgcaagactttgctattacatatattctgaaatctggggaacattgtaagaatagatctgaagggtactagactaaagaggccagaatgtaacaatcagtaaggctgaattcattgatacgactgtacttattagagagtccagatataggatgttatcttgtgcaacttgagttgactccaatagcttacttggttggtttcctgaaacttatactcagtggtgttctgtgttaaatgagtttgagatgccagagcttccctggcatgaattggagaaggaatagagatatgggagtggatttgtcaagtgatacctacatgtgtatctcctacaaggttctgtgagatgacctagaagatactctactaaggcattgggaaatacattggtgaggatagtaccttagtctttgaaatgatgggtctggatctcagatcttttgtcctccagactataggggatatcaccattgatatgtgtttgctgatttcagctgtgataatggaaattccagggtagtcaaagccaagtgacagttattaaccaccaaagacaaagtggactcactgtgtaggcagagacatgccagtaatcacaatgccttagcttaaagggatttggggcagttgctaattggtcacagtgtccatgagaacaaatagataggtagcccactggagtatagcttcatttgtcaaaccagtgatcccagatgggtcacctacttgtacacaaaggtcttgcagcaccctcgttgtaaacattcccacaaagaagaattttcctagactagccagattttctcccagcagccaaccctatcacacatgtattaatgtgattttttttaggaaaaaaaattaatgttataattaaaaaaaaaatctgaagaaccagtagccaaaagcagcttgagtcaccacagtggagagttctgactcttgcccaatttccagaccaaagtcaattcaatggcacagaactctgtggttgaagcctagcttgtgcctccttaccattttataccacacataccaaaactcttccttcaagccttccccaaaggcacatctagattttactagagtgactgtgccctgaggaataggaaatacccagtgcttttggggttactgtctttgaactgtcactaatttttggttcctggagaccctccaaattccgagctatcagttaaaataggagtttacagtggccagaagatagatggaatcttacttcatttcttacttaggatgggcttagtggttccatggacccagcctgtgattatttttttcagttgctgaatgtgtaatttcaataattgtaaaataaccacaccagcacattaatccataggatgagggccattatggtaggaagggccaaatgcaagcccctggaatttcacttaactctaccccaatagcaaaccagaagcaatactgcatctttgggggaactgaagatgtcaatgccattatcaaagacttgaaaaaagtctttacacttctatcacacctcatttaattaacctgtttggtctgtgcagaagttaggtggatcttttacaataactgttagtaactgtgaactattgtaaatttcatcagtggtcactcgagtgctggcagtttttccagatgtattatttttactgggaaaagtcaacatggtacctagtaatttctatatagctatgagcctggcatcaagaaaatgtctttacacttctatcacatctcatttcattcacctgtttggtctgtgcagaagttaggtggatcttttacaataactgtcagtaactgtgaattattgtaaatttcatcaatttacaatagatgaaattgtaattaaatatgcaatgtggtcactctagtgctggcaggttttccagatgtaatatttttactgagaaaaatcaacatggtacctagtaatttccatatagctacacacctggttaatgactgtttagcaagaccaatttgcaagttatcactagaaatgtgtacagcttgaatgccatctactttgtaccattacagaggtttcaaaattgtcttgcacataataattcaatacatatttactgagttaactgaactcagttatctctgaataatatctctattcctcctccagttcatgccagggaagctctggcatctcaaactcatttaacataggccaccactgagtttaacgggagttattccctcaccccttaaaccaaacatgttatcaaaagagaaaaaggagcaacagtaaaaaaaaaaaaaaaaaaaaaaaaaaatagagaattcacaatgcaggtaataagggtaaaagagaacaaagccagccccaaatatctgatgatctatggatgactaaaatgtggaaaagaataaagtacagcatgaaaattcattcaacgatgtgtgtgcagtcaccttcataagtacatgggggagttctccaaatatttaggaaaagaaatcatacactgaatgtattgtctagctagcatatgttctatgattaaaccattctttcttttaattttttctttctttttttgagacagagtctcactctgtcgcccaggttggagagcagtgaggctcaccgcaatctctgcgtcccaggtttaagtgatttcctgcctcagtctcctgagtagctgggattacaggcatgcgccatgatgcctggctatttttttttttttttttttggtatttttagtagagatggatccacctgctgtggcctccaaagtgctgggattacaggcatgagccaccacgcctggccaaggaccattatttcttatgtatcttgctagttcttaaggaaataagattactgaaaaagtaagcagtttgttcttaaaaataacccagaaactttcttacaagacttctgtgaataggaccaagtatttgagagctctgttctggaaacaaacttgtctctaaaccatctttaattttaaaatgaaggatccatattaaaaatttttgttagaaatatgtataattgtgcatcgtagagaaaaaatgagttttgccatttaaagtaattttacatattatcttttttatttttaaactatcatttactatcctgaattatgcttaggtttattactattggcacaaaacaataatagctaacaataaattctattgtcaagttctgttaaatctcttgttttaaattttactctgtgctaaaaatcgcaagtaacaagtttaaaattacaaaaattggcacattattatatataatttattcatggagactatatttagaaaattctaaatcagcctattaggtcctggttatacagattcacatacacaaacatatgcacctgcacagatatggaccgcctgctaattaatgttcaaacatataagaaaaaataatatcgggaattatgatttgctgttccgtgtagtagcaattaaaaaaaattctgaatcagacacttgcacaagccagaaaatgaaaacggttttagatttccagaaacatttttgatgctgacatacatttcatatcttagacatctttcagggttgatagttataatcaagattgcatatttaattaaatgaaactattagcaacttcacagaagtttaagcagtatactatgttataaatagaacgacttaattgctattcatttctttagtcatgacacaaataattatgggaaattgccataatgaagaatgtacatacacatgctctttgatatctacatgtgaaatcagggtgggactaagctgtgtaatccttatttctgttgataataccagcgaagttctttgcctcccttccctcctcaggcttttcccttcactctgaccaattccttcctcaatgttgctgccagcctcctctcggaggaccctcttctctctgaccatttccttcctcaatgttgctgccagcctcctcccggaggaccggggaggagggtcttactagtgttccagctggattctctcatcatgactcctgcctagtgcctctgtaactagagttggaagtgagtgtttcgccttggtgtcccactcttgacccaaccaactcctcttttgggcttcaacaaagctgtcttattcttggcaccctatctaggaatctggacaaagttccacatgttggattcaaaaaccatttcagtgacagcacccaatgccttgctaacacgaaacatgtgtccttttggtgctttttatctttgaatgaatttggccacctgcccccttaccatcatcttcgtggtgatttcttcttttaggagaagattttctctttaagtgacaatatattaatacaatgccaaatatgatctataccataactccttaactggtggatcatgtcccactggtatgtcataaagaggtaacaagtcagctaccatcttaatcaattcagcccttgggacaacttggcaagatctgggtacaaacagcctcgtctctttaattctgtataaaagtttggtactgtattgttttggggctttatactttctgccatttcaagtagcatccttgggatacagacagatatgaataatgtagataacgatttagcaatccaagaaaataattggcagaaatgagtgaattttaatgtatttgcaaagcaatctcatgagcatgtaactcagaacagcatgtggcagaataaatcgcctgcagactgttttctaatctctgtcatcttaatggaatagcaaatttgcttataggtatccctgagatatgggtgtaaatggagataaatgatatatttgaatttttttccaggtatcaaatatgggcttttgcagtctaaaaattatcaggcatattatcgatttttgtttagtctttaagtgatttacaagtcttttcaatatgtcgccttcaaattatactgtatagtaacacaaacaaaattcaaatattcatattttataaattaaataaaataattcaaggtcataaactaatggctgacttttctaggtcatggttagttatatgatttttaaatatttatatttctgtggcttttttttgggggggggtcggtgggacagagtctcgctctgtcacccaggctggagtgtagtggcgtgatcttggctcattgcaacttctacctcctgggttcaagcaattctcctgcctcagcctcccaagtagctgggattataggcatgcaccaccacgcctggctaagttttgtatttttagtagagatgggatttcaccatgttggccaggctggtcttgaactcctgatctccggttatctgcccacctctgcctcccaaagtgttgggattgcagacatgagccactgtgcctggccaaatatttatatttcagtgaaaaattagagtttatactgcttcaacaatgtacagttgttagaaaaaatttggagtttatactgcttaagcaatgcacagttgttagagaaagtttggaatttatactgcttaagcgatgtacagttgttaggcagacatcggataatatttgcttaacttattggcccagaacaaaaggcagtaaataagtaagggagcagtttggggaagaggctgttattggcagggaatcctaggcaagatccaggaaatattgaagtggaagagactattaatgttaaaattaaccagacatgtacttacagccatggttgtttgtcctaggcgttgcgcctggcacactaatgctgaacaaatgtaaccgactattagttatattattaatgagcattatctatatattttgaaagactttattcatttcctagaactgccataacaaatatacacaaataagttggcttaaaacaacagaaatttattctttcatgattctggaggcagaagtctgaaatccaggtgtctgtggggttggttacttctggaggctctgaggatgactctattccatgtttctcttcaagctcttcgtggctggtggcactttttggtgttccttatcttgtagacccatgatttcaatttgtgctgctgtcttcaaattgccgtttcctttgtgtttgtcttttcttttaattataaggacacttgttactggatttagggcccacacagtaatccagcatcatctcgtctcaagatcctcaatgtaattacatgtgcaaagacctttttcccacacacggtcacatgtgtaggcttcaagtggacatatctttgtgcgtgggggtcaccaatctactacagcctcaaaatgtattaaagtcagttctgagtttcttaggaaactatgtctaaaatatttacttaaatgagaatgagttgaatcatttatcaaaaatgcaaatttctggccgggcgcggtggcttatgtctgtaatcccagcactttgggaggctgaagtgggcagatcacgaggtcaagagatcgagaccattctggccaagatggtgaaaccctgtttctactaaaatacaaaaaattagccgggcgtggtggtgcacgccagtagtaccagctacttaagaggctgagcaggggaatcacttgaacccaggaggcagaggttgcagtgagctgaaatcatgacactgcactccagcctggcaacagagcaagactctgtctcaaaaacaaaaacaaaaaaatttctgaactatttcccagatatctgattgagtagttgaatggctagtatgtgagtattcagcaagcaccacaggtatttctgatataggtaatccttacataaatttttgagaaacatagcagactaatatttgaggtggctgaataaaatatttttctcaaacttcactttagtaaaaggaaaagcacatcatatctatatgaaattatattttaatacttttcaaaagggatttaagaggtttttaattttgaaaactgattagtcaaccaaaatgttgagtaaatattcatcaaaataaaccatttgaaagattatattacaaaattaattatttttcttccaattctttttttttttttttgagaaagcaaaataaaacttgaaagcatttagcagtgactgggaaagaaaaggcaaatgcattagagtacagaatttgggactgtctctattttgcctgtttccattggctcccatcatcatgcttttatttcagatcttgtcctgtatttggatctttctcagggccagccttgtcccataagcatgtgactccatttctacagactgaatagttcaaatatcagaattaaagtcatttaaaggaacctggagatttctttatttttaggagtggttcaacgtggtatatatgaaggaagctgcatgtgtatttgtgtatgtgtgcctgtgcgtatgagtatgcaggtgtagtatgatgtgttttaaaagcagatattcttatcttttgtttagatgttctctacacttagtgtatttctaggtcctccatgttgctaattgaaaatggtgtttttaactaaaaaaagggggattaacacagaggtcaaaggttatagcatttctgggaaataaataattgcaactcaggtacactgaatcagggcagccctgaatagtgttctgtatgccaagctcaggagaggttttttaatagagatttccacacaagttgttttcagaagcagttatttggctgggcagaaatctgaaatcacaaacccattctgattggttagttaattaggatactgccagctgagggatattgaaggctggaggatacagactttagttgtttgtcgaagtctgttggaacattctgtggtttgaccttcagcaggggtaactgcagtcctctcccaatctcccaactccactttagaaagccttagtcttagttacttaattttcttttgttcggttataggtgctgatatgatttggctctgtgtccccacccaaatctcatcttaaattgtaatccccgcatgtggcggaacagacctgtaatccccacttgtggagggagtgagctgataggataatgggggcagtttctcccatgctgttcttgtgacagtgagtgagttctcacgagatctgatggttttataagtgtttgacagcttttccttcacatgctaacacactctcctgccaccttgtgaagaaggtgcctgcttcctcttctgccatgattgtacatttcctgaggtcccactagccatgtggaagtagtttactttataaacctcctttgtttataaattacccagcctcagatagtatgtttatagcactgtgagaatggactaatgcagatgcctattaatgccttgcttctcaaagtgtgatctatgactggcagcattgtcatgacatgggaatttattagaaatgcagaatctttgccctcatccagaactactgaatctgaatctatattttagctaacttccctaaggtattcctaggctcattaaagtttgagaactgaacaaacttataaaatgcttcagtagatcagcagttgcttttaatataggaggcaatctttataagggtttctaggatatgatccttagtgtgcagctgggtctgtaggaagatttatatctacaaattcctgagttgtacatcacattgctagggaaaaagtagagcttttattgaaaaaaaaaaaggcatgaaagtttagtgtttttttcttgtatgaagacgggtccttagaatttttcaaatattttgtctttaaaattgtctaggtttgttaatgatcaatataaattggaaggccaccagtacttatcttaaaataggctttccatagcaaatcatgtaccatatgttatttctttttctttctttcttttttttttttttcagaaggagtctctctctgtcgctggagtgcagtggtgcaatctgagctcactgcaacctccacccccagggttgtaacaattcttctacctcagcctcctgagtagctgggattacaggtgtctgccatcacacccaactaattttattgtatttgtagtagaaacagggttttaccatgctggccaggctggtcttaaactcttgacttcaggtgatccacctgcctcagcctctcaaagtgtcgggatcagaggcatgagctactgctcctggctgttatctcttttttaatgtaagatgtgtccatgaagtgttataacatgtaaaatacacactgtaaactgtattaaaaattagtacagttgaaagctgaggcaagatagaaagaaattgaacaacagaccaaggagatataaaattttaggatatgaaagtgtcacttgaaattagtgaggaaagatattttgttcaataaatgatattgggccacctatctaaacatttatgaaaaagtggatttttaaaatatcatacccaagataagttctaggtcagtgtttctaaatattgtttttgtcattggctgcaacaagtcatataaaatatatatgtttctcctaattcatcctctctctctgtaattttaaaaatacagatatactctacatcagtttctgtactatggccctttggagcgtcgttaacaattttaatatataacatttttgttctccctagcctcaacaattttgccccattggaggtggtataacccccaatgagaatgcatgttcaagaatctagaagaagtagagttttaaatgtaacaaaataattgctataatttgaatgatggcatcctttccaaaattcgtattgtagcttaatcctcattttggtagtattacgaggtgaggcctgttgggaagtgattaagtcaagagtacctctcccttcatgaatggattagtgccttgtaaaatggctaaagggagctagcttaggccaattttccttctaccttgcactatgtgaggacaccttgacagtgccttctataaggaatgggtcctcaggagacactgaaccagctggcttcttgatcttgaacttccccgccttcagaaatgtgagaaataagtttctgttttttataaattacccattctcatgtattttgttacagcaggacaaatggacgaagataataatgaaagaataagataacaatttaagtgaaggtttgtaattttagagtgattaagtcccttcggaaaaaatgattaaacagaaaatgcataaaagatatactcatatattaagctacatattttgaaaatctattgaactataaaagtcgccataaacaaacttttaaaattttgtgtctatgtccatcccgacaaatagacatcagaaagttaatgtttttttcttattgagattatgcatttaaaaattttcagacatgcattttccacagtgagcatcacaacaggttgaacatcccagatccaaaaatccaaaatccaaaattctcctaaatctgaaactttttgagcactaacatgacattcaaaggaaatgttccttggcatattttggattttgaagttttggatttgagatgctcaactggtatatctgaaaaaaggttcaaattcccaaagcacttgtgttccaaaggattttggttagggatactcaacctgtattatacttagaaaatatttaaaattatagctttttaatgggtgcctatgattatgttatttaatccacttacctatcttacaaggatcttgctatattttccactagatatttgagaatatatgctttcgagcaattacccaaattcctttagttagtaaatgttagagcttgaatttgaatctcagaatccaagtgtttaaagttcctgtaatgtatgatttttctctgtgctatgttttaaaaattagagccatcggtgatttccaaactcatcaaccaaaattttgtaattgttttgcttctaatttagatgtagtttgattggcccattgatgggatgcatacactttataaacttgggactcagaattttgggaaagtcaagtttcttagtcaaattgtcttaattagaaaagtacataactctttaattagtttcttttatgcataaagtcaataatctattaaaaatcatagcttgcctcagtagttttttgttttcctggttgatttctgctgtatctcccttgtctgatagttcagtctgtatgcagtattcaaaattcttgttgtatttggctttatttttaatgcttctggtctttgcactcctcacagataaatattttatacaacattaatggtccttcttgtatagtaagtcagagtttattttacctccagagtcaatatcaacttttaattaataatttgtatgcaagtataagtaatgcctttctcctgtatttggagataaacatttctgattttaactctttgctaattccttgaaatgtttcagatagaggaaaaatgattttttagaatcttttctgttttgtccacttgctgagaaatgggaaggggaaaagatctggtcattaacagagaatgtactgcatattttttgttttcatcctattttaaactttttgtcttgccaagtaaggatgcctcaaactgacaagcacagtaacaattatgaaaattttatgtgtaaaaatatatattgtgagtaggtcaggagttcaagaccagcctggccaacatggtgaaaccccatctccactaaaaatacaaaaaagtagctgggtgtggtggcacacacctgtagtcctagctactcaggaggctgaggcaggagaatcacttgagcccaggaggtggaaattgcagtgagccaagatggtgccccttcactccagcctacatgacagagcaagactctgtctcaaatatatatatatgtatatatacacacatatacatgtgtatgtgtatatacacacacatatacgtgtgtgtatatatacacacacatacgtgtgtgtatatatacacatatacttgtgtgtatatacacatatacgtgtgtgtatatatacacacatatacgtgtgtatatacacatattgtatatatacacatattgtatatatacacacatgtatatacatatacacacatatatgtatatatgtgtatatatgtatatatgtgtatatgtgtatatatgcatatatgcatatacgtgtgtatatatgtgtatatacacacatatgtatatatacatgtatatacacacatatgtatatgtacatgtgtgtgtatatacacacatgtatatatacgtgtgtatatacacatatgtatatatacgtgtgtatacacacacatatgtatatatacgtgtgtatacacacacatatgtatatatacgtgtatatatatacacatatgtatatacatgtgtatatatatacacatatgtatatacatgtgtatatatgtatgtgtatatgtgtatatttcactataaagtagaataaaataacttcgagttaaaggacagtctgtatctgttcgttttgtgttgttacaagggaatatctgagacagggtgatctataaagaaaaaaggtttatttgcttcacagctctgcagactataagaagtgtagtgccagcatctgcttctggtgtggcctcaggaagcttataatcatggctgacagcaaagggggagccattgtatcacatggtgagagagagtgagcaagagaggggaggaggtgccaggctctttaaacaaccagctctcagatgaactaacagagcaagaatgaaatcatgaccatggggagggagggcaccaagctattcacgagggatctgcccccatgactcaacaccatccactaggcctcacctcaaacattgaggggtcacatttcaacatgagatttggagtggacaaaccttcaaaccatatcacagtccttcccaaaaaaagatagtcataaccttataccagcagaaattttacttctaacacaaagtttaaatattcaacctattctaattcttatggtgtgcttatttcctgatccttttgtcaatctgggacttacattcactcccaattatttgtttttattataattgtcccaaatccatggtcacaaaggcataccggagaaaaggaaagcaacttttaatacagttcccctcaattcagaacattctggcaatactgagagaagttgaacaatggcccctgttactttgattcttcagtgatctcctgatgttctgggaagaaatgggtgctggcaagccaggttgctgtaacgagttgggcaaagttttacacaattcaggtccagggaagcacaacttggttcctcgtttccaaggcagagctgtcacgaattcatctggcaatcatgaagtagactcatagacaggctcctttgtttgttggctcacttacaaatcagtggtgcaagcacatttgcctgggtcacatttaatctccttacgacagctacttttaagtgttttagtatggcatacgcatacatgcaacttgctgagaatcgatcatttcttgtgtagtcattacgctaattcagagatgactgctgtcaagattttttaaagcttactttctgatcctatgcgtattacaaagtaatgaagctgaatatctttagaggtagtcattattttcatttaaaaatgtatttaatgagtcatcactatgtgaaatgcctcttaagagctcaaactatagcttatattcagtataacactgataccctttactctcaaatatttgaccctataaaattgttttaaacctgtaaattttatattgataattttttctagtaccagtatctaatttatttcctaattatgtattatacaaacatattaaaagcattttacagtcttggacactaagcaatatggaggtaagacttggttgaagataatctaaagagataaatgtggagagataaaattaaaatgaactctgataagagagtaagtgcttcaacaaaaatgaaaatttatccctcttcaaagttttatcgtatatatatgtatatgtatgtgtgtgcacacctatgtgtatatgtctatctatgtctatacctgtatctatttctagtttgtcactacatcctgccacttggtttattatctctagtaaatagttaagagagcctcaaaatttgtagaaaaaagatgacatttatcaccaagggtaattatttaccatattctttttttgtggtaaaattgctaactatgatgtaaatgtagaatgtccaaacatttgtatacaagttgaatacagttagagctacattctgatttgccattttggtttctggaacttgtttgacctaaatagctaagaataaaatactgggaatagggagatttggtttctagtctctgatgagctgtgtaattttagataagccacttaaaccaaagacttaaactttagtctttggtttccatgttgtaagataagatatgatttaaagtctaacatactttgtaattccaagagtccacgaggtagaagagagtcaggtgcttcaagcaagtacaagtatcagaatcagatgagacagtaacagaaatcctggagacacagttttctggagtttgattctaccaggtcaacaataggaacaataagggaccgacagaacaagcattgacattaaaagtctttaggaaaaaatatgaattaatatgcaatcagaaaggagtccatttgtatatcagaaatcacatgaaaaatattagaaagttatagagttgctggcaagatgaagtacactatatatgcatgcctagcgtgtgccaagtactgaggtggtcatcacttgattttattttacctctcaattgccatgaaagtaaagggatttttccctaaaacatgaattacctatacatgaagattaagtgattgagtctctggtgattaagtgattgccttatatcacattaagttagaacttggactctgtccatgttctaatactcctaatgattagttacaacactggttgccaaacctagttgatcgttagagttctgtaggttcagtttaaaatacagatggctaggaatcatcctagagtactagaataaaaactctgggcatgatgccatggaatgttttgtaagagagttctccaatataatgcctccttgagaaagatggtgatcaaaaatccatgcaggcaagaaaaaggtctgaagagtagtgactgcatgtaccacattctataatatttgactattgaggcagttttctgccacttctgaagttttagtttctgtgtctattctagttctatccatctcaaatcctataacctattttactacattgaatttgttgttgagtgttcaaatactgaaagataaaaatagtttcattttctttcttggaacaaagtcttaaattatagtataaaatggtcaagttttaaagaaaattgcatttattgaaataaatgaaatgttaaccccacgtgagtcagatgtatttgttctatgaattgaagcttattgctaattgatactttgaaaagtcctagtattatccacttaaaggtagggtatattgaaaatgcattttaacaggatgtatttgcaactggaaaatagagatgttgagaataacagagctatacaagaaagtattaccctttagctagcatataatcttttattcctagggagaacacgctattttatatgcatgttaaaactgtacccactggcagaaaagttttactgatgctgtatgacgtttaattcaatagcctgcagcttttttgttcctctgtgtatgttaattagaaatttctttaaaacttttttagttttaatgaaatacaatgtatatgagaccaattgggtggctacaagatgagaaaattgagtctttttcccattgctaataatttaagtaaagcggctattttctttaggagtatacttataagtaaccatacatttaaaaaactttttatactataccaattatgtttttaatgccttctagttgccacgttactttcagtgtcaaagaattctaaaaaataaagagaatacaaacagaaaagtattaggtaagaatatattagatgtcaataatacagtaattttggcaacatttatttagcatgaaaaccgataatgtcagaatatgaaagaagtagtaggtagaactgtcctgaatattgtcagtcatagcagtgtaggatggagattaccagaggctgaaggatgggaacattgggcagacagatgttggtcaaaaggtacaaaatttcagttaggcaggaggaataaattcaagagatctatcttatatcaaggtagctatgactaatagcaatgtattgtatgcttgaaaattgccgagggtagattttaagtgttcttatcacaaaaaaaatgattaatacatatgttaattagtttaatttagccaatacacaatgtgtatatatatatatatattgaaatctgttgtacaccacaaatatatataattttacttagtagttagaaataaataaaaaattatgtaggcaaagtcagaggcaataaatggacagcaaaaaataaacacaactaaaacaacttaaagtaagtatattgggaaaaatatacattgcatcaggagattcctaacgggtaacagtacccagtgttgaagtgtttgaggaaactttttagtttacaaaggtgtttgccaaattagtgtaaccacagggtgtgttaacacatgcagagattagcagcatcaggaccacgctgcccctcctgatgccagggaaagagatgtgtttccagagcctgatgagagctgcaacaatggaaaggggcccttctgccagcaactgttatcttaaaggcatatggctaagtcagaatatcacaaaagcagggaggaagcagaaatctcctgtcatcgcctcctgctggccaaactcagctgaagccaccaactaaaacaaagttctgtatgctgaattcacataaaactcttaatgtcacacttagcagattcagttgattgcttacaatatttagcttctggttcatctgtaaaaaaaaaaaatttgtatgtgaaaaggcagaaatacttcacatgttttccttcttttcttgtatcagaatttttgcattagttctgtatttgaccttctctctactccttactcatttttgcataagagctctactgcccaggcttgaggttttcctaaaatactgtgaacagattattggttcttcctgtctccctaggcactatatggattctcctgccataaattgactgaagggttggatgattgtggacttccttttagccgcttagctgtcaggtgggaattgtggaagtagttgggtctttgggaaattcaacttgggaaatgtggttaattttctgtatatatttcttgaaatggtgccagtgaagctgagctcagctagctaaggagttaaaatataatatcgcagtggggagagctatttgaattatacattggtctttccaccacttttctaccttccagagactcagtaatgccttggctactttggaaagaagtccccttgcagaagagccctagggtctgtggactttgtctttggtgcattattaatatgttcttctacgctgctaccttccctgactgttgttgatgccttcctatgcagttggctcctcacctattgttgactttcttcctccatgtaatgtgccagaacattcacattgcatgttttccttactgtggcaagcttctgtcataattatgaaacttggtcataaagaaaaaaatggcactctaagggctgtgagcttcttcttctaaacgtttgttactatggacttctcaaaaagttgttgatttaaggttggaaatacagctctaaaatgggcattccttgtctttttcatagtctcctgacacctcttacccttataccaatatattggtggctatatgtggtggtttaaaatatgtccacagattctttgacattcctttcgaaagatggaacctaattccttctcccttaagtatgagctggacttagtaacttgcttctaataaatagaataaggcagaaatgatagtgtgtgatttctgtggctaggccatgaaagatattgtagtttcagccttcctctctcatcttgggtcactgtctctgaggaaagccagctgccatgttgtaaggatgctcaagcagtgacatgaagggttcatgtatccagggaccaaagcttcctgcccacagcagcaaggaactgaggccttctgccaacagccatgcaagtgagccttcttggaagcagatccttcagctccagtgaaggcttcaaatgatagctctcctggcttgtcttaaatgcaacctcatgagagaccctagtctagaaccatgtagcaaaactgctcccaaattcctgatccacaaaagctgtgagataatatatattcattgctttaagcagatagctttcaggtaatgtcttatgcagcactaggttagtaaatcactgttcatgttttttcttccagaatttactaccccctttgtcattttagcaccctctcatagaagagagttattggtaatttcccaggatgttcttgaagagaagtttgattcaaatttcaatgtgttctccaaatctgatagtatgaccctaatgcagtccctgtgttttaggatgatgaaattttcatctataatcgcctttcatttttttaaattttcatttgtttctagaaggaaaaatgtgtagtctggtctttactgtgatttttgattcatatatatatatatatatattatgctaatgcttgatatccacttttaaaatattttcaaagtagtaagtaattaacgaatgtaaattttaggccgggtgcggtggctcgtgcctgtaatcctaacactttgggaggctgaggcaggtggattgcttgagctcaggagtttgagaccagcctgggtaacattgtgaaaaccggtctctataaaaacataaaaaaattagctgggagtggtggcatgtgcctgtagtcccagtcacttggaggctgaggtgggaggattgcttgagcccaggaggcaaaagttgcagtgagccgagatcacaccagtgcactccagcctgggtgacaaaacgaaaccctgtctctaaataaataaacaaattaataaattttaaaggtttactttggaaaagaaaacagaaccaatggtcatatttccctttgtaattattttaatttcttgtgacattccatgataattgtcatgtactgtcacatgtgggattcaaccagagagccatacaggtttccctcggaggtcagggcattacatatctgctctggatgcccctttggcccggcatgtcctttcagctgaacatttgctctttgaaaactcaaatgtcctcttctttatctacacatcttattgttccttatgtccttattctttcggaccataactttacccatgtgtgtaactataagagtgctgtaacattttataacctgcatctgttccatgtctctcttccctcttgtcagttctgctacggcatggaatcacactggactcaccactttatcctcagctctgtcatctgaaccacattgaatacgaacctgcctctacctgctctacttgtgcatcctagtgttcttactccttaagctcttacagttgagtttgcatcataatatttctttctttctttttctttttcttttttttttttttttttttttgtgatggagtttcgctctgtcacccaggctggagtgaagaggcgcgatctcggcttactgcaacttctgccccctgggttcaagaaattctcctgcctcagcctcccaagtagctgggattacaggcacctgccactacgcccagcttttttgtatttttagtaaagatggggtttcaccatgttggcctggttggtctcgaactcctgacctcgtcatctgcctgcctctgcctcccaaagtgcatcataatatttcctggtaatttgattgctattagtaagagcctcagaattagagctttacggtattttaattctttcaagtaacttcttgggcaataattttatatcatataagagatataatatttcacagaacacattttattataattaatctcaatacttaaggtgcattttgaaacagagtcttgctctgtcacccaggctggagtccagtggcgcaatcgcggctcactgcaagctccgcctcccaggttcatgccattctcctgccttagcctccagagtatctgggactacaggcgcctgccaccatgcctggctatttctttgtattttgagtagagacagggtttcatcgtgttagccaggatggtcttgatctcctgaccctgtgatctgcctgccttggcctcccaaagtgctgggattacaggagtgagccaccgtgcctggctttaaaattttttggtgaaaataaatataacaaaatagattaaatattattaccctttataaaatatcatatgagtaataatagttgctttttcttgaatgaaatttttagcatccttacctaggcttggaaatttttttctttagctttcccacctgagatctagccaaaagtatgatcctagctttgctcttacttcaatttaccctcttccactttacttacatcataagcaggtttttaaattgtttgcagagaatgtaactgtttgacatagaaacacctttggaagcagtcactgagaatgttattatgacatgtttcttgctgcattggcaccctttaggataagctcttaccatccaccttcctattccttgccatgcacacaatcattgttgttcttcgagtcagaagcttgtgaagttctcttggttctatattattttgcccatattcatatattcattaagttattttatgtattagtccattttcacactcctgtgaagacatacctgagactgggtaatttataaaggaaagaagtttaattggttcacagttcagcatgggtggcgaggcctcatgaaaccttcaatcatggtggaagatgaagaaaacatgtccttcttcacatggcagcagcaagggaagaatgagtaaaagagaaaaagcctcttgtaaaaccatcagatcttgtgaacttaccatcaagagaacagtatgggggaaactgcctccatgattcaattacctcccaccaggtccctcccatcacacatggggattgtgggaactagaattcaagatgagatttgggtggggacaaagtcaaaccatatctttacatatgtgtctatgtgtgtgtccagtttttactatgtagtatatactatattctgtgtactctaaaaagtgtagagacttttagagaaaataaaaagtagataggaaagtagagtggaagaaatataacactattttggccccatcatggtcagcttttgtaaagttggatttgtactgtggattctagattttgttttcagttttaatctgactttgtcccccagttgacccttatactcctcccttcatccaagatctggattcttagtcttgctctgatctgcctgctttcattatatggctggtactgccttctggtttcttctccagtgctagctactgcttgtgccataactaatccctgagaaggatatatattcactaatatattttgtagttgcatatttatttgcaacatcaatttgcttgtgcataaaatatttgtaatttcaatcctgcacaatttatgagtctcttatactctaaaaatgattaaattatcaatgcagggttttaacatttaaaactcagtgtaacgacttctcaatcattaagataatctgaagaaaattttaaaatttctctctgtctcacacacacacccacacacacaaacacacaatcaccaacaaacatgagggactatatatataaattagaccaacttcttactaagaacagttaggaaatctccaaaacatttacaaacatttgcttgaagatatcagagagccagcctgctaacaaataattataggaccaaagtccaagagaaaaatgaaacccaggatgctaaattaggcttagggaggctttcttgcttgtgttttcagattctggaagaggcaagtgagaagtttgccttggtgtagacaaaatgtctacaccaagtagacattttaacagattcacagggctgcagtgggggaatagaacttggaagttagtacttgccatggcagtggtttagactccaaagatcttgtccttaggtgtaagctaatagtagaaataaagtgtttctccttggaatggaaaccagacatagaacaatctcagttcctgattatatcaaatggatatggacttgctaatatttctggtaaactccaaaggatcaaaataaaatattctctggagaaagataatatcatcacaggcttcaagttatctctttaattttccatataaaacagctggtagtcaaacaaacaaacaacagcagcaacaacaacaacaaaacagacatgagaacacttgaaaacatgatagaaaactaaagaaacaaaagatagagactcacagaggttccagacaatggaaatatcaaacacaaacttgaaaaaaatgatgtgtaatttttttaggatatggaaacacaagattgagatttttggcaatgtaagttagatttaacagcagaaaattatttaatgtaatttcccactttgaaagatcaaaggagggcaattatggcatcctgtcaatgtaaacacaagctcaattggtaatatttaatatccatttataggccaggcacggtggttcacgcctgtaatcccagcaccttgggagtctgaggcgggcagataacttgaggtcaggtgttcgaggccagtctggccaacaaggtgataccgtgtctctactaaatatacaaaaattatctgggcatggtggcacccagctacccggaaggctgaggcaggagaattgcttgaactggggagatggaggttgtagtgagccgagatcattccactgcaccccagcctgtttaacagagtgcaactccacctcaaaaataaataaataaataaataaatctatttatagtaaaaacatttagcatctaggaatagaagtccatttgataaagatagctataaaggaatcctactgcaaacattatacttaataataaaatgctgacagccttctctcttagagtggaaaggagaaaattatgttcactatcaccacttctattcaaatgttatcagatgtgtagagaaagaaggtaagtaaaagaaataaaaggaatatagttggaaaggaacaaacaaaactattattcactgacaatatgtttatatattccatgatgtatatttgaactattaaaattaataagtgaatttagccaaggttgtgaacatgaggttaatattaaaacatgatttgaatacaccaataataaaataaactttaccaagaatatatgccaagaccgaaatataccaacaataaaataatatttaaaagagacatgtccttgaaaatggcacaaaagtatcaaatgttatacctagtactgatcatattcctacatgggaaaggtgaaatattattgaagaaaagcagatacacaaactcagaataatcgcaatcaaaattttgtcaaggttttttttgttagaaactgaaatgctgatttcaaaatgtatatgttaatgaaaggtgacaagaataagtaaaatagctgagacacccttgaagaaagaggcaggaggacttacactttctgatatcaagagtctaaatttcttgattgctgtgattctcaagatccttaaatgtaaagtgcagataaaaaaataggattttttgaaggtgaaatgagatagtgcaatacttaccagtgtaccaggtatgttgcaaaagcttaaaacgtagaaattattatattatttatgtcatcttattatgagctgaactgtatcttccccaaatttgtatgtaatccctgctacctcagaatgtgactgtatttggagatagggcctgtaaagagctggttaagttagaatgaagccatcaagaggcccaaatctaatatgactgatgtccttgtaagaagtggaaattgggacacatgcacagagggaaggccattggaaaacacagggagaagatggccatctgcaagcgaaagagaggccgccgaagaaaccagtcctgaagacaccctgatcttggacttctggcctccagaattctgagaaaataaatttctgttgtttaagaaattgttaagtttttttttgcgaagttacagtaaataagatactattggtgcccaatgagatagaatccagtcatgtagaaatacattcaaaaacatatgaaaatttgatttaaggtaatttttctgttttgataaatttgctggttgggttaaacaatccaaagaggaaaaaataaaacttatctctagaacatacatacaaaaaatcaattctatgtgaatgttgatgcaaatgtaaaagataaactatcagtaaatatcttcataattttaggataaggaatactttttttagaaagacataaaattcattgataatataagagaaaatttggactatattaaaaccaagaacttttttttttttcatacagagttttgctcttgttgcccaggctggagtgcaatggcgcaatcttggctcactgtaacctccacctcctgggttcaagtgattctcctgtctcagcctccctgcctcagcgggattacaggtgcccaccaccatgcccagctaatttttatatttttagtagagacagggtttcacaatgttggccaggctggtctcaaactcctgaccttaggtgatctgcccgcccggtctcccaaagtgctgggattacaggcatgagccactgtgccaggcccaaaactaagaacttttgttgataaagattccattagagaatgaaaggtaaatcacaaataggagtggatgtttgcaacatgcataaccaaataacaaaaatataagacatccctataaatcaatagaaaaaagacaagccatttttgaaatggcaagttcttgaacaggcattctacaaaataggatatccagatgactaataaacataacaaaggtgttcaatctcaattagtatcagagaaatgcaaattaatggctcaaatatgaaaagattgccaatactaaatgttgacaagatgatgaattctcatatactactggtagtaacatagattagcaccatcattttggagacagttcactaattttgaacatatgcatactataacccagcaatcccacttctgtgtatatacccaaaagaaatgcatatacatgaagactaagagagatgtaaaacaaagttcataacagcattatttgtaatactcaaaaagtggagacaactcccatgcctatccatactaaaatgaatgtatagattgtagtccacttatgcaatgaaacactgcagcaatgaatatgaatgtactgtaactactctcaaaaacatgggtgaatcttaccatcatgatgatgagcaaaaggaatgaggtatactgtgcaattatattaacagttaatatgcagctcaaaaatatgcaaaaaaaatctgtggcgtttgacccaaaatagtggttgtgtttggggggtggagggagcagctgcaagaaggaccacaaagaagtcttccaagatgctggtgatggtgctttttgtgagtgtttgtctgaactgtccactgcttatgtgtgttatgcttttaaaaattagaatatgcacatagtttgcagttgagctctgtgtattaacttctgtctacgtcttctgaggttttctcttttcattttactgtttaagtcatattaacatgtgaaaaagtaaaaacctgagttaaattttgaaaaaagaaaaaacaagaaactatattcttctttaaagaattgatttcttggctggcctgagggtagtggattatcagaacttattaacatcagtgttactgaagttggtgtacaaccccccaccccccaccccactggtaaatttgactggctttttataaaaaaatttaaaaaaagatttcttgatcttattcaagataaacattgtcttgcatgtactgtccttttttaaaacttaaattaattgcacgattctgctttaaatatgatagacaaacaatttgcggcttacaatagagcccagttttatatagacttatttatttatgtaaatgttcttaagcttcaagtttccatgatataatcttttgaattaacttctcacttccctagtatgtgttacctggctatatgtaggaatataagattgtttcaaagggcatactagttaaggacaagggtattagtctgttttcacactgctataaagaactacctgagactgggtcatttataaagaaagagctttaattgactgacagtttcatatggctgacaaggcctcaggaaacttacaatcatggcagaaggggaaggggaatgcaaggcagcaggatatatatatatatatatatatatatatatatatatatatatatatatatatatatatatatgtagagagagagagagagagagagagagagggagaggaagtgctacatttttaaaccatcagatctcatgagaactcactatcatgagaacatcatggggggactgcccccatgatccaatcaccccccagcaggtccctttcttgatatgtggggattataattcaagatgagatttgggtggggacacagagccaaaccatatcaacaagtcttgagttatattgcacaatattgattttgtggtcttgggaagagttctttaacttttgattagtttcagtattcaaaatggaaatatttggtagatatgcaaccttacgattaaaaatgtaaatacatttagacatatgtttataataaatttggggtaacaggctaggtatattagacatgtaggaagaaacatttcttgtattaacaaaaatcagaattatgagctgaaattatagagaagtgaaaagcaacttctaaaatgtttcaatagtatttgtactagaaaatcagttttcaagctgctctagtaatgtctagttattggtaactccattgttttgcaaacaactcaaacttctttgatttttctgggtggtatacttatgcgttaataacgaagttttggaaatttatgttttaggctatttatagtgttattttaagatgaaatgagttatttacagatagaacttgctttaaagtcatttgatatacagagtataagtatacaactaaatcgaagattactgttttttaaatgtctctttgcaaacagtagtttcctagtatctgacaaatgatctaagcatgaccttttcaagtctatatttatgcataaaataaggcatatttgtattgttgtcctcatataaaaatcttttttaactaaaataagcaatgtgtcagtcagtttggctagggaactgttttttcatttaaccttcaaatcagccttccttgcctccctacctcttacttcctacattttgacattcattcagcaaatattttagagggacttcttccttatctttctcttttatgaaacattttacaggtttctgtagtacacactgatggttcttgtcttaatcatattacatttatgttttgaaatatcattttattatgttttactctttagctgttttacgaattctcttcttctaatgagatcataaattcctgaaagcaggaactgccttttcttattctcccacatatcaaagaacagaatgtactcaagacaccctcatgaaagagagttttatggttgaagacttaagcttgtgtgaatgaagtctaacacttttgagagatcattgtttatcaaatgtctcctgcattgtatattatgcttgctctatgctattaaagtaatgagatttctgactcagtactcataatgtggaaccttgcagtaagaaatgatgaacagcttcaaatcacctttaatgttagcttcacattgaaaccactgcaaatcatctatgctaccttatacaaattgagtgtatttgaaaggctaaattgagcagtggaaactaacagcactggtgtactcttcttttggctgggagttggagaggcgtcttttcatctacaggtgatttgcattttcagagactggctaatgctcataaaacattagaaatctatacatacagctatggtaaatattcttaggcctcaaatttgtaccctatgacctttagaatttacttcccactttgcagtcatatgctacctggctacatgtaggaatttcagattgttccaaagagcataccaattaagaacaagtttctgctgtcacactgccaaatattgactaagtggctttgggagagttccttaatttctctgagcctcattttgcattgctgagtagagggaatgatagtgccacttttatgagagagttggaggattagaggagataatcctaaacaatttttccccctctacaggtgatgtattctcctcatatcacacagaaaataaaataggtgagaactttctaacttaaaaattataccctcaaatttaaattgatttcatacatcttcacctatcctttcttcctgccattcatctctaaacaagagggacctcttttcctttgcaaagtcagtgctagacttgtgctcttgatctctctttcttctttacctttataaccttcttgtgttgtttatcccttgtgtcattgcattttcagtttctttcattcttttggctctggcactttctttccagcctataaaattgtttgtaggctaaaaatttgacctggcagccattggagctgctgtgtcattgtcttcttccctttttaccaaacttaaaataatttctgcatactgtatggattttaccaactttccctttagttaatatagtcactgaataatccaaacttattacaaaaaattaggggtggaaaattttctcccattatctcttcaactcaccaatctgacttctacatccactttattgaaatgactttgccaaagatcaccaataaagctttagtttccaactgcctaatttttgtgcagtatttgatgtctttgaccgtctcttcctacccttgatagctcctcactgactttctctttcaaactgtttttttatgataacacttttctaatcctcctgccttttaaaaaactacctttgactctcattcctcttctttaattttaagtattgtatatttcttgggtttcctcctttgcctttccccacttccttttcttccgtactttttttctgactttctctctctctctccccaccacctgtttctagatcatctatctgcaactacaaactcaggaggaaacaggctactgtgttcagtaagcatctcaaagtgagcctgtccaagacagcttctctgtttcctctctagacctgaccatcaccctctctctctggaccattgcaatgatctctaaatgactctcactacttcaggtggtgagaagggataggaaggagagatctataaacacagaactaagaattcctttatcattcccccaatgagcaaaaagttactggttagtactgattgacaaagggtacaattttcagtccttcactcaaaaagtcaacttcatcatcttagatttactcaagtttgtgagttgccttatgaggatctgagtgtctgggtggccatgtggctagaaatattctattagatccttatttaatttgaatatgtgtataaataatgcgtgattagactcaaagatgtagggattcaaactatatcttctatgaatttctatatctcttccttgctaaatttttaactatgggtatcttctatggagaaattatattaaatactcttcagtcctatagtgtgtaaccttggagtttgataattcaggtgtactacattaaaatttaaaactttctttaaaaagtattatgtaaatgcttttgaatttctagaatttatatatcttattaatttcaatattttgttttataaatatatatatgacctttcatatctcaaactgctatttatttgcgttataggcatacttagaaaataagaaaaagttctttatttttatttttattgagaggaaaaattctttatttgataacatggattatcaaattaccctatcaaataaatataaaataccaagtaatatttctaatatatttaaaaggaatatttgattaagcttgccatttttgattattacggcttatttcataaatatttaatgactcataagatcttcaaattattcccctcaataacattcgattttcttcacctatttgttaataatttagcaatccaactggaaaacatgaacatatatggcataatatgttttcctatattttctcttaataaactaatgccatgcctgtatatgtttgtttatgttccagctataagaatttaatgtgtttctttgagatccctttacccagaaataaattatcttacccttggtaatatattagtaaatttaatagtcctctgaagtaaaataaaaattaagcaaatttactacaaaaataatcttgtttgctcaagaacattgaatgtatgaatttccacacattgagtcaccactgcttttcccaggggcttaattttacatgtttcattttgtcctcttagaacttactacttctttccctttttactcattccctctttttcttctccctccaagtccttgtattaatcactggtatgccatcctttattgtcttataaactatttaaataaatggacaaattaatttatatgattgaacctctccttaaagtgagacatagaactaagggctataattgtgaactctgtagccagactgcttgggatcaaattgtctctgttccttcctagttacgtgactgtgcctttgttttctcatctgtagtatgggaataataatattacctcacaaggttgtaaggagcattgtattgttgatgtttgtaaagctcctaagacagtgacaggcatttgtaaagctcctaagacagtgataggcacctcataagtgtttgttaaagacacatgttctttcggtcaaccttctattcttctattgcatctaagtagaaaaatagctccttcctccttgagaacaaatcttccaccagaaattgggttataagtgctactcacctcctcagggaccttcttgctttcataaattatctcttccaattctgctgagaggtctgctgctggcctgatggggttccatctatatctgacttgacctttctttccagctaccgttaggactttttcttttgtgttgaccttcgtgaatctgatgactatgtgccttgggagtggtcatcttgtgtagtttctagccggggttcttggtattttttgagttttcatgtcaacctctctcatgcaattaggggaattttcacaaactgtatcctcaaagatattttccaagttgcttattctgtctcctttctcagaaatacaaatatgtcatagatttggtctctttttataatcccatgtgtcttggaagttttgttcattttttaaaattccttttttctgtatttttgtctgagtgttgattcaaataactcatttttcaagctctgagattccttcctcagcttagtctatttgctgttaatacttttgattgtattatgaaatgcttgtaattaattttttagctctagaagttcagttttgttccttcttaaaatgcctatttcgtcttacagctcttggattgttttactggattctgtggattcctttgattgggtttcaactttctcctgaatctttatgagcttccttgccattcagattctgaattgtatatctgtcatttcagtcatttcagactggttaagaaccattgctggagagctagtggacttctttggaggtaaagggatacttgctttttaaattgccagagttcttgcactaattgattctcatctgggagggttggtgtttctttaatttgggtgtaagttgatcatagtccattggcttcatttctagatgtttttagatggccaagactctgtatagggtctttatggctgaacgcttgtccttggcttcacagggtgagtatattagcaaaatatttttggtattatagtttgggctgtgatccagtagatggcactttaagattcatgggtggtgaataggctctaattcagctgtgtggcttctctgtaattccttgtgtgtacagtcatgctctgttgtgagggaggaagagaggtaacctcctcaccaggtctgctcccgagccttgtcagagccccctgcaaccactggcactgtgcctgcatttcttttgtgaggtgttctgggctggggtgctctttgagcagaggccacagcagggagataggccacaccctttgtgggccagccctgtggagtgaggcatgccccactcacactacagcccacaaacttgcgcatctcacccccttcatgctctgagactgtgggctcctctcctgctctggtgctggccacagatctcagctaggcactccttagctgtgtgctccagccctgggtgctaggattttcttgctgctctatcctctggacccttggattcgggttccaggtgtgctgggggatccaaagccttcctaggttgctggaaacataatcaggtgcaggaaagcatccaggctgggcagtggaggctgcaccatgcacacaaccctgtggggcagccaggcaggtgccgtgggaggggctggcaggcaaggggcctgaagaatagctgttccccagtcccatggggaagtaagtcctggcatggcggtcagctgaggcaagacattctcagagggagatggggaccctgggccaggggtgcccctgtctatgctctcctggagctgtgctgttcacaaaggttcctagttccataccggctgaagacccatctgtgcctattctctgggcagatacccacatcagcctagatgtccatgggggatgcgaggctttctgtagccaggatcccagaggttcatcgcaagggtgagcagccccacatttccttaactcacccatttcccaggagctgttcaggtcctggaactaccctcagtaatcaggcacctcacacagggttcctagcctcctcccttctcagcctcagtgtctgcgtgataccttcatccattcttgacattttctcttagagatctgtcccaattatgttaatttactcaaagccgtggtcgcactcagtgggagtggcccttcctgggtatgtctagtcagccatcttgtcctccagtcatgtatttagaaaatattttttacattttattgtgataagatggaatgtttgtagtatgatgtctctgggcctttctatatgaattttccttttagtagaattgttttttcccactgtgtgtgcctggcttaatttaactcatttcttcaaatttgttctgactcttgtgtctttcaccctctctctacagggtctctagggcatggctgcctcataacctttaccacactgacttacagatgttgctttacttggctagacccagcagaaatgagtgttgagagaaatgatgtgttcatctattccatgatctcaacaaaatgattggcccaagtaacatgatttttttcaatcagtgaaaaaaacgaatgttttcatttcataaatatattatttctagtctattatcctatgaatatccctcaataaaataatgtgtggcctgataaatagcaaagagattttctttctggccatgattaaccaagaaatgtgctctcacaaagaactaaaaaaaaaaaaaaagaatgttatttgacaggttaaataaaaagcataacagctttatttttgaacaagttcttatttgggaaagagtttcacatttcatttattatgtaattacctatcccatcttttggaatgaccaataatttattatatcccatgctataatctttcttcatgggtttttcttagacattaattttctcttgaagttaatgcagattatgatttttaggccagaggcaaaggattagaaaataatgttatgtcattttattataagaaaaagtacagtttttttaaaggagtatgattagtttctatgacctcaatgtctggacatgtgtcaatagtgtgtggtgaaaaaagaggccttcgaaggcctttggtagcttagtgtgtgcatttttcagatatgactgtatggtctcattatttctatacaaggaatttattgttccattgatcttgtgtatttctgtttgcctttgatagaaaacagaaatgacagaattgtcaatgtaaatggaaacctacttaaatagtatgtctctccttgagctttgcaggttggcttttaagcattgatctgttatttggttgataagcttgactgtcaagtttacttagtaatttagttttagatccctttatgttttatgttccccaagtagtccagatacagaagcaaacactattgttgtttctttttctttttgtttttttttcctaattgctaagtgggattcttatttattgatagcctttaattttgttgtgtttgttttgagacagggtctcaccctgtcacctaggctgggctacagtggtgtgatcacacctcactgcagcctcaacttcctgagcttgagcaatcctctcacctcagcctctcaagaagctgggactagagggcataccaccatctagctaattttatttttttgtagagatggggtctcactatgttacccaggctggtctccaactccctcaagcagtctttccatcttgagctcccaaagttctggaattacaggcatgagccaccttgcccaggcttatttttttatttacatttatttatttatttatttatttatttatttatttatttatttatttatttatttctagacggagactcactctgttgccaggctggagtacagtggcatgatcttggctcactgcaacctccacctgttgggttcaagcaattcttccccctcccgagtagctgggactacagatgtatgccaccacacccagctaaatttttgtatttttagtagagatggggtttcaccatgttggccaggatggcctcgttctcttggtgtgatccacctgcctcggccttccaaagtgctgggactacaggcgtgaggcaccgtgcccggccccttaatttttttaacagacttttaaaagactttaaatttatagacatatccctttaatactgtataagctggctcatcacaaatttttatctctaatactactttaatttttgttcagtttgaaaatgtgttctaatttttattatgcttttgttctttaacttgtgaattattcagacatatgttttaaattttctaatatatgaagtttttatgttgtctgttattgatttctctttcctcttgtgttttccaagttgtctttttttagttattcccattttcttctgtattgtatataattttctcctgtactatctgaacttccctttaagcaggcgcatttgttctagtttgttttatatttcaaaaagcaaagaaaaccttgactcacattgcaccttgtacaactcatttttcagctcttctttacagcaaaagactttgaaggagcccatagagttggtgtttccacttagtctcctccctttctcttcatgacccatgttagctggcttgctgtccccaccattcttctgcaattgctttagtgacctcgatgttaccaaatccagtggtggtgttttggactgattatctatctactattctatcaatgagtgaaatcaggatattgaaatctatgactttaattgtggatttttcctttttctctttgtagttcaagtatttcttgcttcaggtattttgaattttgttattgagttcacaaacattagtgattgctataccttcgtgataaattgatccttttatcattaggaatgatctttgtagttgataatatcctttcttctgaaatatttttgatatttcatatagccattctggtttaatgtaattaataaagcaatgtatctttttgatatatattttttcattcttataattttaatctattgttgtcttatattaaagtatatttcttataggcagtgtgtaattgagtcttgttttttatccaatatgtttatctctgcctttaaattattatggctagatcacatgctatgtgattacattagtatggctagatcacatgctatgtggttaaatatattgttaggtttaaatctattatcagttttaatgtctttcctgacaattataatacactgtcaattctgcattggctttgacgtattggtttttcttttgattatgagttgtgttttccttattgtttgcatgcctcatagtttttgatcgaatatcagacattgtgaactttaccttttagggtgctgggttattttatattcctataaatattcttgagatttgttctgggatacagttaagttttatattttgggtctttcttttcagacttctgggtgggacaagaattatgtttagtataaggttaatttttccttaccacaaggcaagacccttctgtgtactctctccagtgcccggtgaattatgaggtttcccagtgttgctggtagggacagtcactatctgtcactgtaagagttgggtattctctctaattcttttgggtgttattttccgtgcctttcctagtagccttacatgaatagactgatcaatattctggtgaatactccagaaccctcattgaatctctgaagttctctcacctttttgatgttgtcttgcaaactctgccgctttgatttctccagactctctgcagtgtctccctaactcaataaatcttcctggctctgcatgagctcctctgcccactgcaaggcctggaaactctctcaaagcagtaaacttgggtaattgtaagactccaattgttttttctccagcttcaaggatcactgtcttttactgcctggcatccagcaccttgaaaatcattggttcccatattttgttatcttttattgttgttcacttctggcatgatgctagatctagtgtctgttattcaatcttggtcagaagcagaagtcaaaatccttttcagttttcgttagtataattaatttatcaaaattaattccctcatttgtggcatagattaactacctttccagcatctaacttacttgtaatttgcaaatcttgtttggagctcaccttctgatgaatatttttctttatatggccttccagtttgttaattttgagcctgccaataccctagcatcactgggtgtgcaacctcagtttatgtcagcacctcaactcatgagtttttcccatagttgtttatttggttatgagattttactgcctgcgccaacacctccttgaaatatagacccatttcaaaccatactcactaagtttgaacccacatcttggccacagggaacaatttatttttgttaggtacatgaggagggggcactatttctatcccccttcatggcagaaactgcattcctaattcctgactttacaaggtatacctgtttttgtcctggggtccaaaatggggcatattccttatggcattatccctgataccctttcagcttgtctgtgggctgttgatttcagctcctgtttgctactctgagttctctgttcatttctggttcttagagattttatttacttgaatttttcaagcatggaatgttttctattgagtttgtatttctttttagcagaaaaagcggatgctcaatttatgttgaatccactgtttcacccagaacactttgtaaaaaacatcagaaaatagagaccatgagagaggtaacaataatttcagtaaccctcgagtctatcttctttaaaactctacaagtttacatttctgaactatttttctatagattttgtgcttatcttgtcagagattctatttaaagcctttagaaaattcaaaacttaaattatgaatgatggtaaagatttctgccaaggctgttgctcttctagtgcttttcagaattctggtaataactggaaaaaggtagaaactagcttgtaaagtaccagtgacgatgcactttttatattgtgtggcatgagatttatcttctagtaaaattgaaaaaaaactcttaaattatataaatatttataaacaaatataacatgtttacagatatgttacaggtagagctctttcactaaaacccattcacagggagtgcagaaaatgagtatctgattagaatatctaaaaatgaaaaaaagattctggttgtggtcaatatgacctaaccttgattttcaacattctttctttgccaatcactggcattcttgtaggcccaaagttcttgtatcccttggttcatttctacctttgatatgttgtatttaattgttttatacaggagcattgatttcatattaaatatatttttctaaatgtcatatacttttagaaaaataaatatatttttctaaatgtcatatgaccccagggcaaaaacaagtatatcatgtaaagtcaggaattaggaatgcagtttctggcatgaaaagggatagaaatagtgccccctcctcatctacctaacaaaaataagttgtatactagggtattggtaggctcaaaattaactaactggaaagctatataaagaaaaatattcatcagaaggtgagctcaaaacaagatttgcaatactagttaacatatactaattgaagtatatgatctactagtataaagtatatagtttcagttattttgaaaaagaagttctacaagtgccaaaggttatctttactataatattttaatcacctatttattttttaatttcagcagcttttggggtatcaagtggtttttgatgacatggatgaattgtagagtggcctgagattttagtgtattcatcgcttgactagacatctttttaaatgcctagtaatttaaaaatttcctatgaaatattattccatacttataattatccttgcagagatactaatctgtgatggaacttgttttctcatttggctaaatgtcagtctttccctcatcttgttgcatcttatttgtatacagttactaaaaatataactactcttaacatttgtatgttcagaatgcttaagttactagctaccaagtttctttatatttttatcttatcataaatcaagcctgatgactgattagtataattgttatttttgagcatttggacacagaatagccataagtaaacatcatcattaaaaaaattctgtttatataattcattcacataagagtccagtccatagaaactatctaacacaaataataatgtgcacacttaaaactcaatactataattaaaaaaatatacataagtaaaaacattaaattcagtcatcatgggaacaatgcacttttgtaaagtagtgaaattaatttacataagttacaaaagaaaatccatctcattaattcataattacatagtcctccatttcagggtgggattggcagaatgataattatgtgctcattcatgaaaacatgttataaattggataagctatatttaaatacactgaggctctctagcacctaaaagtctaatgatgatgtggtctgtcaaaactgaaaatatttgcgggcttatctaattagtagaaatagtccaaaaatctttatgaaaagataagcatgtatacatagttaagagctcagcttttttgaaacggagccttgctgtgttacccaggctggagtgcagtggtgcgatcttggctcactgccacctctgcctcctgggttcaagcaattctctgcctcagcctcccaagtagctgggattataggcacatgccaccacacccagctaatttttttgtatttttagaggagacggggtttcaccatcttggccaggctggtcttgaactcctgatctcacaatacacccgccttggcctcccaaagtgctgtgattacaggcatgagccacagcacccagcctacttttttataattaaatacagctacttgatctagcaaaaatctatagatacattagatttatcatggtaatcgttcattttacagagagagagagagagagagagagagagagagagagagagagagtgtgtgtgtgtgtgtgtgtatagacatgtatataaagacatggctgggcacagtatataaagacttggcctgcagtgagccgagattgtgccactgcactccagcctgggcaacagagtgagattctatctaaaaaaaaaatgtacatcataaatataaacaatttttatttttcaattattcttcaataaatctggaaaaaataaaaattaaaataatgtttatgagaatcaaaaagaccccattatttatgttatttttattactattattttttgagatggggtctcgctctgtcgcccaggctggagtgcagtgatgtgatctcagctcactgttatgttaggttttatcaataattcttatagcaaacccattaaaataatgcatataatgcatcagattgcacttgggcataattatagacttctaaagttttgtgtctgttatctatttcagtattacagaatcgatttaatgtctgattttaatctaatcataggaagatgtatatacctttggcaaaccctcctctttccctctataattaatttcagtcaactaattgggaaatatatactcaatacataaaagaaggggtgacatttatctttatcttaacctataataattacagcattttgttaatatatttattgaatttagctgtgtctggaactatgttcaagacattctattgggtcttataagaaaagtctgttcttaatgatgttttcattgtgagggcatcttcaagatttattttaaagttctttgaatgaaaaatgaaagtccagtagatagtttgacagttattttttaaaaacaaccaatcaacaattattcatagaaatatgtacctaactctgtgtttggtacaatagggcaccaaaaatatatgacactctgatccactgattgcatgaagaaaatattacctaatgaaatttatcccatcttggacttaggtttttctcacaaagcatagaagtggatgcttaaaatatctgatattgttagacataagattagagataaaataagggagaagggcagaagctaagaggtcgtgaatgagatagggcagggatccccaacccctgggccgtggacccctaccagtccgtggcctgttaggaaccgggccacatagtaagagatgagcggcaggtgagcaagtgaagcttcatctgtgtttacagctgctccccatcacctgagctccacctcctgtcagattagtggtggtatttgattctcataggagtgcgaatcctattgtaaactctgcatacgagggatctcggttgccctctgttacgagaatctaaagcccaatgatctgtcactgtctcccatcacccccagatgggactgtctagttgcaggaaaacaagctcagggctcccactgattctacattatggtgagttgtataattatttcattatatattacagtgcaataataatagaaataaagtatacaataaatgtaatgcacttaaatcatcctgaaaccatcccccatgctggtctgtggaaaaattgtcttccacaaaaccagtcactgttgccaaaaaggttgaggagtgctgggatagggtggctgggaaatgtattcagtcttcaagctctcttcactgtccagtcaacaagacaaatattagaagttaagaaggaggagcatggtacagtcttgcatctggtgtcttttctaccttttccttcaaggtttatctgtgggagaatgtgatatatgcatttacagtagtcctggatagtgaagaattttctttattcattcttgaaatctttgtgtgtccagcaccgttccgggctttgcgagcacctgacacagatacagtggaatccatttgtaagagtgtatacttagctaatttgttatagcagtccttttagataaaagtgaatcattacttatgctgaaaccaaatgtaggaatcttctgagtgagttgacttgcatgtattcatctttgcaagataataagcaattaacccagtgattagagcacaggagataatttgtaatcatggatgtaataatggaatttaattaacttcaaataaatattttagtgagggttcatttgtacacccagatatttatttatattgtaatagcttttatatttttgtctttaaccactgcaccaaaaaatatgcagcaaagttattatcaatttaaaaagccatgatctaaaatgtcatagctttttagtgtttatagcatttgtattatgatcagtatgcagatcacaaaaagattgacagtcttaacgtgattgatgatattgtttttcggttcctgaacatattgctctgattccttctgacagttttgtttgagagtgactatcgggtatgtaattggtgtttcttaattgatctagggtcatcatttataaagcgtagttcaagaaatcaccctttgtgattattaaaagaaataatcttttttcttcatttgtaatttgagttagaattgtcaaaaggatattgatgaataggtcatatctctagcaaggaactaagatacgcctagaatatggagttatgtgccttttctcaacttcctcaatccatatttgtttgaatccaccaatgtacatgaggaatgaggactttctctgtgaaaagtggctgctacatgtgagtttagaaacattttggcatgactggggtagtggacatgtaatattgtgagaaaaggattctgagactttattacaatgtgaatatatgtcagaggactatgactggccatgtattactggagccagagggcatttctagttcagggcagagtaagatccctcttgtttgaaccgtttctcatccagaccacctggcaggaagaaaggctgaatgtgaaattttaaagagctctctccgtaaatgatgtagtgtccttgtgctgccagcagcttggcatgggccttatgtaagagagaggagttgcttcagtcataagcaacaatgctgaccagctcactgagcattgagtaatggcttagaagtgcacatctttgtctcatggtattagtgaatgacaaacaccaaggtgcagtccacggttagtggcagaagtggtcagtggcccatcctgatctcacaaaattctcaatgggctttgcagtgatgctatgtccacagggatatctttgaagattgctaaggcccaaatgatgcaggtgttattgctgaatttactgaaatttgtatgtataggttaataggatctaaatcgtaaacacaggctgattacacatataattttgatatgaagttttgaagggatttgttctctttttagagagtcatttactcttttttttcagttgtataatcagtttttcaaaaagtatttaatgaggtgagaacatacaatatggacttatctctctttctatctggatatagatataaatacatagataaagatctatctatctgtaaatatcttcatctatattggtttaagtttctttcttcctcttttttccttctctctaatccattcatcaattaccctctccctttctagtagtatttttttttcctgctgttcttactagtttttttttttattattatacttttaagttttagggtacatgtgcacattgtgcaggttagttacatatgtatacatgtgccatgctggtgcgctgcacccactaactcgtcatctagcattaggtatatctcccgatgctatccctcccccctcccaccacaccacaacagtccccagagtgtgatattccccttcctgtgtccatgtgatctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgtaataaacatatgggtgcatgtgtctttatagcagcatgatttatagtcctttgggtatatacccagtaatgggatggctgggtcaaatggtttttccagttctagatccctgaggaatcgccacactgacttccacaatggttgaactagtttacagtcccaccaacagtgtaaaagtgttcctatttctccacatcctctccagcacctgttgtttcctgactttttaatgatcgccattcgaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgcttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagccctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtgtaaggtgtaaggaagggatccagtttcagctttctacatatggctagccagttttcccagcaccatttattaaatagggaatcctttccccattgcttgtttttctcaggtttgtcaaagatcagatagttgtagagatgcggcgttatttctgagggctctgttctgttccattgatctatgtctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctcttggaagcaattgtgaatgggagttcactcatgatttggctctctgtttgtctgttgttggtgtataagaatgcttgtgatttttgtacattgattttgtatcctgagactttgctaaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcataaatagctcttattattttgaaatacgtcccatcaatacctaatttattgagagtttttagcatgaagggttgttgaattttgtcaaaggctttttctgcatctattgagataatcatgtggtttttgtctttggttctgttcatatgctggattacatttattgatttgcgtatattgaaccagccttgcatcccagggatgaagtccacttgatcatggtggataagctttttgatgtgctgctggattctgtttgccagtattttattgaggatttttgcatcaatgttcatcaaggatattggtctaaaattctcttttattgttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttgattggtaagctattgattattgccacaatttcagctcctgttattggtctattcagagattcaacttcttcctggtttagtcttgggagagtgtatgtgtccaggaatttatccatttcttctagattttctagtttatttgcgtagaggtgtttgtagtattccctgatggcagtttgtatttctgtgggatcggtggtgatatcccctttatcattttttattgcaactatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtggagagtcatttactctttatttttatttagttaaaccttctgaggaaatatttgaaatgtcaaacagatagtaaatatggagttctattttatcatatcaataatgatgccaagtgtgaagaactgaaaatcaccggtgcaccttgaaattttgacaaatgttggctctgagaaccatatcgatctgtggttggatgtggagtttgctgaagcaggcatttcgtaagtctttacgttcttagaagatttgggaatttgataaaattatttttttcctcaagcaaactgaaggatttacccttgctacatatgcttttacacttggagacgtgcttgcctaatgtgcttttcctatcaaaagggaacatgatggtgatgtaactagacagcctccctttccacattcagcaggattcatgccctgtacgtagatgataacaccagttcacagaacaatcttttggattgaggaataaatggaaaaaaagcacattttatttatgttttatatgtaaatataagcaaaggttttagtagaaagcagcataattacataaacaaaagtttcatttcttgtcttattccaagacgttgttcttagccaatataagtgtggcttcgtattcatggccacccttctagacagtgggaagttttccctgaaagacaatcacatggaggaaatccacagttcatgttccctaacatttgtatactaaaagcatgtaataaattaaggcgtggacctttaattccttcccaggtggaagaagtagtgaggtgcaagaaagcagagttgaaaataagatttaatattgctttagaattttttccccgattttctgagtaatggtgattttctgagattctttcgaagaaggctgcttttagttcaacaagcattatcctcaaataatatatttattgtagaaatgctatatggaacattttcatattattaaacaaatcaaatttttaaatatgatttcttaaatgatttttccccaagaaataataaaccattataaaacaatgtttctcaagtgacttgtgtagggtagatgggaatatggtggtaaggtgtgacaatttccagggaacgcattgattattcagcaattatttatggagcatcgataataaccacttggtactgtggattgttataacaatatagtaatagatgataataaaatataattcataccattatatggattattatatggacttgttcttacaagtgctagggctggagtacaatagtgaacaagaacaaaatttgtttctgtcattagagaacaggaaagaggagagtagacttcatttccaaaatgcttgtaccgtgtccctatttcacatgactttaggctattatgtgatgctcagcttcttgcatatattacatacatattgttgcaggtagaaccatagtgtccactcacacacttatttgtcccttatgggtgctttgtgactgcagcagcagcagataggcatgttatgtaggggctgggcctaatttcagagggagctgaaattgcacaaaaagcagattgtatcatcttaaatacctacagctatctagggctgttcaggggactttgtggggtgagccaagagaaaatgttataattaaatagatatgaggtaaaagagaaccaatatttgctcatttaaattatatttagttttgtgtaataagatttagaaagttccaaactgggatgatctgagctggtttcaatggtatttgctgttaatgattggacatcagttctgtgtatttgctttcccctttgatcatagggaaggtaaatttgtttatttagaatttgtttatttagaattttgttagactaattgaatcagactattaataaaaagtcaaattcagtgtgacaacattgtaggtgtgtgccatcaaggcataaaatttagatttgaccagcaatctctaatgacacaggagttggtgatagtgtccttgtcagggaaggaaaatcaatctttcaggcatattaagtgaggtaaatattttgttgaagaggttctatcactgcaaattccagttaacagcaccagctctctgaaattaacaggccatgtaattctgaatctaataagattcgaatgctgtatcatattaggtgccagtagctaaagctctgagagccgggagtggtgggaagatgtaaacatgatcagttagcttctttttgacagcaccttggaatgaactgacacaggcaacaaatgggatagaactgtgaaatagccaaaaacaatacaagaggctgagataaaaacagttcatttggcaacgtactgattcccaggaggggaacacctcatgcaccagtatcaaccccagaggaggactctaaacacgtcaccaatttctgttaaggttccttaatctgccaggttttgcacaaacccagctgccagaggtttcacataaacccagcatatgagtcgaatgaaacaggatattcactcaagatgtcaggcaaaacaaatttattactcacagataggcagtgaggataaacagatctgtggcaaggccatcccccaaggctcaggaaagctggccagagtgaatggaatcttgtctgtgcctaccccactttgctctacaactttggaacccccaaagcattgcactctgggtttttatacgccagagtaaactttgctcactgggctgaagtgtttcaggatggatatggaaaaaacccaggctgttccagatagttctccttatctcaggatgttacattatcagtacattcggcctgagaattgctaaggaaagggggaagacatggattggccagggcgattcaaagacaggtcctcctgcacacctatttgtgtacattcgttatatggaatcaattcatttgctcagttattcagcaactatttatttggtactttcagtttaccatgtgtggtgtcagctgatggtgatttggtgatgattatcaagtgagcaaagatttacttttggtatactcattaatgtttttattcagcatttaatgacagtggatatatctaaagtatgtcagaacagtagaaagattatgaatgcattataaaatgtttacatgcttaattgctgaatccaaatttcatttttatatcccacaaatatgaatgttgtcaaacttctgtcactttggaaaacagtaatgaaaagaatttattgcttgctttggttttattattgttttttgttttgtttctgcctctgaatatactatttttattaccgtacatttttcttccgtagctcattttatcacattccttaaatgtcaggttcattttgttcttataactttcattttgagtagtggcaaacaaagggataggctattaagaaaaatgcatcggcttcttcaaatgtgacagtagttttgtggcgatatcagcattccaccaggaattcatcagtgtgtctcactctgagactgaaattctcatctggctgctttcattttctaaatcattttgctgtaagtttagctttactgtttagttgatttcatttaattctgcatggaatttattcatctgtgaatttttaaaaactgttatgattaagtatcatcccaaatctggaataagtgtgacgaacggtaaatttctaaattaaaagaataatgacacttttaagtatttctgtcttttctatctaatggtccgaaagtgggcaaaggttgttatgttagacatgttcttgccagtagagagttttacatttggagctcgggaaattgcttaaatgtagtgtcatctaagattctgcatcaaattgaagggtacattttgtaaaggcatgggggtcctaacaccactttctagcaaatgaggtcttaaaagtgacagttttggtaagttttttaatctttcagcatgtctgttagaaattgccagggagtctggatcccactgggtggttatgaaaaatttgtcagattagttagaatgttcagtaatataatgacattagttaaccaaattgcttccttaatgagggcatatgacattgagttttaaatgatagcctaaagattttagagatatgtagattagacgattcaacaaatgaaaactagtacaagaatataaaaattctttgccaagcaattaggaaacatcttttctgtatgaatttcttataacaactctcggagtggtcaaggctgttaggcatatatgacaacaatgttctttgcccaaggtcatgactttaagtgataaagataaaatgtgtagcctgctttgcttccagtcactaagtgccttcagctgtcatagttggcttcaatttctcacctccagacccagtcttccctcagattcggaatccagtctcatcttcagttagagaaattttaaagaaccttcagccattagttcatcagaaagtcagctagctgctggctcttctttgatcttatagtccagtcaaggtttttcatcattccctagcactaagcttctgatttatgttccagtttcagctcatgggtacctgtattgttctaatgtttttaagtccacaatttggttccttaccagttctgctaattccccaagaattgttctcctgactgtcaccagaaaccctacagtccctatggccatagtcttgatgcatattccttggcaatcctgacacccatcaccttgccaacattactgcttactctttgctgcagctctcctgatgctctctttttccttcctgatgagacatacacctgaacactgctgggcctctgtgttgttgacagtttacctgcctagacttccttgtgttgtctgcagctgggccccacctgacctcttcttccgcgttaatggtttctgagctctatccatacctaataagatatgttcaaatcacctgcatgcttgcattgacaggagaagcctatctgttattcagtcattttgcctctagttatcactcttagttgtatattttccaactctggaaacttgccatttctgtcatatgagactgaggaatactaaacaagagataaatggcagtcttgtttggctgggacaagaccatctcttcttgtaagtgataagaatttccccaggtgactgtgataatatgaagaataaattatacttctgtagccctcactaatctcttatatatactcttcatacattaatgctatagtaaattataaaacctgccatcatcagtggttgggcaatgttgcatttgaaatgcagtaagacgcatccaaaagcacaggcaccttagattttgataagttttccatcagttaagcctctcctcaccttttaacatcacaaacattcagtatgccacagttgtccagattctatggagcagatatgaagaaagaaaagtatacagctctgcctaacagtaagaaaagtacaaaggtgaagtaaaatattcaaatataaaggggaatctacgatgttagcgagtgatgatacccatggattaaaacaaacaaacaaacaaagccttgtgatattagagagttatgaacacaaccactcatcctgtcagtaaaattagggagacaaatgcaggccaatacaatgagatatgtatgatattcttgagtattaagttgatcataactcatcaccctaatttattttctttgttagtattttaaaaatattttaagtgaatataaatgattttccttaatattgttatttagtataacaaaaataatagagatatttataacaaccctaccatcacagaacatctgtccatatctggtaggtgacctgaataggggaacagacaattacaaggcaaaggggcaagtcctgtcgcacacattaggctatggattcatacaatccttcactcaaatcctggatccaccacatattaaaaggggaactttgggcaaattatttattctgtatcaacctaagtttttttatgtataaaatgggaataatagttttacctgacataggattgtgtggattaaattagaagtctaaggcaaatacaccctattcaatatatgacattacagattgttttattccgtgttaatgctcctgataaacacatcccggcaatttataaaggaaagagttttaatggacttacagttccatgtggctggggaggtctcacaatcatggtggaaggtgaaaggcatgtctcacatggcagcagacaagagaagagaatttgtgcagggaaactcccctttataaaaccgtcagatttaataagacttattcactatcgcaagaatagtatgggggaatctgaccccatagttcaattatctcccaccggggctctcccacaacatgtgagaattatgggagttagaattcaagatgagattttggtggggacacagcaaaaccatatcacagatatttccatcttgcctaacatttgggactggaagatcaattaggaatgtgcgttattcgcaaatcttaaaatctggaaaattgaagatttttggaaatattttattacaaaatttcacagaaaaaactacaaggaagaagaagaagtggttaggaaaatgaaaaatcaacttcggtatattgacctgcagcacctttaaatcatgacattgaaatatcttgtaggttttggatttaaggaattgcgatagatggaattggaaaaatttgagcgcaaattatcaccatattcatggttactgaaacaaagggagtggctgagatcaccaagagagtgtgttgagagagaagactgagtcctgatgaccactaacatttaaagtaaaagtcaggaggagaagtagatgaagactgagaaagggactgcctcagaggcaaacaagaccatgaagttgcaatgtcaaaaaccagtgaaagatggtacttcgaacagagtgagtggatatcgaataccatatgccaatgaaagtttaaataagagctgaaagagatatgctggatgtagtcatattggtaagagcagttgcatttgaattggtggaaacagagccagtttacagaggtttgagagtcgagtgggagatgcaatcacagaggaaacatgagcctgggaattttttctgcaaatgtggcactgaggaggtaactcctattctctgtaatatgaagggataattgaaaggaaaagatgtatgttcttttgtaggtttggtatcaggcaactcaggaagtctggtatgagaatttccaatttccttttttatttttgagacaaggtctcactctgtcacccaggctggactgcagtggcatgatctcggttcaccacaacctccctccgcctccttagctcaagtgatcttcccacctcagcctcccaagtagctggaactacaggtgcacactactgtgcttggctaatttttaaatttcttgtagagacaggatctccctatattgcccaggctggtcttgagctcctagagatgaatgatcctcttcacttggcctcccaagttctgggattacaggcatgagctactgtgcctggccagagtttctaatttctatatgaaataaatattaagggtaattgctgagagttaagagaaaatagaagagaaatctgacagtggagttataaaacttctctgtgggattcagggaccagtagaagagggcgatcatgaagctttcaccgatgtttataatggcaaatttcgaatactcaagatattcctatccttaagtcttctcaacttgaattcacgtgttactgaaagactgaagaataggcatgtccaaggcaaacatgtttaagttaatactcatatcttctcttttcagtgtccatttcttttgcaaatccatccttccatctattcatgtactcaatgagccatccattcatttattcatatatttatctatctttccatcttcaatatgtctagatgtccttccattaatcaaatattcattgattgacccaacatgatttacaaagaggcattaggattacaaacaactgcacaatgatgggttttgttctcacaggatgttttaattaagataaaggttcagtacagccaaggtggacacttatttctttctctcgtaagagtctgtatgagtagtttaatgaatccaggcagtttacatctatttaccatcccatatccctaggtaactggccttttgtatatggcacaagataattcccacatgtccacatactagttagaagaaggagggaagatagggaaaggtatgctccttctctttaagccaaaatatgaattggaagttgcacatattgttttcattcatattctattgacaagaaaaaaaatcaccttttgccacacctagtttcaagggagactaaaaatgcaggctttattttgcatgaccatatgagcagacagaaaggagaagccaggtactgaagaactaacagaagtttctcccttacagagcctatgtttttcttgtagttacaggcaggtgaattgacagttaccatacgtttggagaggtcacagtggtaatatgtgatagcagctcacagggcttccccatctccaagaattctactgcacagtgattcctgaagacctctgtctccaaaataggcacagagaatttcccatctctcaatgtcatttcccctttactcaatacagttcttatttccttagagtaaatcaataagttttgagaaagaaatatcaatgataaactcatcctaacatgttcattgctaatcactacttcactcccctcccttttaaaatatactactaggatagtttcaaatgtctttaattcgtggattttcactatattttaagacagaatggctagtctgagaatcagatttaccattaagatttgaaacttacagaaaccaagagagaattgattgaaatattatttaaaagaatccagtgattatattgacagatactggtgaaaacaaaaaaaagcatttaaaaaggcttgtattaatctgctggtaagtgaaagaaactcgtagtaagggggcttatattgcctaggaagagagtttacggcctttgaatgagcaacttactatttatgtctgttaattgttgattcttgtttcattatggagctgggcaccctgacaataaattcttctatcaaattggtttcatttaaagaaacagatctcttatgaactatttaaagatcctttcttcaaactaaacaaatcaagacttggtaaaatggctctagaaacagtatctatgaggcttagaaacataggaaataaggcctcccagtgtttcctataaagatgtctatgaactatgggttgatgaactatggcataacctcagaaagcctgggattacacataacgccactaaatgcagatcatctcattaagaatgataattcaacttctgttccactgtatctacctggttatcttatgttcattaaggacttttatggcttgtaattttccctgctgaatttaattgtttatctctgccaattttttctgatttcagtgtcacttttaaacatttaagctcaacaattttgtcaatccctagatataaacctcttctaaaagcactgaaaaaaaagatcatatatttaattgctagtaatttaggtattttcttttaagtgacattttataaagtgctatataaatttagaacattagtattatgattggattaattttgtcactttatgtaatttctctgtatattatgttgggtatttattgctttttaataagcatatctagagatgaataatctcctttcacttgtcaccttgccagccttcacactgattctgattttcctgtctttgcacaaaacatcttttggggggtgttcaaatttctacttaaaaggctaatttcacaagaggtttttgttaaaaaaacaagacagtcaagtcagatcaactggatggatctttttagcattaaatccactggagtattggctggttattgatttgtttaccaaacagttattgaatgtctgttacatgtcagggttgggtgtagcaatcaattaaatgtcatcatactttgccttttaggtgttcacctttgtgttcaggagcaaaatgcgtaaacatatatgttgaaattattggctcaatgtggctatgtatgagagtgaaatggaagaagcaatttattctgcataggctggggggaagaccgtgtagagaagatgctatttaattttggtttttaaggatgaatagaatttcaccagtcagaaaagtgaccacgggagtctgggtggcagaaggatgttaagggagaaaaacactgcctgaacaggcatagcatgatatggttaagcaacggaaggacattaggtattagtggaatctgtaactgttgggaagaaatagaggtcaataaatagtagtaaagccagttgcaaataaagtcttggataggatgctaagatattctctaaaagactcttgacaagcaactctttgatctaattttcatgtatatgacaaagcaatccctccctccctctctccctccctcctttcttttctccctccttccttccattcctcaatacatttactttaattctcctttttaggtgttaaggataaagaagtgaacaaaacaggaaaagtcttagcatggagtttgtattgtagaccaacagtctgaaaattgtttctgtaaatggcaagatagtaaacattccaggctttgcaagtcatctagtctttattgcaactactcagctctgcacttgtagtgagaaagcagccatagacaatatataacaaatgggcatcgctgatttccaataaaactttatttacacactgacatttgaatttcatatgtcacaaaatattctcctccttcttctatttttgctccagccactgaaaaatgtaaaaatcactcttagcttgtgggttgtacataaacaggaaggctagatttggcccatggactgtagtttgtcaaaccctgttctagaggttcaggttaatggaggcattagacacagacattagaagggtgaatcaaaagcagtttacatgtttaaatgatttagaaagtagtccatgcaaccagcttatacaatagagagattctctaataatgcaggagaggcatgggagttcaagttcttggacattaatttctaagtgagtgaaggtcacattagattttctttatatacaattgcccccttttatgtccaggcttatatttatatgacatttctgtatataggctagtctggctgtgtcttgggaccagtttagctgagccagttccccatcatcaatattggtgttacataatattcaatgtgatttcaggctctgcttgggatagtcctctcaggcatgatcactactctctctcagcccactcatgtgtacacagcccggttcatgtgctttgctcagataaggactgcggaattagaaccagtgttagttacccagaggtttttgagagtaagctattgggcctttagaccagtggcaagatcttgattacgcattttaataacacatatttttttttttatcagctcacagtatttttgggcttcattgtttaagtttggaagttgttgttgcctggagtctaagcccagttctactgttggttgctgtgtggcactgggcaaatgattgaagctttttcagccttagcttcctaatttttaaaatgggaatcatacccataacctaacttacagagtttttgtattaaatgaaataatctttgtatcctttcaaggcctatatttaaagcatctggtatatagcaaaacaaacaaataaaaatgcactatttttactacttatacactatttatactactactatagcactactattactattattataattgtagaaaataagaggaaatttggcattcttttcctagtagagtttttgttactctttttaaattggatgaatattagaaagaggagagaattaacttacttcagaaaagacttgcccccaaatcctaggaatattacagatcgcttaatacaagaggaaatcgaatatgagctgtatcattttgaaagaacagctgttaaacatttcaaaaaatttaatttagaaaaggttaattacctttactatgtcaactacatttttaaatgaaggattcttaattcttttgaaaacatgtccaagacccatttatttgttaatttaattccatgtgcagtggacccccagctcctatacgagggcaaaccattataatatatcttgatttgaaggctcaacacagccactgttgatttcggctgctaaaattagagtacgctgtattcaactctatgcacattatattagaatttgctttggtctgacacaagtaagaggctttctatttacttagtattgcggggtaggattttaattggttccacagctcttactcaagtatcattttacttttcaacaaatgattcagacctttggggagacatgccataatttaactggagaaaatttaggatccatgaatgtcacacacacacagaaactgcacaatggagacaatgatgtgccgatctgtataagaatgtgtgaaatgctactgattcatttttataggttttgttcttcggagtttttctgtaacagacagagaagactaagtggatctctgcacattttcttttccagtctgatctatgctcagtggtgtgtatttaaatgtgtgctttaacatcaatacatttgtatgcacttaatatttagggctttatgtgcatagaatttatttctttgttcaatttgtactgattcatacatggccatcaaatctaccaccagcccctgagtgagttatttcttttggcctcaattttctcatcagtgagataaagctaacatcttggaaagcgattattgaaaggtctagctgagaaaacagatacaaaatgactgggtttgtgcctgggtcaacaggtgcttaataacggcttgatttcttccctttcatctttcctatgcttttccttctaccttctagcccaaatcatgctttaaccatcaccaggtctcttcttctgtgtctaaaatcaccatgcaacttatttccattattaatcacagacaaataaactaaatatgatagtactgttttagagatttctaagttgtaaatataaagagctatgctaaagataggctttaacataagtagaataatctgattatgagatgaacatgagtctatgtgcttttactgttgtattgaatttatgtttgcaaatgttaatgtaaatgtcatgtctctcagtggctgagagttttgataaaatgacaaaaaacttctaattgtttcttctttgggtacccatgaagattgggctacaatttctagttatcaccatcatatggcaaccaatctgttctgcatctctctttggtaaactgtcagattcatttgttcacattgtcatcgctcatgccataagatggcttaagttatggtctctctgccctccaaaaatatccttctttatggccatgatgcctctgaatatgctagctgccaggcttgtagattttcatcttccaggactttttgctagtgagcctgttatttgtcacttaatgtttagaattatctgtagctgatgccgatgaacttggtctggaggttggaagtggcctcacatatatgtggctattgggcatagctattgctctgcaataccttcatttgctttgaggcttttgctatattagatcctaaagatggtctgctgagtggccagaggacagacaatacttggaattttgtgataataaaatgttacagttggacatttctggagaatctccaggccaatattaggcctgtggctaaaggattaatgcagcagagatgtccacagccagaattatctatgtccaacgttgcaacaactgtaagggggtcctctgttagaatgtgtggggagatagtccagatctctctgcttaatttcattatgtttcactagtttactgcattagtaaaagggggttagaatgaaaacaaaaaaacataaagcatagtttctctgataagaactttttctaggctgaatgtatttttttctgctttctttaaaaaagagaagtcaccgactattaaaaataggtatctgttttatttgcctgcctcatacccatgtctctttcatctgataacagcacacatatttctcatcccctgctctgtccatgtggttcaagtgaggttaacctcgacactagatgatgtgggcaggtgaggaagtctggacaagctcatcctcctttgtttcggtgacaggtagacacattagagctaataagagaaaccccaggatttcttttcaagaattgttggaatagcaaagctctctttccctggatatgtctgatagagtagagtgaaagtctggaggtcctgatagtcattttaccattggtaagggagtgcctacctaagatggagtcaaccaaaaagagagtaaaatataattaacctgtgaccatttcaatatttagtattttcccatcaattaaatgttctgtgtaacattcattctaatgggagaattgtatctaataatatgtattagtcagggttctctaaagggacagaacattatatatatatatatatatatatatatatatgaaggggagtttattaggagaattgactgacacgatctcagggtgaggtgatatgccaactgcaagctgaagagcaaggaagccagtccaagtcccaaaacctcaaaagtagggaagccaacagtgcagccttcagtctgtggccgaaggcctgagagccccctcgaaaatcactggtgtaagtctgagtccaaaagctgaagaacttggagtccgatgttcaagagtaggaagcatccagcacaggagaaagatgaaggctggaaggctcagcaagtctgcccttccatcttctcttgcctgctttattctagccaccctggcaactgattagatggtgcttacccagattgagggtaggtctacctctcccagtcaactgactcaagtgttaatctcctttggcaacaccctcacagacacacccaggaatggtactttgcatccttcaatccaatcaagttgacactcagtattaatcatcacaccatatcagtgtgctatcatttatcaatcttccattatttaacattttgtctgcaatgagcaactgcatgtgtaagtctacatcttaacatctgtaagatatagaaatgtcatttctacttcagagtacataaaggcgttttatggctttttatatgttaggcaatacactgaacatgttcgtttttgttaggacgttgtggtttaggattttgattttttttctcagtttaaaatattcacgaagtactataaaaaagtttacatatgaattgaagaaatattttcttagaaatataaaagacaaaaatcctctctagcctggcgtgaaaactaagtcaagaaagctgatctgttgcacagcagtacacatgccatgcgatcttccagcagctgtgtctgccatgagatgcctttgtgattttcaacagcaatcagagcagtggatcacctgtgcatgggtggttgaggcatgtttgaagaaggttgaaagattgaaagacagctatagattatggagagaaaagtccactactacaagaatccaatatccagctaagataaaatttacctgtttggctggtagtttatagaataaaggtattgcagatattcagtgattcagagaggaattgattgaattccatgattcataggctgaggaatacattatcatctgtctacctcatgaggaataattgcttgagaatgaactctaacaatattataatggatcagaggcctcaagataggggaagaaggaggaggagagagtaaacaggggtgaataagacttgaaatatctttatatctctgtatctgcctgtcatctatctccatctatacctaaatggataataatagggggaaaggaatagctattattttaatgccaagtaatggttaatgaaaattataggatgtcaaaggaaaacttaataatctagagctaaatgtactatactttttaagcaaaatatgcgagttgtgtagtgagttcaaggacaatccacaaagtgtcagtggtgcccagcaagatttatttggtgacagtctgacaggtttgtatgcaagggaaagtccctcacagcatgagaccttctcgagaccatggtgcaacacaccacccagaaggggatgagggcaagaggattcctgggggagaggaggattctgcgtctagggggcatcactcagaagcacagcagagagtctctaggtcagagaactccatgggaagcaatggtttggggtcttttatggcaccagggtttatcttatttatggctagtagatgttgggtgaagtttcataggttgtgcataacaggcagtctctaaatggctaaaaactacatatatgggctgcatttagtataatttcatatgtaaaaaaatctgaatttggcattggcaggcttctgagccaacaataccaatctgctctgcagataacaacataggaccaatatagagggaccttctttggctcagttatataacaagttgataatagagagcagatagcagatgctctaaatgtctaatttaggcaagactgcatgggacgtaagagtattataaaggttgtatcttatggtaatgggatttaggaagcaggcagggaatatattgtcctaagagataagaaaatcacactttttaataattgagaaatatttaattacaagtggtagtaaagggagaataaaacagaatgaaaaagtagagtggaatttccaaaccaacgaagagcaagcaaatgagcaagaaagagtgaacgattagcagtttgaccagatcagcaaaacactggaacaggaataaaaagaatgtaaatttcaaaaggaaacataagccaactaaataaaaggagttctaccaattgctatactaaatgtgaacaggctgaattcagaatgtatggagagctagactgtcaaaaatctacccctattgtattctatttatgagaagcccaagagtggtgatattatcagacaaaatggtcaaaagcacttaccaacatgtagagagacattgtgtaataacaaaatacctacttttcaaagaaaatatagtatcacaagtgtgaatacaccaaacagcatagctgccaaaaacacattgaaagaactattaaacctccaaggacaacttgatagaaaatatagttatagtgggagatattcatatgtttattctgaaatcagatctaatagaagaaataattgaagacatagaagattcagattatatcaatgaaaatcatataaaatctatgtatagaaatgtgtactttaaagtagaacatattttatatatctataaaaattaatcaaccatatgcttgactataggaacactgctaaaaatagaaattttgcattttacaacttacatgttttatcataataaaataaagttagtaataaatgaggagacctaacctcctcaactattggaaattaaaaatcacactaagttaattatggatcaaaacagaaatgctaaattactagctatttttagaaacaggtattataaattacaaactattatgaatacatttgtaaagcagaatactttatataaccaaataagctcaataaaagctctactctgaggaacaatttcagtcaatgacccaagaaaggaattttttcttttttaaaaaaaattagaagaaaatcaacaaaaacaaaaaatgaagtagataaggagaaacactgacctcaagtcatgcaataaaagtgaaatagaaaggattaaaaaagtaaaactatttttctttgtgtattcaagaaaatcaataagaaccctgttgaagcaaagaaaaaagggagggaacaaccctacacatgctaaggaatgagaaagggcataaaactacataggccaaagagattgatgacataaggaaacactacatgcaacataaaaaaaaaaaatcaataacactcctacaagaagatttaggctactatatatgcatagcacaggagttaagaagacctgattaatcaagacaggaaacttggaagatgttaaagaaaagctagacatattttaatgtaaaataattaacactgttttacaaaaatattgtaaatgaagtcaaaggaagaatgatagatttgtataacttttgtctttctttattgagcatggagaaggcatggaaggatatatatcctaggctattatctctagtcatttagtcgtgcggaaaaagtgtttgagtagagagagtggaagaagggagatgggtagagaaaaatgaagtaaacagacttaatatctaaaggctatgggtataatttaaaatttacacagccttcacaataaagtccttgaaacaagcaagtgccttatttggtagaacaagcctagtgtgaaaaagacttctaaagtatctaacacttaatcagaactacgtctttaaccacgttatttagggagaatgaattggagaaacttatcaaaacccactgtacatcctttatatatagataaatataatacatagagttttcattgaaaatagtaacatattgatcagttcagaagaagtgccttatgtggtatgtgaacttaaatattcattttcctcaccttcaaatgtcaattttactctccatgaatctattatcttatccaattttaagcagatatttagtctttcaatttcactgatggcatatttttgaagtgataatggcctcattaactgcttaaggccctactaataacaaacaatgtattttactctaaaacaatatctggttttctaagaagcaataactggtttcctaagaaaaattattatgatgactgtttttcttttttacctaaaatcttagaatagaaaagaactctaacttgtctttgtgaaaaggagtcttttgaaattctatacttcaaggttactagcatggagagacatttgttacactgaacacaaatcaatatcatatatcagcttgacatataaagtcaataacatatttctaaaatagaggcactatttattggtagaagcacagaaaacctggcctggtccttgctcaggcatgtactgaccatgggagtctaggacatgatatggaatttctctgaatctcagtttataacagtattatccaggcctacctgcctagagggtttcttgtgaaggtcaaatggctaccctgtataaaaggtctttgtaacaagcaagaactctctatgcacgcaggaagatatattatgggagccccatgttcttctgaagtcctgcctttgccctgtccagttgctctggcggtcgatatcacatgaagttacattctaaaataatgtttttagacatagtgattgaggagcttattttattttatttttttatttgtttatatatatatttattatactttaagttctagggtacatgtgcactacgtgcaggtttgttacatatgtaaacatgtgacacgttggtgtgctgcacccattaactcgtcatttacattaggtatatctcctaatgctatccctccccattcccccaaccccacaacaggccctcatgtgtgatgttccccttcctgtgtccaggtgttctcattgttaaattcctacctatgagtgagaacatgcggtgtttggttttttgtccttgcgatagtctgctcagaatgatggtttccagcttcatccatgtccctacaaaggacatgaactcatcatttttttttttttttttttttttttttttttttttttgagacggagtctcgctctgtcgcccaggcgggactgcggactgcagtggcgcaatctcggctcactgcaagctccgcttcccgggttcacgccattctgctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgaactcatcattttttatggctgcatagtattccatgatgtatgtgagaaatggtatcacttttacactgttggtgggactgtaaactagttcaaccattgtggaagacagtgtgaggagcttttttctttgaggaagaatttgcttaaatttttcttttacaccttagattgtaattgtcactctccagacatatctattaggaataggaaaagatttctcagtagtacagactctaaatctctatagatggtgtttgaataataataaaaaggattatttgattcttgtccttggcctgaaaaaatgacacactggggagatctctaattgggttgaatcttgaaacaggtacttgaaatataaaataaagtttgtctacttggactcattgaagttttgtaagatgtgatttcataaaatgaccaaggacacaattttcctgtagcattttgatgcctgtagccttctggaggaaatgatgtaaaactgtaataacatattatgttcctcctaatagtattcttcaatatcaatgtattacataattctaagtaattagaacaagtaaatgtttaccactattagggaaattgagtttatctctatataagggaaactgtttgttcccaacactcttgaacattatgtctttggactcttttattaagtataatttacaaaattttaataaatctaaataaaatcaattttgtgtgtttttctatgatctgcaagagaccatattaatagatagggcaactttattttgatgcatgaagttaactatttgttttggtgttaatgttaccttacagtatctacgactatgtatcagcattctgaactttgccataacgtgatctgattatataatgtaggttattaaaattttttagcctatttaagtgctttgtcctagttatagctttttttttccattaagttatcacaatagtttataataattactattactgctttactgctaataataatatatgaaagaatgacattaaatgcagttataattagtttcaagtgaagagcagtgtagactatttcaagtgtcataactcatgtgttatttcaggtagatcatacatatcatgtagctatgtttaaccgtagctacctatcatttgtatctatctgtctgtctgtctgtctgtctatctctctatctatctgtcatctatcaatcatttatcagttgaagtaaaataataagtaattttaattggaaaatagcatggtatgtgaaacaatatgggctttgaattcagacagtacttgatatcacccctggctctacctctttgcagttttatgataacttttaagcagctgaatttctctgtctcagttgctttatcaataaataacaataagataataactaagtccatttcttttcatttctgtgagtagtgttgtcttctcagtgcttgtcaaatgtgaatgtgcatatcagttccatggggatcttgttctaatgcagattctgattcagtaggtctgagaagggggctcaagattctgcatttctaataagcagctagtccacctgacacagtttaagtagcagtgttgaaatatacactgggatgcagagagttagatgatgggctcaagtgcatttctagcatctaaagtggagataatgacatatcttttggagagttattgtggcaattacagataatagatacgtaaaatgatttctctggcttctgccacatggaaggagctcaggaggcatcatgattgtgattatctttttaagtattatctatgtgttaataaattatttctggttcacactgaagcaggtcctagctgggagtacgacaggaattattttgtccagccacactttttacagaagagaaaacttagacttccagaaggcaaatttccaaaagactgaaactctttccatcccattattatactttccttgtcataaaagctgaatgaatttgagatctgaaatgcatagaaagaattatttaaatttattttttttcaggctgggcatgatggctcacgcctgtaatcctggcactttgggatgtcaaggtgggcggatcacctgaggtcaggagtttgagaccagcttggccaaaatggtgaaactccgcctctactaagagtacaaaaatttgctgggcgtggtggcacacacctgtaatccaaggtacttgggaggctgagacaggagaatcgcttgaacccaggaggcagaggttgcagtgagcagagatcacgctattacactccagcctgggtgacaagagcaaaactacatctcaaaaatatgtatatattttttttcaaagaggactaggacttaaaaggcatttaaacatataagaggacattcctacaaagttgtaaaatgtcagtaagaatgtggaccttttggggctatgattacttactgttttgaatcattctttttgctactaaaggtgggaaaatggtacattcatgcaaaaatgactttaaacactgtaatatgtattcaagaaaatcctgtgcagtgaaccagataagctagggccattcctacaccacattgtaaaggctgggatgtatgtttttagcacctcacttttccctttctgtgaccttttccaatgatcatctttatcgccaggcacagaattttctctcacctactgtgttttccaagtctctaggagacactgagctgatatactcattcatgctttagagatcaaagaatgactccttgtagctatatttctattaaaaacaacaaacacacttcaaagattagggactgtattaatattcatttattaggatcttcttggtttctttcaaataatattattagaactctaactgtaatgcctctttggaagactaacttctactgagattttaagataacagtaaagggcagcctctgaaggatattttttttcaggtaacatttcataggatgttattttgaatattgggtattagcttctttgttgtttgtaggtgattggagaacagaatcagggctcgacgggctcaataaataataccgtcttatttttccctccccattctacccaggtatagaagcagttcagagatagacataaatcaggacagatatagaaaatattatcttgtcacagatgcaaatgaatttaggaaatttagattttttagctaggtggatttgctagcaatctgccgctaaagtagggagattcagcccagttaactggagagacccagttacagtcagtggcatctctgcacagtatcagatctccccaaagagggcctgtccccaaattacagaatggagaagcctctttgggcgggctggctgttgtaaaatagtggaagaagaatagagccaaggtacccatgctgagttcctgctcctaagtttaccaatcagaaaattcacaccttttcttctggggaaaatgtgggaggaggaaagaaagggggtcaagaaggtttttcttttgtttttttgttttttgtttttgtttttttaaatgaatatcccttaacaataagagatatatgttcttccctgacattttacagctttattctcttaatccagtaacttaaccataggtccaacatctgttttttaaaagcttacatctttttgtccctctctgcctgattcttctgtctaactcatttagttctgaacctgggcaggaaacaggggacctgtttattggaatcactgaaattcattatcctgtgcattggaccagaaaacttaagcaagacacagagtggaatttagggatgaatataccagcatagccagaatgggtgacttaaggccttaggtattggcaagtgtaccactttggtttttggtttacattacacagattttttaatttgtgtgattgttttttaactgatggggcctggccagttaccttcacaccttaggtttaatgacatggaccttgacgctatgctttaggaagtctttcaccaaacatatgtgactgtttttgtactggcaggtatacagaatatgtctttaaaaatcactagccatttggaagccagagcatgtggcctattggtaaactgaactacatagggaggcagaacctagtatggactcaaggaacagacatgctttaaaacatcaaaaaataagtgttttagacctcaaaacaaatagtgctttggttaaaaaatatctcaaggtagctgagcactgcgtgtgccacagagccccactgtgagctgcaactcttttaaaactgtgggtaggcaacgctcaaagggaggctttatctccctttctttgcaagcaggacaaagtgagtgaactggcaattaaaagcctctgtgtctgttggtagaaattagttgtttatggactcaaggaggaaccaaagagtttgggaaatactcttcagtcttactattaggagaaatagtaaaagaataagacaaaagggaggaaaacaggctgattaagctgaaggaagaaagagatttttattatgaagaacttgacaacttagagaaccacctggagagataggaaagggagttgagatggtgaagaaaggcaaaggaagtccaaccaaggtcttaaaagtttgtactgtagatattagaaaatgaggctctgttagttcttactgtatcagaagcactagctagaaatagtaaagtctaggggaggtaaaacctcagaaagccaactggtacaattgatctaaatgggtccaggacactgtggagagatgtccttttaaaactgaagcttgaaagatcgtagtaggtcccttgagattgagttggctatatcaagtatgaaaactctggacatatttaagatgttaaaatgatatccttgtaaaatgatcatagaatcgttagatgattagtgtgcaagatgacacatttaccgtgagtcatcattacaggaattgcctgtgtccttagggaatatgcccaagagatttatggaattggggatctaagggaagggacatgagcaagaaagacaaggcttaatagagaggatccaggtaacagtgatagtttgagtctaagattggtttatctattcacccaaaatttttggtattctgaatgtgtttatttcatttcattatggaagatgaaaacaggagggttatattagaaaataaaatatctgggccaaaaaacaaaggaaaatataatggaaagaaggcacttgaacacagcaagcagcactgccctacctgtgttagagaaggaaatgtggaacctcaaagcgaagtcagtcactttaaacttacctgagactcttgaaagaagtacaaaacagtagagagaaaagatatattaggggcatggtccatagtgcaggaaaacatgtagcaaaaaagaaatgctgcctaacttctaaaacaatcaaaagctgttgaatggtcacctgaggatcctgacacagggctatgtcctccctaattccccagggtaacagaatttagaaagattatctgcatcttctgccgaggtagttcagctgaaacccgtgttggaataggccaaagaggacaggtttcttagggattaacaattttctggtgagagttagttatcatagcctccatggcctagagtggagcataccctcgactaaacctgaagatgctagaaatatggggctcaaatgaaaatgagcatcaagaagttttgattatgcagaaatgaaaacaaagatgctacaaattagacttgatgactggatttgctgtcgttctgtatttctaaatttgtaggaaaacaagaataccattctgggagaagacagtggacatagatgaatttcctccttcagtgttgcaaatgctaagggcccactgtaccctcttggtgcaaaattgctcttgattttcagttgccagtatacatcctctggacatctgacatagatggatgtcatactggtgaagctgagaatctattccttattcctcagatgtcactgggtgttgttatggtctttggtagtgggtaagtactgggttctaggaatgccatttttcctggaacaactaacctaatggctagagattgcataaatttataaattttgtgagtgtggagccactgtcataacagtcttgtatgttctattcactctgccaattcttaaatggtgagaaacatatgtgattttggtgtcaaactaattttaaattgaagatggttccttgtggaagacaactcaggttggagtttctgaaaaaatccagtttaacctatgggttgagtgttcgtctggttgacatcatgaagaataagaaactgaagaactttaactgatatttggacttccaatttaccgtgtttgaaatttcaacatcaacatctggggactttcagggcaaagaatcttcctttccttgggctacatgtaaccatgaggaatgaaatctactagagtaagaatttgagtctctccactctttgccttactctttactctcagatgaggataatgacttccctgatgggtggttttggaaaaggagttgagcatccttagctcaacctactcatacttagagtaaattagccagatataattagcaagttcatttagctgaaaatctaatccttaaacaccaatattgcttttatgaataataaagcacacatttgctctccatctgcctgactcctaagattatctctcagttggtgtcaagcttgcgtagggaatgaggacatcatttattggcttcctcaaacttcacctttgagaatcctgatatttcttgatagtgtggattattttgttaatatttataatagtaaaaattcttattattcaataatctatttctaaaattgctaaggttgattaggcataagacacttcagtaaatataaaatatgttgggtattaagtggaaaaagaaaaatacagaatcaagatttcgaatgacaactggtctttgaagttgtctattcctacctaatatttttatgggggaatgggggatggttaaataagctaaaactgagaaaagataagatattagcttaggtcacacagtcgatttgtgaaagaacagtttctttttttttctataatcttgatgtaagttgagtttatacttgttgaattagaagaaaaataaatgctgaccaaagtctcataagtctcataaatcttttaaaacaaatcacctaatttagctcactcttccgatcaagtacgttctattatttatggtaccctgtttatacttttgggagtaataatttttttcctaccatctttatttcacttgataaatactgatgtctttctgtgtttctactggagcttgaaattaatatagttttatataccagtattaccaattatgtgagcatcgtgatggctatagggcttaactaatgttgaaaagtagcataggagtagattacattgttaaaaaaaagtgttccatttaataaatgcatatgattaggctgaagagacagagaataatttattcacaacaacattcttgccactgttccattctggggtcgccaacatttgtttcctgagctttaagaacttagactctttaactacttgttctccctcattttgtcattttatgtgttgcagaatatataatttaatccctatatgtgcataggatgctatgctctgaagtcagaattttgcagtagagtaagacttgagaattgaatggaagattaatgtattgagacagagggaagtgatttggccagatttgcatccccattaagtggagaacccagactagggcctccaaccttaatttctattttaatgttctgttaggtattttaatgaatgtattttccagaaaaagcccttttattttgtatagaagcctaatataaactcatgtaaaagtttccagtaacagaaaattataaaaatgaaaatacgaattggatataattattcaattcatgtgtaacatgcattaacctttggtgtatatttctccagatagctttttctgcttgtttacacctactatcctagaggtatttttcaaattaatgtaaatacccatgtactactatgtgaaatatgaatgtgctggttcattttatagatacagtatattatttttaaacatcttcctgttggtgggcatgttttcatcatcagcattttcctttatgctatctggttattctagcaattaaaatactaatgaatattttgcttcaatgtctttattattatattatgttacactgatatctttaaattacctgaatgtattgtagtgaaggctgtggggtagagtttcagctttatattttccaagaagataattagtttcccactgctacttcctgaaaattgcctatcttttttctccccactgatacactgaagccaggtattcagaggtttacacttgcagataaactttagaattatattgtcagtttcatatttttcactcccttgggattttattgaatttatagatttcatttagggaggaaattgacatctttacaatgtagagtcttcctattcaagaagaagatgatatctctacattcatgtgagtcttcttttatctccctcagtagttttatagtttttttcattacagtttctgcacattcttattgcttattttctgttttggttgttgccgttggatctatacaatttatttatatttttatttaacagcgttaggtattctgtatagtttcttagtatttgggattttcaagttatatgatacatcaaaaatcatttttccaatctttccaatatttatgcttcaattttattgtttaaaaaattgcaatgtgaatgatagcaccatttacatatatctttcccttctttctgattttaatgaaatggcacagatatgttgttttatcctttagcatcatgactgtgtcaagaacatgtagaattaagcctatgatttataatctatataatatggaaatcctattttcattaaaaacatatatagtgtatacacattatataaatatattttacatacattatgtgtgtgtgtatatacacgtgtgtgcagtgtgtgtgtatttgtgtgtgtgtatttgtgtgtatctccttttaaaacaaaatcaaattgctatacaataagtctttttgtcctgtgattacagtagacttatagtggcattttatagccatggatataccatggataaataagaataatttacaggtaagatgatctgcctcactgtaccaagtacatctcccagtggcatgttttcctgctaaaattctgactgaaaagatttctgcttccaggaccaagtgcagtgactcatgcccgtaatcccagtgctttgggagactgaggtaggaggattgcttgaggccagcagttggagaccatcctggacaacaaagtgagacactgtccctgcaaaaaataattaaaaaaaaaattaggcatggtggtgcgtgcctgtagacctgacaactctgtaggctgagataggagcattgctcgagtccaggcatttgaggctgtagtgagctatgatccagtacccctatactccagtggcagagggagatcttgtctctaaaacaaacaaacgaacaaaacaaaaacaatcaagatttcttctttcaattaatgaatgtgccttatgtcaatgactcatttcttaattaaaattaatgtgctgaattattcaagaagtttgaccttttactataagttagaaaattccatcttaaatatattgtagaaaggttgaggtctgtacaggcaggttgaaggacagttacaaggttttcataggaaaccttcttacctatttctgggacctgggaatgaaggagaatataagaggctgagaaaagtttgttaaaattggatttaggagttataaagttgtatttctcatgaagtgtacttacattattttctgtggtcaggttcaaatatctcttcccctaaaagagtgagggataaattcatgcgagagcctagagatttacattttaattgtgaatgggtgaccttaaaaatgttaaatgttttccagaaaaagacattcccaggcaacagtggatcttttattttattgtgcttactgtctgtggacaagggatatagtcatgtaggatgaaaggaagtaggtaccaaatgaattcatatttctggaaagaacaagaagtgatagttgagttcaagaaaagctattacaggactgaaaatagggacgaacaggagaaacggcttaaaaagagctgggaaaccctgatacagataagaggaatattgaatccacctatccaaaagtcccactgctaaggcgaagagagaaaggagtggtacaaaacagtattggccataaaagagaattcaaggggaccttcggtgggaagcaatcttgacctacaaaaatgaagtttaactttgatgcctaaattggattttgttttccaagaccatgagagtgagcacagcactggactgagatgaagactctactcattcttcaagaactcctctgtgaagcgggctgtcagccattgcttctcctgtgttccctctataaatgtgactgcctgatttgtttatacttgatagaaaggaattgtcttatgcctgaatagaggatagctctataattgaatcaacaggcagagagaaaaaggaagagctcatgacaaaggcaaatgtaggaaaacagcaaggcccagaagcaatctctgttttgcctttgacataggagtaaaaagcgaagctgagagaaaacaagcacagaaaggggctgctcacctagaaaccaggtggacagtggtgtaccttctggctcctggtatttcgtatatcaaacctcaagtctagtcacatatacgtataaattatgaagactttcttgtgttttctcatttctaaatctttgtatttttccttattgatctattgccaatgccttttactacttttctttgatttacaatagacatttctttctttttcttttttttttctttttttgagacggagtttcaccatgatgcccaggctggagtgcaacggtgtgacctcacctcactgcaaactctgcctccccagttcaagcaattctcctaccccagcgtcccaagtagctggaactacaggcatgtgccaccatactcggctaattttcatatttttaatagagaaggggttttaccatattggccaggctggtctcgaactcctgacctcaagtgatctgcccgcctcagcctcccaaagtgctgggattacaggtgtgagccaccatgtccagcttacaatagacatttccaaatatattagttattgctttaatgtagaactctaagttgaggattggattcaaaaaattttttaaacaaggacacatttttaaaggaaataatataccccaaatgagaaaaagcccgttagctaacgtattatacctcaatgtcctattttctaaaaaattatttattagcttttgggatgaattaatctgtatgttaagctgagattcagcaaaacaaaataagtaaattaactgaatttgaactcttttcttacttgaaaaatacaaaaaggcaatgatgcttaaagaaagtaaagataaatgtgaacaaagtatgaatagcattttctacatgctttgcatgagcgagtatatgaaaaactgccataaactttaccttattttattttagtgggtaatatgttaaatttagaaaaaatgtgagttatcttttcttctgtccctctgtcttgattcttccccagcacaggtgtgtggaatattttaaagtttgtctaaagaaataattattataggtaaacagatataagtgtattgagttgggcaagatgtttttccagttccacctcaaatgtgagaaaaaaatagcagtgtgaagctttgattatgaagtctgggacattcttactataggcaaatactttcagagtagagggcccatgaagattaatttatgttacagaaacaaactttctgatgattcataaactgaatttcttagttcactttgttatttctaaagaaatttggtatgatttgatatgtgactacccccatggtaaccagatatagcttgctcatgcatttatcgtaattgacgtcaaagaagtgatacttccttgttgctctaaatatcttccctggagtctaagaacttactctaattgagtcaattggcatccttcacggatttttttctaacttcaattgcacttaatctttcattgttacccaagaagtcctgcagtaggtaaaatagagtcattctgacgcagtcacagtcctgggccgaaagggatggtggccaggctctctagcaacatattatgcatttattttcttcattgtgttcctattcatggaggacatatagtattcaggtgttttctaagttcttcacaagcattatttgatttcaatcttgatacaaccctgaaaagtaggctttattgtcttcattttacaaagaagggaaacgagtttaagagagattaaatataaagtaaaatacaaggcaaggaattaaacctaagtccttcagattccaaggcttgggttttattcactatgtcaagttgtccctgtgttgctatattttggttctcatactcttttttttttcattgtcttttgggaagaaatataaataatacccataaaagctagctttctgttctttaaagcaagtcaaatgaatggttaatttttttctaagtatttatatagaattaactttatgtttaaaatacagagagattccgcatagcaaaagaaactatcattggagtgaacaggaaacctacagagtgggagaaaatttttgctctctatctatctgataaaggtctagtatctagaatctacaatgaacttaaacaaatttacaagaaaaattacccattaaaaagtgggcaaaagacatgacagatacttctcaaaagaagacattcatgtggccaagaaacatgataaaagctcaacgttcatgatcattagataaatgcaaatcaaaatcacattgagataccatctcacgccagtcagactggcaattattaaaaagtcaagaaacaacagatgctggtgaggttgcagagaaataggaatactttcacactgttggtaggagtgtacatttgttcaaccattgtggaagatggtgtggtgattcctcaaagatctggaaccagaaatgccatttgacccagcaatcccattactaggtttatacctaaaggaatataaatgattctattataaagataggacctataatcccagctactcaggagtctgaggcaggagaatcgcttgaacctgggaggtggaggttgcagtgagccaagatcgcaccactgcactccagcctgggtgacagagcgagactcctcaggaaaaaaaaaaaaaagatacatgcacacacgtatgttcattgcagcactattcacaatagcaaagacatgaaataaacccaaatacccattaatgatagactggatacagaaaatgtggtgcatatacaccaaggaatactatgcagccataaagtggaattagatcatgtcctttgcagggacatggatagagctggaagccattatcctcagcaaactaacacaggaacagaaaaccaaacactgcggccgggtgcagtggctcacgcctgtaatcccagcactttgggaggccgaggtggacagatcacgaggtcaggagatcgagaccatcctggctaacacggtgaaacgcagtctttactaaaaatacaaaaaaattagccaggcgtggtggcgggcgcctgtagtcccagctactcgggaggctgaggcaggagaatggcgtgaacccaggaggcggagcttgcagtgagccaagatagcgccactgcagtccagcctgggcaaaagaacgagactccgtctcaaaaacaaatcaaaacaaaacaaaacaaacaaaccaaaaaaaccaaacactgcatgttctcgtttataagtgggagctaaacaacaagaacacatggacacggaggggaacaacacacactggggcctgttgtggggtggggttaggggagggagagcattagaaaaaatagctaatgcattctgggcttgatacctacatgatgggctgacagatgcagcaaatcaccatggcacacatttacctatgtagcaaacctgcacatactgcagatgtcctggaacttaaaaataaaatacataaatattctcttctaaaggtttgcacttcataggaaattttgttttgttatagaacatcaacactattcacccagtacatggtatcatatttagtttatcaggagttacctacaagttagagacataagagggtgagatcttgattaagaacattggatgcttttctaaggagtcatcctggaagctatagggaacactgagttcgaattggagttgggtggtctaggggcatggatcccattgaagagagctagttaagaaataatgaagactgaactaaggctgacacaaggatatattgcagagagtgaatacaagaggctaaagtcatggaaacaacatgatttctaaatgcaaaggaattacatgtttatggcttgattaactggattggtggtaaatgccattcacaaatgtaggcagtttaacaggaggcccaacttgtattttgaaataatttagaacctatctaggaggagatatttggtaaaaaatttagtaatttcaagagtggtataggttgaataattttgagggtcatcagtgtatagattagacctctctaaacttcaaggaatgcaggctcttaaatatacattttcttaaaagagtaatctttaactcataatctgtaactcaaaaatgatagttggttgattgaagctatggttttaataaagtcattgggagaaggaggaggaacagaggcgtaaacacagtgaagagacgataggcctgaggatgaaaaacacaacacacacttagttttgggatccaagggaagaaaagtaacacaggaagcgactgaaaaggagtggctagagagatacaaggaaaactagagtggagtgttgtcacagaagccaggggtgggagtgtttcaagaatgatgatgagatcaacattgtcagccaccacagaaaggtctataaagatcaacccaaaacttcaaaggaatttggtgacatggaggtgattgttgataccagaaagaagaataatggaagtgaaaaccagatggcagtgggagtaagaagtggaaggggaagaggacttagaaaggatgtcaagtttaaggaagagctttttttttttttttaagtaaatgaggctggagcatattttattccaagattatagaagcattggaaaggaaactattgattggagagaaaagcctggagggatgattgctagtgcatgggtcttggggatgtgggaggtgatcagatgtaaatattcaagtagtttgttgagttttggacaataattctcaattcttaattttccagagacaggaagggaatcagaatcatggtggcagataaagataagctcctgcttgccacataagtacgttgagtccttgatattggaagctacattgagttagaatattttgcactccacttcttatggtgttcggttatttttccgctagcagtataccataggctgagcatggggatggaggagactaatgattagaatgattcagtgataaggttttgtaatataggaatgacagaaaagcaaggggtaagaaagttgtacattatagggtggagcaagaaaaagataaagcctcatttggtgaacagagtgtagattggtataaaaaaaactgtaattccaaaatcaattgcatttccattgtcaatgaaagagcacaagttctgtaagatagaagatgtagtcaaagactagaatttaaaatttaacatcatggataatttaaggcctcattgtccaatctgggagagtcactgaaatgtaactactacaaattgagatatgctatgatgtaaaatatacaccagactttgggccctttgtatgacaaaaggaatgtgaaatattttatttataataatttatgttgataacatgctaaattatgatattttggtgatgttaggctgtattaatttgctagagctgctgtggcaaagtgccaaaaactgggcagcttaaacaatagaaatttatcatctttactgtttttgaggctgggaagtccaagaccgatctgcttcatgcttcttatctagcttcttgcagcttgctggcaatggcattcctcggcttgtagaagcatcacctcaatttctgccttcaccatcacatggcctcccccctgtgtacctgtctctgtccaaattccccttgtttttaagggcaccagtcataatggattaggagtctccattacactcatatgatctcatcctacttaactcattttgttttcaatgaccctgtttgcaaaaaggtcacattttgagctattgaggcaagctcaaaagtcacattttgagcttaacatatgaattaaaattcatatgttaagacttcaacatatgaattaaaattcatatgttaagacttcaacatatgaatttttggggatacacttcaacccatgacataggctacataggatatattggtaaaattaattttacctgtttatttttaattgtgactactagaaactttaagattatgtatgtggctcacattatatttctatagtatgtgtgtcttttgaacaatacctaacactaattgagccttgggtatatgcaggcatttttctaagatctttatatatatgaaattttacaacaaccctgttcagtttacctctcatagagggtagacagagaatatccaacgtcgcatagacagtaagtagcagagttaggatgcaaatgcaggtgttctgactcctgaatctgcactctgactggctctagaatagtacagctttatgaagaaactagtatattttgtcagtcatgggaatttgaaaaatattatttcatcatattacttggcaccaggtatttctctacttgttaatctcctcttttcattttcagttttctgtgatctctgcctcagtttctcttggtagccttttatttcttgcattcgcatcctttactaatcaatatctatatttttcctgttaccctttgtaacaggaagatgtcttatgtgctttatttacttatatatgtttgatggcagagcaatatatttttgttatcttaacctgtcttttgttttaaaaccttcctagctattattaaaaagcaactcttctgtatttgtgaaattcttttaaaaaaataacacccagtatacctttaaataccatttattttgtgactgtgtacagatactctgaaaaagtcatggcaaaaagcactggaatgagttttggcaaaaatttaaaatgtgctgtttattagggaataataacttaaagactgttactcaacatgagaaagatattttaaaccaaattcattgggcaatggtggatttaaatgattgaagttcagtggaataccaggttttgtgctcataaagctgtgtgtttatatgttgaaatatggctgaatggaagaattgagaaactttgctttcatttcctggctttaccacttgttgcatgaccttgccctgggatagacaaaaggaatcaagacaaattgagtgggaggctacatctagaagaagctctttcaacaggtacttcagggactcaaattttctcctgtgagtttagttcaatatcctgtttttttctaactgttttgtagtgccatctttgacctcagtattttttatcttgactttgaaacctgtacttgatttcacccttactgcccccgattttacctttgaatttaacttctctgtttctcacttgggcttagtgatgtggtcttgactttcatcaagcttttcttggtcattgttttataccctaactccataaacttgacacttaaatatagctaaacttcagttaatctcctcagtatagatcagggggaagaaccagacactgcccctcttcctgacagtaggaccctcaagtccctttgttactagctacttcatgagaatttatgacctcattacaatttattctaaatgactacaaatttacgtaagatagtgtgaggtcactttgagaaaggatttccttatcctactactacgttatgtattactgaaatttttacatgaaaactgaagtctagtcagtcatccacatttatttgtatgtatctgtgggatgcccactttgtcctctatgctgatgtttctcaaactttagcatacaaaaaaatcacctggagatctggttgtaatgcagacttctgggtcagagactctgattcagcatatctgggggatccacaaatttgcacttctgacaagtcctctggtaacattaatggtgttcttctgacacactttggatagcactgatgcagaccaagattccaggtgatcattggcccaaatgactgggtaacatgttggtagcaggtaacacacaggtcaacctcattcatttcctaaggaaaaataaaaataaagcaagaatattgtagttctttggtttccaaatgctgtattaaacatacgtatatgaaagaggagtggctaaactcagcagtggctctcataaaaatggttttcaaatctgtagcccagaaaccttatattaggaaaaaagatggttcaggttatttgaagcaaagtaccctaaaaattgatctttccctaaaatatgcaacctgttatctttaacaaatattcattttaaagccattttaaggattcctgatttggaaaaggaacccttcttatggttggatgaaaatatatatttttttaacatttaaggaaatgtgtttttactgtttgttgttatatgtaaaatttacaatgaaataaattttgtgttatggttatcagtataatttatacatcagaaaattaaatatgattatactatatatatagttatctacatttagatacctatccaaaattgttatgattttaaataattaagaatataaattatattttttaaatgacaaaatgaaataaagaactgcaaattcttgatctaacataatggtttaatggctttattttcttcagtcaataaaatatttaatgagcacatactgttagcccagcaagcaggtaggtaatctgatacataaaagacatagaaaggttgattctaccttaaatatatgcttctggtatagcatataaaaagtcccaaatctactctacaagacaacatgatctaggtgtttgggaaaggatataaatgtgatcagaaacaagacttcaaagaggtatagaattcatgagaatgtgtgcatgtgtctgtcacagagcatgggtggatgtatgtaaaagtggagaagaattaggaagcttctgtaattcaagttatcagtcatcatcagacactttgaaaatattaactttattttaatcttttataacatccataaaatcattattatccattaaaaataagatattaaaacaaggtaatgaaataaaatatttataagagaaacaacttgctaaggataatatatatatgcgtgtgtgtgtgtgtgtgtgtgtgtgtgtgtgtgtgtgtgtgtgaaatacatacctatggcattcattcatgtaatatttaagggcttaccctgttttttttgtgcagggtatacatgtggcaaacattaataaatataatgtgcacctctgtataaatcagccatgaaagatgctgattgcttcatggaaaaagtgcatggtgaagttctataggttagcactgtcatcgacagcaggtttcacattccacgcttgaccctgttattaaaccgatgtttcttgtcgttatttaaaacaaaaagttatctctgaatgttttatttaatagaaccttttagatttacattctatgtgtagtagtgatggcaatggccttgcagacctccaactccagcaagctgacctgactgagggcccaggcccagagctctgacatcatttctgcattcctcctgaggccacacctttccgtgctgccccctgtcgggcatctgtgatgtggcagggatgctaagtctggcctgttcctaggaaaaacgggacttccatgactactgactttggctccaggctgcccttacagttttgctgaatcttctttagactacacagcagactagaacctttcctctaaccctcccttcctctctcctgcagcctgggtcatgcctgtagcatggtctgaaagctctgccagcatttcctggctccctctcaattttctttcattggcacatcccctaataacattcttgcaaattagtcattcccatcttggcatctgtttcctagaggactctttctaacacactgtataagggactatacaactatcctctaaagaaacatatacacttaagtaaatttgaggccaataatgagagcctgtaatcctgttctctgattgcagagtcagtcatgaaatttgaaaggtaattgctgctgctgctaaaggagcctcctctgtgttgctttctttaaattgttactcactcagtggtgatccctttttcttagaacttcttaataagattatatactagtgttgtatgctagtatgaaaaatactttagcatacacagtgctatcctgattccaggatgcttccctttagccttttcattcatttatcaaacatttattacaaattgattttatgtcaggcatgatcctagacactggagcacatgtgcaatgtgttgggcataaagatttattggaagagtggcactgtttatctttccatgaaaagcaaaatgatactgtttttaattgtattaagacaggttttttttttcctggagtggagaagtgaattaagtgccatttaaaaactaaagtaaaatatgagattgtcactcttacatcttaaacaacagaaaattcagctgtattttttgatatatataaattgattcttcttgaaacaatgatccataaggccttttaagtttcagattacttttattattttattttataacatatttattgtaaaaagtagaaagtataggctcacagaaacaaaaaaattagtaaattttctataactctggcatccagaaatagttactgttaactttttactgtatagtcttacagatttttttgccataaaacatacatacacatgcatgcacacacacacgtacactcagatatattaccaccattgattttctcataaatttattgagcatctttcctgtgccaggcattgtgtgtgaggactgtggagacagagcaaaaggaaaacatccttcccactatgagaatcagtacaacttgagaatcagtacagtgcggtatcaagagtgtggactctgaatatgggatggctgtgtccccacccaaatctcatcttgaattgtagttcccataatccccatgtgtcatgggagggacccagtgggaggtaatcaaataatgggagcggttacccccatgccgctgttctcatggtagtgagtgagttctcatgagatttgatggtttcataaggggcttttcaccctttgcttggcacttatccttcctgccaccgtgtgaagaaggacctgtttgctttcccttcttccatggttttaagtttcctgagacctccccagcgctgtggaactgtgaatcaactaaacccctttgctttataaattatccagtctcaggcagttccttatagcagtgtgagaatggactaatacaactcttgagtgaggccattgggtgacatctttctctgttctgtaccatcctctacattggatataccacattacacagctgggactggtttcacatctttaaaatggagtaataacaataactactacacacgtttcttgtgaatatacaagctcttattcagcacagtgtccaggctatagaaagtgctgagccattgttattactacactactagttgcctctttctgatattacttagagatcactaactgccatgaaattaatcaattctcagtgctattcattctggattatgctgaaaactgcccttgtgactgaaaacaggacttatatttgcaatcccagtgtgttgttccgtccacagcatgttacgatgcagagaatgtctatattgatcagcagtcccaggggccttttgtttacctgagttatagcatctctgtagcatgactggataaatcttttatgtggctgcccttcaccccagtgcccttctcaaatgcattttagtatactccacatggcttgtattcttctgatcatctcaaacatatcacctacattcccaggcagtcaaaagtcaccagaaacttaatttattgctactgattactatgttcaaatttataaaatacatagatttttttaaaaatttattttgaaataattgtagactcacaggaaattgtagaaaatggcacatagagtcccattatccctctacacaacttccttcagttggtgacatttcacacactgtagtgcaatacaaaactggaacatggacaaggggacatactctgaactggactgcaaatcttattcagtatttaacaattttcatgtgtacttgtgtgtatgtatatgaagtatgtatgttatataaacatacaatttcattgtatgtttcagtttgtgtgatcattaccagaatgaagatatagtactaatatattacctaaaagggacagtgtcatcctacccttcatcaatatacccatctctcacttgtgtccatgtctccaactaccaatctgttattcatctttatagttttgtcatttcaagaaggtatacaaatagaatcttgtagtatgtaaccttatagtatgtaaacttgtagtatatatttttttcacaaaatatacttcttcattctgcctttattttatctttactgtataccaagatcatctttgtttaactagctttctcatctgttttcaattgttcttttatgtagaaaaacaaaacaaaatgaaaacaaaacaagatgagtaaactttgaagaaaagtaaaatttcctggagaatataaaatatacttgaagaaacttagttttcaacctttacttaattaacatcaataaaacaattttaacctgtcccagttatcactgactactcatattaagctccagggaaagcaattagaaaaagaactgtgaacatctgtgaaacaaaattcccataagttttttttttttttttttttttagcacagaaggctaaaaaccatttgttctcaactgggggaaaaatcttttcttaattttaatgaaattataaaatttcatggtgaaattgaaaagagctttcacttaagttggtgccttctatccagcaattttaagcaagactttctcttcaaagtcattattaatattgagtatatttctaacattgctgaatattcagtaagtcattgatataaattcaagtaattcaaatgtcaggctgggttctcagtagtgatttatatttggcaagagttttatgagagtgcattattagtttgctgactgccttaatatataaaggttataaaaagagtttcatccaacagttatgaatttcaccataccactaggtaaatgtaagtaccccaaaaatgcatgtggctttaaaacttctgtagaaatggtcaaagagcaattcatctcaaattacagacacatttttttttctcattaaaggcacatgaggtctactcacattctgaataaaaacatatctgataaatattttgatagtattgtagttttgagattcacattagtttattaatattaccctttcctagtctatctcagatatttctattgatgactcatgtttaactctatgtgcactttggtcactttgacttatgaaaacatttatgctgggcacggtggctcatgactgcaatcccagcattttgggaggccaaggcatgtggatcacctgaggttgggagttcaagacctgcctgaccaacatggagaaacctcatctctactaaaaatacaaaattagctagtgtggtggcacatgcctgtaatcccagctatttgggaggccgaggcagcagaattgcttgaacccgggaggcggaggttgcagtgagccaagatcgtgccattgcactccagcctgggcaacaagagcaaaactcagtctcaaaaaaaaaaaaaaaagatttataaagataaatgttctatattaattaaggaaaatgtgctgtgttaattaaggaattctaaacatgtgttttcaaatggcacactctcctgatgactgataacaaattatcttctcaggagactaagtcatggagaagtaggttgcttgttggacaatgaattaaagagatttggatttttcttaagaaactggttaagggaactagaaagatacagattccttgctcctactctggagttctgagttaggaggtctggcctctagaatatattaataggcagatccaggctattcctatgcaattcagcagagaaacactgcttcaaatattgtctctccttatctgcaaataggttccaagactcctagtggatgcctgaaacctctgatagtcctgatctcaattgtcatcaataagagcatgtttccatttatgttttccacctacaaatctaatgtcttttccatcttaaataagcgttcaccatgctctgtggctataccttttgtaaactgaggtgcacaagcaaaactggcacttttttttcttatttacaatttcatgaatggaagattcattctcactgtagatcttagcaacctcagaatatgatttttatttttttcttattaagtggggaacttttacctttcaattaaaggaagtactttatggcttctcttggcatatttaatcgccagcattactactctttcactttggagctattattatgtaaaatcagggtgacttgaacacaacaagcactgtgataccaggacagtggatctgattacccagagggctaagcaactaaacgcaggtaggatatacagcacaaagggatgattcatgccttgggagggatggagtgagatgctgggagatttcatcacactactcagaatgccaagcaatttaaagcctatatattgtttattctggaattttccatttaatttagattccagttgaccgtggtaactgaaaccacagaacttgaaactgcatgtaaggaggacctactatagtttggtcaacttaaagggaatttctacagagtattgctcatattgataacctacaggtcgtcacagttgatcgtttactttaggaataagcaggcttcctaattaatccaccttggggagatcttttgacacaatggtggcattctgtctctggctaaagaatattatctcaaattcctcaaattgttgacgtgctgatcaacgtataacctgctgacactcaataggacactgatttatttaagaatatctgaagcatgaatttctactcgttgtcttgcatgtagacatttttcagtttgtctgatgtcatctgtagctaaggactgtaacttctgtattgtattctctaacaaaaagatgacaactccagtaatgaggactgcctcttccacttttcaaacgttcctgtaaaaacctttcaccttgtgacagactccaaaacacccccaactttgttggtgtgtctttccaggttgatcctcacatttggcttttaataaacccttataagattatctccgcccccacagccttaatttccatcaacaaacaattgaactcatgaacatagagagtagcaggatggttaccagagcctgggaagggtagtaggggtgtagaggggagatgaggatggttaatgggtacaaaaaatagaaagaatgaataagacctgctatatgatagcaaaacagggtgcctatggtcaataataacttaatggtacattttaaaataacttagaatgtaattggattgtttgtaactcaaaagataaatgcttgagggaatggacaccccattctccatgaacaaaacaaaacaaaaacaaaaaaacataatcaatcaaagaatccttttccagaacaatgttgagaacacttttcttctccctagcttccccctctttctcccttcctctttgtctagtagttccatcagtttctaagttaaaacatcataggcaagttatgattaattaaatcacatcttatattagacttagaatttttaacagctttcaggcataattaacatacaattaactgcacataatttgaatgtacagtttgatacattttgacctatgtataagcaagtaaaatcatcatcaataccaagatagtgaacatatccattcaaaaaaaaatctaaacctaacaattttctcgtgtccctttgtcattcttctctcctacccatcttcacatccctgccccccatcttcaggtaaccattgttctacttcatatgttaaatgcatctctaatgtgacttaagaaggcattaccagctactgagattttagaggcacccatagatttcagttggatatttaccagggcagtttcacttcctaacatgaatattgttggattcctggttccatatcggtgaattcctggttccacacagtgagaattaatataaactttctgtagggcaacacatgttccatgatgtttaaaattgcacatagatccagaaattctactttgaagaacacaggcatgtgcttaaatatacttgtatgaagacactcattacattgaccactgtataatttttttaaaaatggaaaattcacaaatatgcttaaataatggattcggtaagtaaatagttagatacttgcatagtggaataatgatgaaattattttgtggattattgtttactattgtagaaagatatttatatcactcatgaaactcagtcactgaacacagtatatttatataatatgaaatattaaaacacatacatatatacatgcatacacgatgtcaggaaggatatactttatacactgtctctggttagttgaattgtgagtattttaatatttgacttcattttttaatagtttctaatgtttctacggtaacaatgttttggaaacaaaatactattgcaaattgtatttactgcagtgcatttagcacaatgcctggctcttcacatttacagggtaatttcttctttctttattgcttgggtgtttttaccctattattaaggcttaagcccaggtggggcttggcccatttttgccattgtttcacctcagataaactcatacagagataatcaactatttcctttattatattatcaaagcattgcttattgttctataattgtatctgtaacacagtattgcaataattttcttatgtatttttctcctactttgggactgaaatccagttaatggaatcaatgtctctgatttttgcttgcttcagagtacttaataaatatttattgagagaccagcagattaaatgaatggtctccatgtatcaggtacaaataagaaagtgatcaagtaagtgacaatttttacatatagatttagattatttcagattgtgtatgttgaaggttgtattcattctttcattttaaaaataaaattaatgaacttaaaaatagtttgcagaattttggcaagatggcttgtagagtaactgttgtatgctaggacaattcttagggaaaattctgtgtgtgtttgtgtgtgtgtacacatatgtatgtatactaaaatttgtgaacaatcttaatccttcaagattggaaaagttagaaaatatatggaactaaatataagttataattagttaagttgtatgtgtaatgttattcatatatggttgaaagggatttttaaattaaatatatcacttttgtaataaaaataagcttaaatcataaaataaaatctcaaaaggcatttaatcatatataatcatatatctcaaaagatatttaaaaattaataaaagtcaaaaccaacaaatattttatactaggtagactttataatgtgtactctactaagtagagaacaaaatataagttttgatctttatcacttggtaggatacacaatatcgataagaatattactaaggatgagttctaaaacaataataaacaaacagtgccctatgtttgactttgggggaaaaaattcaaaatgcctgtcagctaaagatacattttttaaaaattatggagtcaattgccaaatgtagatacctgctagtctgtcaggagagactggtatccggtgttcaactcccagaggaatctctcttatggggtgaaaacaactatggagtctgttaactgaacagcacagcattgtatcattgaccagagccctgaataaacagaagtcacaacagaggcgatgtgcgtatacccaaggatccttttagtgatcgttgtgtcagctgagaaatgcttcccatagagtcagcccctctgctgtattttgccccttcaaaattcaccatacttgcctaattctcactacttttactaactggtttgaaaggcaataaggccttttgtactctttttccaaaaataacagaaacagaggcagcgtggagtaattaaggcacttacattgacagatgaatttattgtcctattttctacctagttgcatgtgctttctgtagatgtaaagtgtaagtttttggaatagccatattggcatcatgcatgactgtcacctaaagctgaatggcaagcaatgatttaccaaataaactgctattcaagaatgtatccatcatgagaatggaaacaatgattgcagaggtatagatctgggagtaaggatgggtatgtaaaatggaccatagcctaatatttgcctaattgttacacagcgtactagagtaggagaactatgtgttgagtgggaatcagatcttcttcaaagactttagcataaagtaagataaatgtgagatgttacaaataattttttaaaaaacaacaaaaatatgtgtagcagagaaactccacttcatgaaatcacatcagttgtttggtgaagacccagataaaaatctcaaaacttctgttaaggcatttctgactttttcatccacgaccaatccacgactggcctaaagcaaaatgaaatgctctcttctttgaagtattaatttttggataattttaaaaatcacatagtgtttctcctgctataccaattgtgtttgtccatgtgttcaacaaattacataatgtttgtccatttgttcaacaaatatttgttgagcatctgtaatattttagaaacagtgctgggtgctggtgataaaaggctaaacgatgaaggctggcaatacagtttagcaaaaaggaactcagggtttgtaatgggagagacctgggaacaatccaggctctacttcttattggcagtgggacatgggaaagttactaaatatatatgagatactcttgtactcctcctgcaggtgctgagaagccatggaatgttttaagcaaggacatgatacaactagatttgcatttgtgaatgatcatactggcaggagaaagaagatggctgaaagagtgagactgcaagtagggagactccttagttgagtgctgtaattaataagagatgatgaagacttgttttaggaaagctgctggggtgaagggtcatctcttcgaaatggagtgatgagaagagtaaaggaaagggagaaatccaagatggtagtcagtgtatcttgggaaactggatggatgctggtgctattaacctaaaagaaaaagattagccagtagatctcaactggggacaattttgccttccatgtgacctttggcaatgtctcaagataattttagttgtcacagctcagagtgggttgcggattctatggctatctaatgggtagaggccaagggtgctgtttaggatcctacagtacacacgacagccctcacaacaaaaaaattatcccacccaaaacatggatattgagagaccctagattaggaaaagagaagtaggatttagacattttggtagagaagtgagatgctaaactcaagtttggacattttcaatttgaggtactcactaaacctgataaaaaaaaatcctgcctaagttatataacttgtcacagatcaagtggtagaggtctggcatcaacatggaaatattagtggcagccacacatcaaagaccatggatagtatgtaaacaatatagaaagactcagttacgcatacatgtagaaagtatggttccttttaaaaatttaaaaaaatacatttgtttggagtattatttgaacagtgctgtttgtataaaaaggaatagcaacatgagtaatgcctactttggatattttcaaatattatcttatgaaattgagcagtgcattatgtttttatgttttagaaagcaacacaaaatacatttcattgtcttcaagaatttcctctttacaaaatatttttaacatataaatacatattaaaatatatacatatttaagtttatgagaggctggagtagggcaagcacattgaaagggaaaaaaatcagatctgaaagcaaaacttgatttagttcccacctatcacaagtttatagcacctcatgcttttcaaaaattcttcctaaagggtgaacaagtctatagtttatgtaatactgataaaattcaattgaaatataatagtaaatagaaacataacattggtgttatggccttagccatagcacatttcttgttttcaaattggattgtttcatattttgggggaattttttggggggatagaataagttcataatcattctttttcaaagatctgttaggttccaagatttaattaataaggccaactaattcacataattgattccaaagttaaaattttcaatccaattaggcacccaaattgacctttcttgtttaatgccatttgaattgctatactcagcttatgtttaattatagtatctatgtttaattattgcatctgaatcatgtttaatgagctccctgtttaattactgtttctgactaatataattactcttaagtaatctctgccattattagctaagcttcctaagctctgtggggtctgtctgtcagcctgattctccgggctcaactttcctccatcatccctcatatgtactgtgtgccagaccctggattctcttagtgtcattaatgtgcaaagttacttcctacctcggggccttcacacttgctgattcctgccttctgctctgatctttagatctcagctcatgacactagtggcagaaacaatttccttggttttctaaaatacttcgtgccccactccattttagtgttatcaggctattgtgtaattttcctttatatcatgtactgcatttttttactatttgtaatctgtgttttttattttatgtctcaaactctaggtagcaactcagcatcatgtacccagcagcatttgttgaataagtaaataaatatgaatgaattaatgattcaatctgtcaatcacaaaaattaaatatagccttgtaattgccagtacttcatatatatgactttctaaagccattacattcacacagtgattaaaaatacaaatgcatagaaaaaccagaaaataacaaaaatgagtatagtgtcaggtgcaagccaatagggagcttggtgaggattttcagggcagtagcgaagtgcccttggcatttagattcaatacttttaatactctgggggccaaagcataacaacattaagcttgtgggccctgtatgttagttcttggaagctgggagcagtggcagccttggaatactaatgccaggcagatggttggttatggtcacatagcacagctctgcttacatgtccctaagccaaagaccaaaatgtgcctatgaatattcaaggatatttattatgctctttctaagatataccattcatttaaatagtgttaagttacaatatatgtgaaaatagaacaaatctaggagtagtccctttcaaggaatctaagtagaaatttatacttaagatccaaaacaaatttgggtctagcagcctcgagatgtttatcaaagacttaggtagtactatatggtgccatttccaattaccacctgtcccccaccgcctccaccatgatcgccacctcctggtattcacacctctgtgtaacaccctccacttgagtgtaggctggacttaattgactcagttctgagagaagctgtcatgtgttgagtgtggaaatagatgaagactacctaaatcagaacaaacaaagcctctttattcagagcttgctacagcaaggtagtcagtcatcattgcttgagtttggcagagaatcaaaggcaggcagaggaatagagaagcttaatagaggaaaaaaagaaaggcttcaggttgttagaggctgttggcatggggaaactgtcaaaagaataaatagaagcagggcatcatatgtggttggttaggggaaacatgtttgggtttgtctagctggctctacattggaaacagcaaacaaaaaattggaggttatcagttattgattaagttttggccatttggggctgattgctacagaggctgtggtttgacttcctggatggtttgctgcagaggttatggtttggctttccaaactggttgtggcagcttgtgggtcagagttttatttttatgtatggtctgcccattgtctaaatattgagtctcttatgaggcaccctgtggagtggcccacataagtgagcctggaagcaaatatctgaggcctgccaataatcacatgattgagcttggaagcagatcctcacccagtgaagcttggagatgactgcattcccggcagattccctgaacataaccttgtagaagatcctcagctgagactcttcctgtaagttactgtctgatttctgacaaatagaatctatgcaataataaatatttgttgtcatcaaccactaaattttgggatcatctgtttgcagcaatagttaactaatacagatgggaaggatatggtcttttgttaatcagatcaccaggaaatttagctcaaggatttcaggtaggtttatctggaaggcatagacaattgtagtatttctcagaagggaccatttctatctcagaaatacaaaatctaagtcagaaagttaagtcactactccttcttaaaccttctcctccttctctattattttatttaatgaaatcatttaccccacccactggctaaaaaaatctctagtcttctttgatttttgaaccaaatatttagtatctactatgtacaaggcaatgtgctgtcacttagaatggaacacaattacttgctcttgtggagcttacattcttttgagaaaaaaatataaaagaaataataaacatattacttgtgtgtggaataagggcagattctacatccttgcaggggtagaataggctttgttgatacacactgtaaggcaagggtcaccgagagaagtatgggtcccctgattcttccacagtctggcagggccttctgctggccatgcagtggatctgggttgcggtgaagggacatcaccctctgttgcttttctttcttactgtgatggcatgtggacaactttgctggctgttggaatgactatttgagcagaatatctgggcagcattttagaattgttttttgaaaaagccagatgttcgatacctggtaaccctgggaattttcaggccctcattccaggagaagatgcccctgggcatgtggatttccatggggcctgagttcaggtgcagcccctccagccaggattgggggcaggttcctctgtccctcatcaagaactcttaggtttactttctggcaattatgcttgttgcattgccataataaataagtcatttatgcaatgcattatgtgataagtactgtggggaaaaaaaagtagaaccttctacatagggcttgagagtgggttatattaaatagatctactggagaaaacctcattgagaaggtgacattggcacagagaattgaaagaggccatgaggacatctagggaagaatattcctgagagttgggggaaagtctgtaagtcaagaatgtccttggtgtgtttaaaggactgtaaggaagccagcatagccagactggaatcagagaaagtgagagaattaggagaggaagtgagagaagcaacgaggggtcagatcattcagggccctgtgggactttttaagaacgctattgttacttcaagtggagtggggaacagtcataaagttgtcagcaatgaactggcacggtcttatgtcttagaaatttcattaaactgctgttttgagcacagtctagacatgtctagagttcagacaagagatctaggctggagatacacaattgggagtcattggctcacatatggtatttaaagctatgagattggatgagatcatcaaaaagtgagtgaaacagagggaagaagagaactgaggcaggagccctgggaccttttcaattagaaggatggaggaagagaaggaaacagccaaagaggctgagaaaaacatgaccagtaaggttggcagaaggaagaccaagaaagtagagtatattggaaatcaagtaaagaaaatgtattaaggaggagggaatgagagaccgccaaatgttgctgacatgtcacctatgatgaggactgaaattcaccaactgatttggcaatcaaatggaagtcactggtgaagtttgcaggattaatttggtgaagtagaggtgacatcttgataaaagtcagttttatagagaattggaaagagaattggagagaatgataatgtataaatcttgagtaattttgatacaaagagctgcagaaaattggggcagtaaaagtatgagaagaatttttccccttatgatctaagtaataaatctcttaactggtgcgaacatttagatatctaatcttgttccctcattcagttttatcttttaatattattttcttccatctcctattgttattaccccagggattttcatttggttctgtattgtttctcacctggactattaccctagtatcttgctgtgctcattattaccatattaccatctcactactcccatagtatcttcctgcttccaaggaatgctccattactcctgctggcactctctccaaaacatatactacctgtgatgtcattactctttcaagcttaagtcatccaatgactttccaaacacagcttggctacagctgctatgcatgctggaattccagcaaaacagagagagatggataaatcagagctgtgagaggaaactggaactagattttgtgtaaggctagcctgcaagatggggaaggcagctacagctactgttgcctcacttacaatgtctaagaggttgtggggaggagagatcttaatcaagatcttctagtagtggaaggcttgattttctaggtaagaatacaaacgttcttgacttattctctccagtacttagttcagtatggttatattcaatattggatttgcggccacagacaattgtaaagacccatatttgggggaacataagattcctaatattttgccaggtttagttctcattatttcagtttttagttacatatggaaggttttcaggtcaagcattacatgacatttatttcctcactccgtgtacataccaatatatgcttgtccatgttgtgagtatacctacattttgctgtataaatatatgtgcttattattcttatattttagcctcttttttccccctgaatttgaaactgattttgtttctttgcttttctttttagagacagggtctcactctctcattcaggctggagtgcagtggcatgttcaaagctcactgtaacttcatattcctaggctcaagtgatccccctgcctcagcctctcgagtagctaggactacaggtgtgagccaccacacctggctaattaaaaacatttttttttttgtaaagactgggtctcactatgttgccaaggatggtctctaactcctggcctgaagcagtcttcccacatcagcctcctgagttgttgggattacaggcattagtcatagcttccagccctattttgtttcaaataatgaaaaaccattaaatttgttgatgccaagttatagctgcttcaattacattaatttttaactttaaaataaattttaacagatggggtcttgcaatgtttcccaggccggccttgcactcgtgggttcgaaggatcttcttgcctcagcctcctgagtatctgggtccacaggtgcatgccaccatgcttagctctacaataacatctttgaccattactgattccagatatattttttgtgcacttactctgaaccaggtcctgattatacaatcactataatataatgaaagatactttagtttttaaggaattggatgtcttgatatcagagatgacttgcagcaataatgtcacattttgaaaatcagtgttgcacaatacagtatataactctatgactttttataacatatggtgacatttgcaaagattgtagcacacttcaggcaggttaattacgctaggagggatcagatgttcctgattacatgctgattgctcagctcctgttccagccagagggaaagcgctcagaagcttcctgcgtattcatgtgactcacctctgtgaggagtccctgcttgcatgatcatttatctaaagcatttatcccttagcagtggatttgtcccttgtgttttgtcctccacacatcacctccatgactgtctatttgagaagtgtttaatttttctgttttgagttttattttggattacttactgctcttagaggcaaattgctatctgattttactttttcaaatactaaatgatggcgtttttctaaatttatactctgtaaacagatccattcattctgtatatacatggcctgcatcactagacattttatatacattttttttgaaaccaggacctaatattccatgctctgcgttgagattaaggtctgcatgttgcttacagtttatgataccagagacatacactatttagtacttttcattttttcactgtttgaacttcacattagctcactatccaaagatgatactaaactgggaccattaaccacaagctttgcttatactcctttacctgtggatcctctaagatgcaaatcacatgcttgctatgatggatggacattttctgaaactgagctggaagcttcccacttcattctcatattatgcatgtagttaattggtattttgattgaaccatcagaagaataaaaatgcctatgaattaaaggaaattattctcattagatatgaaacaaagaaagcagtggtttcaagaacaaatattattcaaaaatattctcattaaaagaaattgctctctttggtataataaaaatctaaagagaagcatctggcagaatcatataacttactgtagcataacatttgggatgaattaagttgcttcatgctacaaaatgctttcaaggcttctccgtattttttcttcattttagcttatctatggctcacacttctccaattaggtcattttatacttagtacttctttatgtgtatcagattatgactatcatatagaaattacggtcccttgaaggctagaaatattgctaactggaatgagttcaagcccatgtgtggaatgtgaaagtttttctgtgctggatttacctgtgtaatattccatagtgatagttaggcaggttgaactacaagtggtaagacaaataagctgtggatgtgggcattcaggaaaagccagtcttttttttttcttttgagacggagtctcgctctgtcgcccaggctggagtccagtggcgccatctcggctcactgcaagctccgcctcccaggttcatgccattctcctgcctcagcctcccaagtagctgagactgcaggcgcccaccaccacaccccgctaattttttgtattttttttagtagagatggggtttcaccgtgttagccaggatggtctccatctcctgacctcgtgatctgctggtctcagcctcccaaagtgctgggattacaggcatgagccaaggcgcctggccaaagacagtcatttgagttcaggtgttagatacccacccttgggcaaacctatgatcacccaatatttgagcacagtcgagtggatgtatgccattagacaagtactaacattaaattagtcaatggatcttagagttggaaggaattttcagtgccatctcattctctaatctctttaccatctcagatctgttatgtaagtgacttctttaacacgatgctcactactttttcaaagaagcccattctattttcatatatgccctcttattgtcttcatatttggttctgtatctagaaaatcctgagtccatcttctatataagggcctttaaacttctgaaggccacttccacatatgtcttgggacatgcataacattggtagggactgtaagaggaattagagcatgacaccatgatctctcaagagaatgagttggaataatggttaacagtatgagttttagaccaaacaaaaggtctagaactccaacttcaatacatataagctgtgagacactattttaaaaacatctttaaatgtggatatttcaaataatttaattattttcctcagatttattgatctagtcttatgccaataccatgtagcttgtgtctcatatagtacttcagtatctaggaaggttagccccttttagcatttgtcttttgagggaatattcttaaatatttgattaaaacaaaacaattttaattgaaattgcatttcatttacatattagttttaggagacttgacatttttgtggtgttaaatatttcaattcaatatgatatgtctttcattttattcagatcctgctttatatcacttaataatttttaaatagtttttaaaagtaaattctatatttcttactcatttaattctaagcattgtagcattttatacctattatgcataaagtatatttttgtttttctactttagatggctaatgctactttagataaatgctagtttattttaacttatctctttatcttatttctaccacatttccaacatatcttagtttttattccacagccttttggaattttttaggtatagaatcacataattaaaatattatttctttttttaattcacttgaatagattagccaaaacaattttgaatgtaaatagtgatgatagatactgttgttttgtttctgatttacaagaaatggctgtagcatttcaccatagagaattatgtttgctgcttgtttttgagaactggtctgtcttattaaagttcttctattgctgacttagagttttgataacttacagtggtggaattttatcaactgtctttttgcatttatgatgtgatcatgttgattgtggtattaaatttctttttgtttaaccatccttactccttcgaataaatatttgctcctaatgtatcacttatcttgcataatgctggatctagtcaccatttaactatattaactgacagtggctagatacatatgtatgtgtgtgtgggtatgtgtgtaatgcacatttatatatgccttctcttttatttaattacatattacccccttcataatgattccttttaatttaagctaaaactatagtagttttgtaaaaggaggaagcatggatgatacagttgagtgaagtcagcttggcctcaaccaaattcccaaagttactggtgagttcgagctgcagctgtcagactgctagatgcaacttgaaactccagaggggtgggaagcatggcatgattctgtgatgcactggggatcaatcgccagtctctcccccatatctccctaacatcaaaccaacattgccattgttgaggagtctgaatgtatgaccaaagcacacagcattcctgattcctgctcagtcaggtcctccagctttaggttcaggtctgggtgggagagtatgcctggaacctgcagatagtagggcacatgcccagtgattcatgtggagttgagttggtcctggtgtggtctaaatctgtcccacagaagaattcattgccatgatgcctagagaactaggcaatctcatctcctccagtgaggctctggaccctgcagcagtgttgtgtgctgcagcaaagactgtggaactcagtaccatggatgtattttcttctttgttctattttctctttcataatattgctttggtcagtttttgttgttaatatttcatgtctttattgaatgagctataatggctgccacatatttctgttgtcaagaatagaaatatctggtatttcaatattagataagaacaaatatgtatgaggtctcctggttggatcctgtcttccttttccttttctgcatgaacctatgtctgaatccagattctgccacctttgaattcatgtcaccacatacagtggtgttgtttgagcactgcgcaaagtagggaatgggagccacatccagctggggctttgctcttcaaatccttgcctctgggacagatgtgcacatgcgtgtttctgtttcacacaaaagctacagtatcagctagcagcacatagcattgaaatgtagtgaaagtatgcaggcccttttatctctcttagcctgtttcctcacctgctaaatgaatttgtggtattgcaaattcttaacccaaattctcaaatgcatgtattacagttgctggaatatttgacattatgttattatatgtgtcatttagtgatgatctttttgttgttatttacactttagaagaatcttgtatcctattgtttcctatgttatttctacctcttttgatgtatattctctaaaaaattattttttaatctctaaaaaaaagaaagatactagaatgtcaggagaacgaatttctcttgtcaaatataaaaataattccagactatcataacaatgtaaaagtccagttggttcttattaatcattaacttattgtttgtgcaaaaacctttagcaccctgagaatcctaatataagcaataaaataggaaatatttaataaatataacttaatcattgttctatatctttgtaaatgaattcagtaattgcagtggcattttctaacaaggagaattcaaccaatccatttttataaagtgaaaataggcatcagggtaaaatagcacacgttgattaactacttaatacaccattggctttacaaggcctaacagaggagtactttcaaatgacagtgcttaaataaaaaaaatattgtgcaatcctgcatagtaattacaaatgcattaggaaactcgacagctgtgcatggaatgcagaccagaaaagatcatgaaatatggttctaatataatcattagaatgtggttacattgtatgaagggttgagttgtattactgtgcccccccgacattaactgatagtcatatgtggatggtatagagtatgtgcattacgagcacactgcaaacaagagtgagacaaaacatgattgtttcagagaacaatggtacaattctgaatgaattaacagtgattgcagggaacaatgtgaagtgagttagaatatgatttcaattcctagacaaattggagaaacccctccacaatagaatagtacattgctaagggttgatcaggggatggttaacagacactaatttaaagcgggaactttggccagaatcaatatttcaacagctctgcttgttaattaacatatcctccaatgaccttctaagagaaatctcattatgtcaactacaggaagagctagggaaatagttagtagcactttactgagacgataacagctgaaatggcagggtagaacttaggaaagaggtatatcaaaactgaaagaaaggtgattttttataaggggcaagttaggtcaaagaaggaggttattcactatgtctatattctgtattaattgtccatagaagtaaactttccatcaaaaccacaactaaaatttccctttaagaccagccattctcactgaggctcaaaattctatagttaccctaagcccatttgattgaaagagatgtatttgcttgtgtatgtgtttgaaggtgagagtctcacatggacttttgctattaatacattgcttgaatatctaaattatgatttttgtcactaattcatcctaagcctggcttgctaagatctcaaaacatcgcacatgtcaattgtattattggacactgagtgaacccaaaggaaaggtagaactagaatagtctagattagaatggccttccgtggagaactgggatataagctagtggttttgtagagactatgaggagagattgatctgatggaagtagaagcatatgttgcccattgctgagtgatacaaggggaccctagatacagagctttaaatgccaggatacaattttcctttgctctctgataatagagaaacattctgtattttgaggagtgaaggtacatagcagtgtttggcaattgttaatctattggtgttctatttggattagaactaggagagaattcagtgttgagtctactgcgataaacagggacacgaatgtatagaccagggtagtggctataatataaaatatcataaatctgacagaatggtctgaaccaggagaaaaattaaaagacattcttaatgttagtgtgggattaggcaggtctgggagataaaaatcagaaagggagttcattttgggagattaaagcaaaacaaaatcttaccacagaaagaaaacaatatattctttctaataaagaaaatccatgatttttcaactggaaacgctggtggctgcaacacctccagctgtctaccaccaatcattgtgtttcctcctctgatctgcttcagtctataaattggaatactcagaagctcatgttttgtcagttgctgagggcggggcataaactgtacagtttaacagaggaatgtgaaataatttctggggctgtccttagtctgagagcggcttcagcattactgtctctcttaggctgcagacagttctgaaaactgaactaacttcacatgaaattgccaaaatattgccttctgtaataaaactgatagaattaaaaataaaaactacatacttcctttattctcctatagcaaaaggatgcagaaaggcaacttgtatgacagctagtgttcctatcattggttttactcttcatgtttgacattggtaaacaataggatttcaagaagtaatcacaaaggatagatttattttaggcattcaatgaactttgcctttgatgtgtaggcataattagtgtattgggccccagttagccttaattaaattgattaacatgagtaacatttgccttggttgatataatgaacataagcgtaaggatttttttcatttagcttatttttcacacctactagtttcatgtctaaaagttcatagtaaagtttagtaatatgttttagagttatgcaaagtagtgggaatagtcttgatacttgagaaatcctgtgtttagagctgcaacatattgaatcaaagaatctgtgaatgggagttcattcatgatttggctctctgcttgcctattgttggtgtaaaggaatgcttgtgatttttgcacgtcgattttgtatcctgagactttgctgaaattccttatcagttcaagaatttttggggctgagattatggggttttctaaatacctaggaatatagataacaagggatgtgaaggacctcttcaaggagaactacaaaccactgctcaaggaaataagaggacacaaacaaatggaaaaaccttccatgctaatggataggaagaatcaatattgtggaaatggccatactgtccaaagtaatttatagattcaatgctattcccatcaaactaccattaacattcttcacagaattagaaaaaatattttaaattttatatgaaatcaaagaagaccctgtatagccaagacaatctgaagcaaaaaaaaaaaaaaaaaaaaaaaaacgaaactggaggcatcacgctaccagacttcaaactatagtgcaaggttacagtaacaaaaacagcatagtactggtatcaaaacagacatagagaccaagggaacagaacagagatctcagagataacacctcacatctacaaccatctgatcttcaacaaacctgacaaaaacaagcaatggggaaaggatgtcctattcagtaaatggtgctgggaaaactggctagccatatgcagaaaactgaaactggaccacttccttacaccttatacaaaaactaactcaagatgcattacagacttaaatgtaaagcccaaaaccataaaaaccctagttgaaaacctaggcaatatgattcaagacataggtgtgggcaaggaatccatgaccaaaatgccaaaagcaattgcaacaaaagcaaaaattgaaaaatgggatctaattaaagagcttctgcatagcaaaagaaactatcatcagagtgaacaggcaacctacagaatgggagaaaatttttgcaatctacctatctgacagaggtctaatgtccagaatttacaaggaacttaaacaatgttacaagaagaaagcaaccccatcaaaaagtgggcaaaggatatgaacaggcacttctcaaaagaaggcatttacacggtcaacaaacatatgaagaaaagctcaacattactgatcatcagagaaatgcaaatcaaaaccacaatgacatactatctctctgtagtcagaatgatgattattaaagtcaggacacaatagatgctggtgaggctgagaagaaattggaatgcttttacactgttgatggaaatgtaaattagttcaaccatgtggaagacagtgtggcgatttctcaaggatctaaaaccagaaataccatttgccctagcaatcccattactgggtatatacccaagggaatataaatcattctactataaagacacatgcatacgtatgtttattgcagcactatttacaatagcaaagacatggaactaacccaaatgcccatcaatgagagcacggataaggcaagtgtggtacaaatataccatggaatactattcagtcataaaaaggaatcaaatcatgtcatttgcagggacacggatgaagctggaagccatcatcctcagcaaactaacacaggaacagaaaaccaaagtgcatgttctcattcgtaagtgggagttgaacaatgagaacacatggatacggggatgggaacaacacacaccagggcctgttgggggttagggggtgaggggagggaacttagaggatgggccaataggtacagcaaaccagcatggcacgcatatacctgtgtaacaaacctgcaggttctgcacatgtatcctgtggttttattttttttagaagaaatgagggaaaaaaagaaacaacaacaacaacaaaaccatcacactaagcaaaaagagactgacatgaaagaaaaaataagaatctgtaacctgtcccctccctgcctaaaggaattatatataacatttaaaaaatttagttattctagtgactaaatattattttgtgactgattatcttttctgaacatctatactaaccatcgatgacataacaactggttgttcactttgtgcttcatagtttgtgctatggcccctattagaagaatatattaaaaacagctcagaggaaacaagagctcgcccatccttatgcaaagagagagaaattagctgcctttagatgtaagcttccttagcgtgatggtgatgcaggaagcttctctactgtgaaaccggtgcaggaaataccaccacagagaagcgtgcccattactccatgtcagtgcttttaaattaatttatttttatttttatttctgcccatgagacttattgatctaagaggatttagcacttgcccatagcaggcatccagtgaacaccagaaaataatagaaaaattatagaaacataatttaatatccatcaaaaacgaaaggtctatgtattttccttccctcttccctcctttctttcctcttcttttactctcgtgatgaggccctagtgttatcattgtaaaagcattcgtttgcattgttgtcttttccattattgcattgacttagaaacaacaaaataaaatccattcgtctactaacagatgtcccagactaatatttctttgcttatagcacaagccagagaacaacacttcaaattaattttttagaggttgcacctttatctttgtaactgacatcagtgaactttagctgtgtgaaaagcagaactcaagtttcatgcatcaagtatttgatgttatatggacatgataacaaattttatgtcaagttgactgggccatgaggtgtcccggtgtttggataagattatttctgggtgtgtctttgaaggcgtttctaaatgagattagcatttgaatcagtagactatggtagattgcctttcccagtgtggatggacctcatctaatccattgaaggcccaaggcaatattttctccttcaaatatcctggtttaccactaactcattatatatatatatacacacacacatatatatatatacacacacacatatatatacacatatatatatacacatacacacacacacgcacatatacacacacacgcgcatgtgtatatatgcatatgtgtatatatacacatatatgcgtatgtgtatatatacgcatatatatgcgtatgtgtatatatacgcatatatatgcgtatgtgtatatatacgcatatatatgcgtatgtgtatatatacgcatatatatgcgtatgtgtattatgcgtatgtgtatatatacgcatatatatgcgtatgtgtatatatatgtatatatattaattatatatatatatgtctcagagctttactgaacatttggaggtagttgagttagcactgtcagaagaatctatttttagacattaaaacatcattcctgtcagtggagtaaaaagtcccttcatgaccctcttcaacttcctgccatattgtcagagtcattttctctctactgatactgttttcaaaatccagcaggcagaggccacccaaaattcctattactttttaatgcagaaaaatttctaacccttatttcccttttttttctcatctagactagtccaggagaccttgccctttgcaatcagagatcattaacgtgttcttcctacacgtgcttttcagatgtttcctaaacatctgaatggtgaataatgcgtttgtttactatcactctttcttcctttccctagggcactattttggttacattaaaaaaaaaactcaggggaaaaaaaaacctattgggtatatgggagatgaaaatggtagaaaagacaaagcatccctttacataagttaaacataattaaatttacaataagtataaggacttagtagagaaacactaatatatatctttgacaaattgatttcacaattctccatgattctgactgaagatatatggcactaaatatgtgctgataggtactaggaatttagagtagttggatttgcttgaaaaataatttccacactaacattcaatttttggctcaaaaaccaattattacaaacctcttgtattgcatgcctggtgcttagaagtacaagatgagtaaggtatgatctttgacctcatggactgtaagtatagtgggacatgtagggatgttagcaactaattataaaatactgcaatatgtgtattacctacaaagtgatattcacacagtggtatgaaatagtagattgtacaaccaatagcctaattggattaaggagacttcctgtgtaggatggggtttgctcttaatgatgaatatgtgttccagatagaaaaaagatagaaaaaatggactgtgtgaagggttcagagggtccaacagtatcgtgtttctgggtttggagcatcagctccatgtgtgatggaagcagagggcaggggaacaaggaggcgggagatgaaagagtggaggagataagagtggaaaacaggttaggcttcacccaagaaagaacatcgaatatctcactccagggtggttcgacttttagaaatgtcagggtcaggttttctaatatgtactaaaaatgcagatttctggacttaaggaatctgaatgtcttgatgtgaatcaggagcctgaagtaactctttgccatagatcatgggagcctttggctttgtttgtttgtttgtttttgttttttgagatggaatctccctctgtcgcccaggctggagtgcaatggcacaatcttggctcactgcaacctccacctcccaggttcaagcgattctcctgcctcagcctcccaagtagctgggattacaggtgcccgccaccacgcctgactaatttttgtatttttagtagagacagggtttcaccacattggccaggctggtcttgaactcctgggctcaggtgatttccccttctcagcctcccaaggtggtgggattacagacacgagccaccgcacccggccacctttggctgttttaatgttggataatgctaggtcatgtctagtacaacaagccaatataccatcatggatataggtgtactcagaaacagaatgaaaaaaaagtcagcttttaatacaggttgaaagctatatggcatcctgggtagcaacttagagtagtttagctagaggaaattgtatagaatgtttactaaaatgctcttggtgaaattttatcaagtaccttttatttttcttttgtaccctccctcacacagagtagtgaatgtgaatgtctgagtaacttaatcattctggaacagtgaaacaggcttcgtgctttcaggaagactaaagatcttaatggtttggaggcttttgaaaacactgcataaattgtatttgactttatttaaactaccaagctagctttaagtttcatccagagaatgcttttgataagaagctgttgttgggtatagttagagtgataagtgagctggcgcttaaccttacgaggattaggtagggtagggacagggaccactgctttttaaggccgttggaaccaagtacacaatctgtatgtttgcctaaaacacttcactatatatggatagggaacagcttgcatgctcatgctgtgtggaagtggaatctacattcaaattgaaaatagaaaagcaaaatgaagtgcagtaataacaagtgtggactgcaacatgaccaaagtgggaaagctgttaaaataaataatgctcatggtcatattggagttcattgtgaaaaagatgtaggaagcagaatagataattctttcaaatgaaagaaaaagggaatcataagcaggggtgcaatacagaggaattatggctcaatccttttattaaatctcgaccttggtgagtaccttcctaaatgatacttggtactttttaatgattttcaaatatatgactgcagctccacacagaaactaatgtgaatttccaagaaaacaaattttgaaaaagaaatagattttaactccagttttatggaatttggtgccttagctataaggccatgatattttgattaaattagatatacaattgggcactgagaaaggttttaaaatggaagattttgtttatatttgtttgtttttaatagacgagaacctcaagtcccagagctggttatgggggcatttggcagatgaattagttcatctgtcaagttcttttgcattctaatatacggattttccaagcactttgatcttgccctgcaaaattgcagcattaagggattttattcttattttaaaaattcttgaataaagacaccattttttgaattggtaaatgtttataaagaaaattcatattgtttctaaagtcatatctttgaaatcacagttatttagaatctagatttctacaagtcatatctttggaaggacctttgtttttaaatatatatttctagtgcatttaaaaagggctgctagtatcccatagcaaaaatcacataattgttacaccctattctttctgcttttgactatgttactgttggagtattttctgataagagctatgaaagcagaaatggatgttgtagtaaaacagactgttcttggtctgattgattttgtgctttataacccattttagttatcagaaagaattacaatttttttctccagctatttggaaagaatgtaatggtctaaaagaattgcctaccttctgaggaagtttctctcatgtcaaagtagaaacagtatatttattaaactgtctgtaacttcggagtgaatactttcaattcatttcttcctctgtttcccgacctgtaactgtaggaatcgctcaactatgacacttggcaatacgatctagcagatgtgtaggaccatgcttaggatgcggtaaaatcaggagattgcagattaaatttaaaccgtttttaagtcactttatattagaacatttggtggttagaatttgtcgatagtatactttagtatgcatttgtatgatggcttggagaatatttttgtgttgcctaatgaaactccttagccattgctataaagctaacagaaacaaatggatatattttaaacactgtactgtaggcagatatcccaagaaccatgaaatgaagaagagataagatgcttcattagtcgttcatattaatatattgttatttagatttaaaaactccaccaaaatgttctagcaccaagaagagggtacaagttaatgacaattcttagagcaataaatatgatcgatgacttgtagtgactagacataataaaaatataattaattgatggcacaggaaattaagctgtgatagttatttcaaggatgttaggagtttttgtttttttttttgtacatttgtggatcctatagagctgactttaaaggaaaagattgaggtaagttatcattatgtaatttgagaaactgcaagttcagttaattcattttggttgagaatgccatgtactacttaacaaaatgtcttttctagcacttggatattcttttagccatgttttggagactctgcaatgtgaatcaaagtgtattagtttactcagttctgtggagtttgactttgtcctggggtaaacattgtattttaataaataaatgaaaataagtatgaaaacatttaaagtgctcaatatttaactgaggaaaaaatggactgaggaaccagtggaagctcttttagtaatccaaagtggataagagagatattaaggcaatatctggcaatgagaaataattttttaagaaatcaacatttatttatttatttatttatttattatactttaagttctgaggtacatgtgcagaacatgcagttttgttacataggtatacaggtgccatgagaacagctattgatgactcactggacgtgggcaataaaagttctaagactttgagtccagatgcttagatggttgatcctaacatacaaaataaggaggtcagaaagatgctgaaacaatagagggaaataattggcaaatacagatctaggttgatatgttatacatggaaaaatagctagaatctccagtaagaaatatttgcttcagcaacaattctcaaagtggtctggggttccggaaacctcagagtgtttttgagatcaaaactatttcataatactgtgaagtcatggtttacattttcctctgtatttgcatttgcatttatagtacaaaagcaatggtgagcaaaactgctggggctttagcacaaattaaattggtggcatcaaactgtacttttaatagtaatcactgtatgttttacctccacaaattcacatttttaaaagccattgcatttaagaaagtccagataaaacagcaaaaattattgactgttaaatataaactctcaattacacatatttttcatgttctatgtcatgaaataagattgcataaagcaagtcttctgcataccaaagagtaatggctctctcaatgaaagatacttttgcaattgagttgcaagctgaactagccacatttttttttttctgaataccatttttttttcttgaacaaagtgattgacaggcaagctatggtaattcagacttaagtatttggcaaacattttcttaaaattgaacgaaatgagtctatagcttcaaggaaaacaacgtactgtatttgctggtagcaattatatttgagcttttaaaagaaaactggaaatttagaaaacttacatccatcaccatgaccttgacagtttccagtacttaaaaatgtgatgaggccacgcacagtggctcacacctgttatcccagcactttgggaggccgaggggggcagatcatgaggtcaggcgttctagaccagcttggccaacatggtgaaacctcatctctactgaaaatacaaaaattagccaggcatggtggcatatgcctgtaatcccagctactctggagactgaggcaggagaatcacttgaaccagggaggcggaggttgcagtgagcaaagatcgcaacactgcactccagcctgggcgacagagcaagactccatctcaaaacaaacaaacaaacaaaaaagtgatgaaatgtgtcaaaatgaggaaaatctgcataacttatgaactaacatgtcaaggcatggattacaatgtcttgaatgggtaagagaaccattcataataaaagattggccagtggtatgcttttagattctgtattgcacttaaacttgaagaaacaatccatcgtcatgttttggtgtaatatcaaagaacaatgttaacaatgatctgaaaagcctattaaatgaaaaggctgcctttgtcaactgcatctgtgtgaggctcgattttcttcatataccttgacctaaacaagatgctgttcacagattgaattcagaaatagatgtgagaatatagctcttttctattaagtgagacaataatgaaatttacaatcatgtaaaacaatgatattcttcacactaacattttttgttttggaaaatccagttctgttttttacaaaaccagtaatctagtatcattatgtttattatggttctcttaatggattaaatgttttaaaataattatcagtttttttaaataatacatacgaataatatgtatttctatatatatatgtgtgtagcccaccgcaatacaagctttgggtttctcaataaatttttaagagtgtaaagcgttccgagaccgaaaactttgatgattactgagctacatatgtaaatgtgagagcaatcggcttggagttttatttgccattgtaaaagtggtgctatattttgagcaagatgttaagaaacaagaaccaagactttgaacgatctggcctaggatgcagaggaatgagtgaaagaaacaaaatttttaccaatagagggtataagagaatgcgtcaccagctttagaagctagagttactaggagactctgaatgttgacaagaagcccttgcatttcattaggaagaggttggcagaaatctcaataccatttcagtgacaacttgacccaatcaactattcctctctgcctgcctagctcttccatcattcctagtggaatttatgcagcatcaccagcagtattccctataacctaaatcttttccctgaatttaacttcaccttcttgttctaactaaatagtagtttattttctcctatattatcttttgacatggactttttctttggcaggggaaagagtggtagaagagcaacaatatttatttttttctccacagtgtatttggtgataaagatcttaaacggtatctttctttcccagagattaggatgcagttttgtacttcataattagaaatattagaaaatttccagctgagttgacttcaatgcaacacatagctttctctttatttttgccatatttataatattagttaatttttgaaaagaacgatttcaatagctaatttggtttatcatacacaatatcttaatgtgctaattaacagtgaaatgtttgcattttgttcaattatataaagttttgtcttgctttattttgtttttgtgtacatctatcccttttcagctattttatatagggtgtcagactatttagaaaatgatagtacgatatgtgatatatatggttccgaactcagaatctggaaccaaatactcagggttcaaatccaggctctgctactttctgtataaaccttgatcaaatcacttacactctcagtgctgcaacttgatcatctgtaaactaggaatgattaataatacaatgtgtgctatgtttacttatatacacagtattattatggtggtcgtgctagtaagagtacccgtatcatgggttggagaatcaagtgaattaattttccaaaagaacttaataaatcatctagctaatggcaagtacatggcaaaagttagtgattattattattattccttaatggtttttcagcacattctacctttaggcactatgcaagtaggtaccatgtacaaattcatttaattctcacagctgttctatgagataggtgccattattatacctgttttctgatgagaataagtgagaggcaaggaagtcaggaaatttacacgcatgggactagcatctaattatagggcatttgaaccaaaccctatcagaatgtacagaggcccctcatgggaaaaacattgggagatagaaagatgaacaggaggactcgattcctgcctcaacagattcatgagcacccaggaaaggcaggagggtacagtcagtcttaggacattgttctgagcagtctgtgaacataagaagtgaaagaatcactagtcaccatgctgcattttatttcaattgaatctcacagctatcctgcccttggtcagagcagacacgattgcatctactttattacagacaaaattgatgcttagagaggttaaatagctcacataatcagtacgtggaagaccttggactacagtcattgtctcctgagtttgcaaatcaagtgtagattttttaattttatttttttgtcttctgtgatcagtattgtagtaggctgaatattgggccccaaagatatcagggacaaatccctggaatcttcgaattgttgcttacatggggaaaaaaaaaaaggtctttgcatatgtgcttgaatggaggatcgcgagatggggtgattatcctgaattatctgggtgggtcctaataatcacatgaatctttaaaagagaggcctagggagatttcacacatgaatacacgcagaagacaatgtgagattagagtgatgtggatataagccaaggagtgccaagaaatggcagcagccaccagcagctggaaaaagaaaggaatgaattctctttcagaacctccagaggcagtgcagcccagaccacaccttgatttcagcctagtgacactgctttgggatgcctggcatctagaactgagaaggcatacttttctgttatttagactgggaaattattagcaatttgctacagcagcaacaggaaacaaacaggatcatcctcttttgttggggatgctgtgctcctggatccacatttttgctcctatgctcccctggcaaatcctctttgcctgccggaagagtcactgcctgtccggcttccatgctgccatttaccagacttctggtcatgttcccttaggaactcgccattttattacctgactctttctcttgacttcacttgacattattcttggcaactataacatccacttatttatccaatattttagtctctatcaatgccctagatcacatccttttgcttactcaaggaatttcctcctgcagttcccatcctgcctgctcagtcatcaatttattgctatatccatatgtgaatattcagtaaattctccttcctcatacaagcaaaatgtttgacctcatagccccctccagtgcctgtcttggttttctgcttccattatagcaaacatttgcaagaagttgtccataacgttgccttaattcttgtccttttctgctcatattctgctgaagcagctgttatcaaggttgctaagggcttctctttctcatcagttcccatggtcaattgttattcctcatctcagttgcccttttaatagcatttgacatgatagattactttcttctacttgcattattttcttcccttgatttctgggacactccgttttcctgattttctttttacttcactggcttcttattctaattcttgttgctggttactcttcttttcccaaatttctccactcttccctatcttttccccttcggttatttcatccagcaccataactttattctccataacagtcactttcagacttatatcaacagcttcaacttttcctgagactccaattattttatctaattgtatactgatacattttatttgattttctaactggtaacatgttcaaaacaaaacctttaattttccaccccaccacacacaaacacggagccggcatactcttgcttatcttagttaatggtaccactatgcatccagatactgaggcccagtcttcagatttatccttcatttatccatttcctatacatctccctccaaacaaaccacaagttattttgcctgtgattcagtacatatggacaatctgatcacttattgcagcatacacctccaccaataccacagtccagcccagcaatgactgtcacccatactgttagcatagcctttaaactgggcttcctgttttcactcttacacccacccagcagtccatgctccatatatcagccactgttatcctttaagacatgaacagcatcacatttctcctatgttgaaaattccccagtgcttcgcattccacatagaaaatctgaaccccttaccatgatctgtggggccatctgaaatctgtcccctgcctacttctcagacctttctctattctcactcactgagctccaatcacattgactttcctctgtttttgcatagtcagcaaccttctttgcacctcgtaaccttgcactctaccttctctgagccccctaaccactcatcttttcatagctggctctttttcatcactgaggcttccacttgaatgttgcttcctcagagagggttttccttctcactgtatctaaaatggccaatctcagcctgggcaacgtagagacactgtctctacaaacaaacaaacaaacaaacaaacaaaaattagctgggcatggtggtggcgcttgtctgtggtcccagatacttgggaggctgaagtgggggagtctctggagcccaggcagttgaggctgcagtgagccgagattgtgccaatgcactctagtctgggtaacagagtgagaccttgtctcagaataaaataaaatagccaatctgtagaaaatcattttgcccaaaccagtttgtccaaatcaatattttaatttagcaaatgaccaaatattgtttatagtttggatgtatttggtaaactcagaaagtttcctattgagaataagattaagaacttgcttttgattgtcttttggtcaattgattataagcaaattgatctttggaaaacagcacccttcacttttcatcccctaccctcttttatccctctgtaatacctaacataacaataaatcatttatatatctgtttgcttttatactttatcttttactctgtagattctaagctttataaggacagaaacttgtatggcttattcagttttagcttcaaggtctaaaacaggtgctcaaaatatattggttgaatggatgaatgaaagaatgaatatcaaaagaaactagatttgaatacactaagagggaatagacagtgtgccattgaaagccaaaaatatagaacatctcattctcttgagatttcaaatagagaaaatgaggacaggaattatgagttagcagaatgaaagcttttgtttatttaaataaagaagaaccatgtttttgtgtatgaattaactaaaaaaaaaaaacaaagaaaaagaggaaggagaaccaccaataaaggatattggtttacttgttctgtataaaaacataaagttgtgagtaagaaactcttccgtatagctcctttgtagttctagattgtgtttctgagtttaaagattattagaaaatttgatttaaaatcttcactccacaataattcatgaaacaatcaatggttagttgtttagaactgattttatctgttacacaactgcttaagggaatttaaatttctgctaaaatcaagttgattttcaaacataattaattataaaataatattagaaataaatgtgaagcaccatgaagcccaaattaatgaggagggaaatgagggaggaagagagttaagagggcatttttccatacagtgcttgtcctagaagataagattaattaacaaaaggctaattcttgatgatacagattaatatcccactcactatttatttatatagatgactgatttctgcataacatttgaaaatgtcattaaattaatattccagaaaactttgcacattttactttttggaaaaaaattaggaaatatgcaaatacaagggaaaattcagtataaacgcttccagtctagagaattaggtagttgcttcttttatttaaaaatatatatcttcaagtggctataatggtcttctgaaaatcaaaagaattattactattaaaattattcagaagtacttcttttaagaaaaaaggaaatggaattaaaattcattgtaacgtgtgtgataaaaattggttataaaattacttttaaaatgatctacctacctattcatctatctgtataatttaatgcagagggatacatgatttcaggcacagagcaactctaaagtagcagagtagtaatgaattatccattgcaataacataatatgtgacttgagagttgtaatgcacaaaatgcaaattcgctctgaaaatttctcttcaatcagatatacattgtaaaatcatctgattttctatggttgatatgatttaatcttttaaaatctatttcatttctatatttgagaatatctgtggcctcaaattgtaattgaaatttcaaaatttttaagttaaaacattcatatatcaaaaataaaaaatattaaaagggtcataaaatataagtacatgtcatgccagagaggttattataacagttattcataatcattgcttttagaagtcaactttatctttaaactaataaaagccttgtgactcttcggtttctctcattacaaaaagccacctgcatatgaatcttcactgattttgacatttttcacatttaattttaaatcgatatcactcaattttatctctaccagttttatttaaagttaaatcctttatttgtgtcagtaatcatttgtgggtttaataaattttctctaaaaggaatgtgggctggaagcagttaaagttttcagtcttaggtgttttgtcattaaattaagattaacggaatgttaatgtcgaaaatggaaatagatgcagataaacttcatgcattccaaatccagtttttagtgagataacacataaatgattttatgtgtagataaattaattttcccataaggctgggaagaattacattctatatttaaacagtaattagattgcacttgcagcctttaattcgatctaccactcaggcattataaggaaaactggaaattattctgtcttgatagacttattctgatatcactggaaagaagagcttgttgaaattctcaatgaaaaacacacacacaaaaaattttattcctaatctgtttcttaaattccttaaacaagactggaaaatgtttattttcaatgtgtgctacaatttttaattcttgaatacaaagctactatttatatagcttggttgagaagtatttttatgtattataactgtaatgaaagaaaccgtagtttctctttcataattaagtagatgtgattaattgttcagcaccttacctatcttggatttataaacaattattttatatgtctattacgtttttggagaacagcacatattttgttacttgacagttattttgaaagtttaaattcttgctaatatcaaaatgttaattcagtaaaatggaaacactcaactccttggtaaacatggtataagaacaaagtgatagttttacaaattcaaagttaacacaaacaagtagctagagtaaattcaatttctgattttaccaattttaattaaaaattagtacaaaattattcaatggcttggctcctagattgttcatttttgataggtgtttacacattaaaattttatgaagtgattaggacaaaaaaattcaaaatatgtttatccctaagcattgaagaatcaattatgtatagaccaatagtttacagttttttattggttggatttaagaaatacttatgatcacagatatataaaaatatgtatattacatatatttaggtaattcaattaactggaatatttcaatatcaggtttaatacatattgaaagtcccccaattttttgatattgtggtgagttaatagcatggtgaaaaactaatgcaataaattacttaaatcaaatctattttgtgttcagatattcaggaaataaacagaatattgacacggttgtgtgccactgaagtacagagatttgtttggagaaatacatcattagacaatttcgccattgtgcaaatataacagactatacttacacagatctagaccttagagtctgctacacacctaggctatatggtataggttcatcgctcctaggctacaaacctgtgtgacatgttactatacttaatactctaggcgtttgtaatgcactggtaaatctttgtgtatctaagcatatttaaacatagaaaagatacagtgaaaggatggtatagactgagcctgtaatcctagcactgtgggaggctgaaggagcagataccttgaggccaggagtttggaaccagcctgggcaacatagcaagaccccatctcaacaaaaaaataataaaaagtaaaaattagcctggcatggtggtccacacctgtagtcccagctacttgggaagttgaggcaggagggttgctttgagcacagaaggtttaggctacagggagctatgatcctggcatcacactgcagcctaggtgatggagcaaaatgttgtctcaaaaaatcatatataaatatatatatatatatatatatatatatatatatatatatatatatacacatataaaattatggtataaattttttttaaaaaaggtacacctgcatagggcacatagcatgagtggagcttgcaagattagaagttgctctaggtaagtcagtaagtgagtggtgagtgaatgcaaaggcttaggacattacactatttagactgtacaaatactgtatacttaggctatactaaatttattttaaaaatctttcttcaataacaaattaaccttagcttacagtagtttataataaatttactttaaacttcaatttttaaaaaactttttgattttttgtagtaacatttagcttaaaagacaaactcattgtacaaaaatgttttctttatatcctcactctataagctttttttttctatttttaaatatttatttatttttttactttttaaacttttttgttaaaaactaagacacaaacacacacattagcctaggcctacacagggtcaggatcatcaatatcaccgtcttccgcctccacatcttgttgcactggaagggcttcaggaacaataacaggcatggagatgtcatctcctgtgataacaatgccttcctctggaagaactcacttaggtggctttatggttaacttaaaaaaaatcagtagaaggagtgcactctaaaataacaataaaaaacatagtatggtaaacacccagtaacaaagttgtttattatcattatcaaatattatgtactgtacatacttgcatgtgctagacttttatatgactggcaatctgatatttttgtttataccagcatcaccacaaacatgtaatatgttggactatgatgttatgatggctatgatgtcactaaattataggaatttttcagctccattataatcttatgggaccaatgtcatatatacagttagtcattcaccaaaacatcattacaaggcacatgactgtatttgatgacatataatttccccttcaaagggtagtaaagtcaatacacagtttatgaaagctaaaattttaatgcatgtgttattagagaaaagttttaaaatttcactctaatatgattcctgaagttattatcaggttctttttggttgttttgttttaaagaataaaactgaatcagagaaaaactactctaaaatcaaataaaaactgtataatttgttcagaaatttatttttaattacaaactcaaagagtaatcagaattagtttgttgctaataatacacagtggccttaaaagagaaataatgatatttggaaatgctatattcatttttattttgaatgaaaactcctaaatattaaatatattctcttcaacattgcttttacaatataaattactttgtaaaacatacctgttagggctacttaaagataaactccatattttcctaaatcattgtgttataaattaattgggctgaaatttataaagaaatattttattcttgcctttataaaaattgcatgtgtaaacatcatttagagttggcagaaatctgatggaacatcagtattgcctgattcagcaatgttcaacctttattccactaagaataatatggcaattgtcagtcacatgaacacatatagcacatatcttagaaacctgggtggaaagcatgtaagaatgcctgtgatatagggtatctttgaatctatccttattttatctttaacaaattaagtaattttaaaacattgtgatttaaccattattggtaaataaaattatttgtgacccacttcgcggttcttagccacacacaaactgctcagaaaaatgacctattttaaggagaaacatacaggcttggcagttttattgtagttcaagccacagagattcaattccgttttcacactttgtcctgtggatctgtgaaaacagagtgtagtggctgagactgcagctgtggggtcaggttatcatagtggaatgcttgctgaacaactctgtaagagcagagagaatattttacacgtatttgcaaccgcaatgtttcaaaaactggccaggttaaaagaatcacctggactgcttgttaaatatagattcctgaaccaagacgaacctactgagttaggatttcaaatgcagagacctgacaatctgtattttttccccatgaagcccaggtgatcaggccatttggggaaacctggcattaatgctggctgacatgatagagctgctaatctcaattgaagccttctcataatcatcccattttcattctttcatatttttattgaggaactagttactagcgatgcacaggtaacacatgagctctacctaacaatttatacgtactctattgaaacagaattgcaattacttttaaaagctgttacctttgattgcagggtagatgcaccttaatatctcacactaaagcctggaaatcaatgtgaattagatcagtatcagaattcatgatattgcgttgttatttatttgtacttggactctgtggcatattcatgacacagttctgcttcattagtagctctctctgcacctctgcattttgttattccattttgttttttcctactcttcttccacctatttttgtaatatactcaaacagtgtttagattactaagttattgcgtgatcttttacaacctaattaaaagtgactatacggttgggactataggagataattttattgaatatattttattattatatattgaaacagtccagtatccttatttaggctaattatgaaatgtaattactaatatatccaaggtgtttactgttgcttaatgcctcattttgatataccattttgacttgctgattattccaactttctatttttagattttctcccttaatttacgggtaaattattcttggttctttttgtggataaattgacttgagatcatcagttatttaagtaagaaacaaaatatcccacagtaaagtctttgaagataagatgataagaaaaaggatatgattaataatgtggtcacaataatttattttcatcaaatagtagcactcatgggtttcccagtgcttaacaaaatgtgataatttatggatactttgaaaatgaatgctttactttctctttagttagaacatgtgaggaggtctaaggattgtctggttttcctttgggaatctaacctccctttgtagcaaccagtgtgtaatctactagctttcattctggaaaagaaaaagattttaaaaattataaaaatatagcaggtggtgaattaagtacttaatgtgaccatcttttataaataatgaagtcagattatgaattaaatttctcaatgacacttttttctatcattagtgagttatgaatgactatagaataaagtaagaaactaccatacatgtaacttattttttatttcattacttttttaattttgagacagagtctcactctgtcaccgaggctggagtgcaatggtgcaatctcagctcattgcaacctccgcctcccaggttcaaatgattcttctgcctcagcctcctgagtaactgggattacaggcatctgccaccatgcctgggtaatttttgtatttttaatagagagggggtttccccatgttggtctggctggtctcgaactcttaccctcaggtgatccacctccctcggcttcccaaagtgctggaattacaggcgtgagccaccacgcctggtgatttcattacttttaaacagattgtgatcctagaaatatgtctgtataaaacttgtgtgttgtaggcaatggtcattcttgtccggtcattatccttggaaagctgaatttggttgagtaggctgagagttacaatttagatacttagattagttttgatgagtcatttaatgtctggagcagatggacggtgttagcatgaatactaaaccttctcatgttttacctctgcttgtgttacagaaacccttgaaactctcatcaaacaagcagaaaattacaccagtatacttttttgcagtacctacaggaacatggccttggaggctgctgcttcggttcaggagttcttcactgatgtggggctgtatttatttggtgcggatgttaatcctgaagaatttgtaaacagattttttgacagtctttttcctctggtctacaaccacctcattaaccctggtgtgactgacagttccctggaatactcagaatgcatccggatggctcgccgggatgtgagtccatttggtaatattccccaaagagtaatgggacagatggggaggtccctgctgcccagccgcacttttctgcaggcactcaatctgggcattgaagtcatcaacaccacagactatctgcacttctccaaagagtgcagcagagccctcctgaagatgcaatactgcccgcactgccaaggcctggcgctcactaagccttgtatgggatactgcctcaatgtcatgcgaggctgcctggcgcacatggcggagcttaatccacactggcatgcatatatccggtcgttggaagaactctcggatgcaatgcatggaacatacgacattggacacgtgctgctgaactttcacttgcttgttaatgatgctgtgttacaggctcacctcaatggacaaaaattattggaacaggtaagtaggagctccacattttcagtctgacttcttgtaattcaaatattagccatgatatactttaggaaatagtaggagaatgtgtctgttgatatattcaatccaagatattatttttttatatcttatgataaaattttgattggctgaaataccacattctctcctaagtagaagtctgctgaaagggtgagtactgtgacgtggcaagagctcaggtttgaaatcaggaacagcatagatttgaatctttagcctgccggtaattagctaaatgaaattaggtaagtccctttggcctctttgcacctcaatttcctcagtgataaaaaggaaatagtaacatacaacatttgaagtattcttttttgggaatataggcattatgtgtgcaaactacttagtatggtacctggtactccaaaaatgggtagttattgttagaatttcagaagcatttggctttaaaatggaaaatgccagttatatatccctgaagttaagacttgatagcttagtgttcaaaagagtttcttcagagatgctccaaaatctgtcacagtgatggcgtgataatttttaaaatgtagtgtatacacggtcatggtgttttattcctagcaggctgaaacgtttttaaaacacaatcatcaaatcaaaacacatgagagttttctatttgtctcaccttacatagaaccatttttctaaatattcactggctcccttagtaatagttctcatatcccagagtgaaataggatagcatgctgatggttctactaaacatattcccctgaaataaaattatactctccagtgccaacaaaagacatctccttaggctggcattgatttaccaaattaacaagcattctcataaattagctttaagcagaaaattttagtagagggagtttctccatgttggtcaggctggtctcgaactcttgacctcaggtgatccacaggcctcagcttcccaaagtgctggaattacaggcatgagccaccgcgcccagcgatttcattacttttaaacagactttgattcaattcctttaattaatgactgatagaatctgaaaagctttatgtccaaacgcgttttccccttctcttcctaaccttcagggactttccaggtcctgcgtgagcctttatggttcctttctgcaaattagaaatgacacctcctttaggtggattcagcacagcagcatagggtaatgtgtgggctgaaatttaactccctgcttcattcagctgggtatccctatacaattaaccgggttctcaacttgatgtaatggcctggtcttcttgtcttctcacatccttttatgaaaattgtacatggcccagaacctctggaagggatgcaataaaccatctcaaaaggaggtaccaatgactgctgtggtttcaagtatttccttgaaaaataagcacttagatccagggaacaaaatgctcttattattattattatttatttatttattttttgacggagtctcactctgtcacccaggctggggtgcagtggcatgatctcagctcactgcaagctccgccttccgggttcatgccattctcccgcctcagcctcccacgtagctgggactacaggtgcccactaccatgcccaactaattttttgtatttttttagtagagaggtggtttcaccatgttagccaggatggtctcgttctcctgacctcgtgacctgcccgcctcggcctcccaaagtgctgggattataggcatgagccactgagccggaccaaaatgctcatattattttattgagtatctccaaaagggaaagtaagcacaagaaatcagagaccaagtccagatttgattattaatttgggtcattataacttaatgtcccatggccaggaccttctgatatatgtaagtgaataggttttcaagaccttttttcctatgtattttggaaacctgaagggcctttttgtgtccttaaaatctatcctgtagaaaatcttctgtgtttcctatttcaaagactaaaataaaagtttgcagtagacaggcaagctttcaaatcctgagtttgctacccattagtcatgtgggctgggtcagcttctaaaacccttaagcctgtttgtcctatgtgaaaaggaagggaggaataacttaaataggacagtgttggtcagagtctgacactggtaggcagttggtacctgataaccttactcttttctctccttattctaaggaaggccctaagcagaccttggtgaagcaggtgactttagtatctcaaagtattagaatcaggtttatgtttcctaaagaagttttatacacaacttttatcatgtaaaactctctgctgtattttcaaagagagtgctctttttaaaatagtctgattttatataatagtcctatgactattttgagaaatataaattattactgataaattatggattcttttctaaataaaacaactgagtcctcttttttacttatgggaacagaagaagaaactgattttaaattccttgaaaattgacccattaatatttatttctaccaattcaaagtgatttataagctctttatcaaactttgataaccagttcgcacatcgatgaatttaacaaattcaaaataaattactggaaagccagcaaataatgactttctcacattcccaaagaaatctctgagatctagtacttccaagtctactcctccataaatacatattttcactttaaaatatctgtggagatacctgatatatatataaaatacttctgttggatgaatttcaactggaaacaaagtttagttttctgagaaaaatcataagtaccttatatttggttaatgtttagagaaacaaaagttaatttacaagataattttttaaatttcataattctgtgattttattaagacaaagtttgatttaataaagaagagaggtaacaaagagtaggaattaaaagcacaagtccaagtgttaaattggatttcacatctgtctctgcctcttactagctctgagtttacgcatttgcttattttatctctgtttgcttcagtttcctctttggttagatggggtgatgaaataccataatagtatccttgtgagaataaaatgaacttacacacttaatgtcttgtgcatagtgtttacattttaccagttatcactatcacattatattatttagaaataattcactgatttatctgaattttttttctttttatttgaaatggagtcttgctctgtcaccaggctggagtgcagtggcatgatctcggctcactgcaacctctacctcccgggttcaaacgattctcctgcctcagcctcccaagtagctgggactacaggtgcctgccaccatgcccagctaatttttgtagttttagtagagatggggtttcactgtattggacaggctggtctcaaactcctgaccttgtgatctgcccgccttggcctcccaaagtgctgggattacaggcatgagccaccacgcctggccttctctgatgttttaaatgctcccaaagtaaacatttatttcttaggggtgtagagctcaaaaaatattttaaataatcatttaattaaacaaatgcttgtaattgtctttatgaatgagaaaaaattgatattttcagaaaatattagacaagtctctaacgtatttttaatattaacggattaatattaaaatgttaatattaatagattaccctcttgttaataaattattaattcatttggtaaataaatacttcatattttttgaaatcctatttcttagtaattacatttaatatattatttcttgctataatttgacactttaacttattaaaggcataagaacatagagtctggtttaataacattgtttcaagatgttctaaacagaacaaatgttaccaggaaacacagctaaatattgattctatacagttttaggaaaaaaagatgttttcttttttttttttttttgagacggagtctcgccctgtcacccaggctgtagtgcaatggcgcgatcttggctcactgcatcctccacctcccgggttcaagcaattctcctgcctcagcctcccaagtagctggaattacaggcatgcgtcaccacacccagctaattttttgtatctttagtagagacggggtttcaccatgttggccaggttggtctcgagctcctgacttcatgatccacccatcttggcctcccaaggtcagaatcataattttcaacaaaaaaagtcccattctattttttcttacagataagtttttcagctattctatctatgcaatattaatagagattcagctggttgtactcaaattactttagaattactatataattctatcaataaaacctatcaaaaatgactttacggtgaattgtataatatatactaacatacttaaattcactgttaaggaaactaatatcttatcacttcttctgtacatttatctgaatctgtagacagtaagcatagtaaatttattaagtgtttttaggcatttaaactataccttcaataaaagaaaagttaaagtagcagcctggattatttaggacaaaatgctaattttgtccaatttattcaatgatgtgatatatattttcctacaatatggatgtatgtgagattttgcaaaaataagtactagagaacaaaaaagcgtagggaagaattctcaaaatctcagtctccaaagtaacctaattaaaatacaatgccattgcaattttagatattttaaatttagatattaaatgcaatacattctacagtaactatcacacatgaacttgaaaaagtcatgacatttgcttagcgtcagtcagtctagtgcagtgtgggagtttttgagtgatgaagaagaggtggcagagtgcatcaccttctcgtggtcatgacactttcacaataataagaaggctaatatgccctttccctagaaaagtaagacacgcagacacacaggcacatgcaaactattgcatataatttcagtgactttacagctcctgtgatgccacagacctgagggtgaggacccctgggttaaagaaaggacatctcattcttagggtgaaatagaatgataccagagttggttcctagagaggttcaaacatggatgaaattattttgaaattaatgttggatatgtagagtgtgttcttttgagcatgactcagatcagaatgtataaactttggacagagaagagattggaatgaataagtagaatctctagggttgctccagtttccataatatatgaaaagttgacaagatattgtttctgaaataaaaatgttttggtgggggagctttcattcatgttcatatttggacttggctgccacaaggtggaaggtgtgaccaaaggttgtatataagctacctcatagacgaagcccatgggtggttggacaaaatttcattcaaaataccattgcaattttagatattttaattttagatatctaaatgcaatacattctacagtaactgttagtagtgttgaaagatattatttttacctttgcttaatttttgtttaacatatgtggtgggttgatattgaacttatgatttagtacatggctcttctgaggaataagactgggaattgacaaagaaaaagaaaaggcataagaattaaatttgtaacaattgagagcggaaaatataagctcctggtgtgaaagtcagctctgaaagaatccaatgaaagtgggctgactttgatttatagaaaacactgtaagctaataaagcagaaaaggaagattcattagaccacaggagggttatctattctaactcacagttctatgtagagatcttttctaaaggttttcacccaccgacttctggtcactatatagtgttgaggaacttcttactccagatgtggccatattaagtgtgtagtaacaattaattgtttctatttttaatatgaaggtaattttgttttttttcagatatggaatgagatgttttctgattagaggcaagtcaaagggtaattttattgtgcatggattttctgtttagatatcataaatttgatactctgttgaggtagttctgtgatatttcagcctctgctggtaggaattttcttcacatgcctgattagctctgaatccttcttattttggagatttgacccctgcatgtgtgggctgtgctagtggagtggtgatagtggtgagtggaacctctcctgaggtgattagcagtggtgagggctaatgaagactcatgtacctcataatgaggcaagtccaaaattctttaggggcaggtaacaagtttgaatactttctgtgtaaacagttcatagaactttgaaagtgttgcatgattattttgtgattttatctttctgttaaatattgtggtgtgagttacttgagaataaagactgataatcacagttatttacttttacataatttcctgagagaggtaaaaatattaaatatcttgtgaaagtctgaaggtctgtaaggcagaatctgagcagaggcctcctagaagagtggtccatcacgtttgtggacatctcaagttgctggaaagtttatccttatggtgaaggattatatgtgtaatagtcacccatggtatactagaatgtaatgttgtgaagataggaactaagtcttggccatctttgcctttaagtatttgaaggctattattctgtcacttttcttgacatcttcttctttccaggttactcactcccatttaattctaaatgtaaaaggaaaaagaacccttacattcttcctcaatcaaattacgtgtcaaatgtgcatttgcttttgttaagttattgaggtttctttgagcaaacaatctcttatcccaatattatgagctgtttgtctcctgggaataagaaatttttaataatgcctagtgattcttttgaatttttctgaaataatttctgattgaattttatgtgaataggtcttcaggtgcatcactgatgctttcagctgctttgacaatcctccggctacttttgtggggtaaatctctctaaattaatactgcataaactcatgtgtatgtctttccacaatttaatttatttttcatttaactaccttttaattgtcaaaaattatatgtatttatggtgtacaacatgatattttgatatatgtgaaataattaaaatcaagctaattaagatatccttcacctcatgtacacatttttttagtgagaatgtttaaaatctactctctgagaaagttcaagtgtataatacattgttattaactatagtcacaatgctgtacaatagatctccagaactcattctttctgtctaattgaaacttcttactttttgacaaacatgtcctcagcctcagccctggcaaacaccattgtctttgctcctttgagtttgacttttttagattctacataaaaatgagattcatacaacatttgtctttctctgcctgacttatttcacttagcataattccttctagattcgtgcatgttgctgcaaatgacagaatttctttctttttaaggcttaataatattccactgtgtgtgtgtgtgtgtgtgtgtttgtgtttgtgtatgtgtgtgtattctcttattccataggttctctctacattatgttgattgtttcattggctgtgcagaatcatatgtatatatctcacatctgctttatctattcatctgttgatggacacttagattgattctgtatcttgactattgtgaatactgctgcaataaacatgggagttcagacatctcttccacatactgatttcatatcttttcgatgtatacccaaaaggataattgctgtagcatatggtagttctatttttaattttttgaggaaccactgcacttttcttcataacacctgtacaaagtaacattcctgccaatagcatacaagtttccccctttctccacatcctcagaacacttgttattcttttgtctttttggtaatatccattctaacagatttgaaataatatctcattgtggttttaatttgcatttccctgttgattcatgatattaaacatttaaacatacacctcttggccatttgtatgttttccttggagaaatgtctaaattcaggccctctgctgtggttaaggttatttgttttattgttattgagtgtttgagttccttatgtattttggctatgaagcccttatcagatgatggcttgcaaatattttcccttattccacaggttgtctcttcactctgttgattgtttccttggatatgcatagcattttagcttgaaggaatctcatttgtctatttttgctcttgtggcctgtacttgtggggtcatatccaaaaaatcttgctaagactaatgtcaagaacatttttttcctatgttttctactagtacttttacagtttcaggtcttatgttagtccaaaattaattaactagagatgcataaatttatttctgggatcttaattctgttccagtggtctgcatgtctgtctttatacttgtaccatgatattttgtttattataactttgtagtatattttgaagtcaggcagtgtgatgccttattcttattgcacaatattgctttactatttgtagtcttttgtggttccatacaaattttaggatttttttctctatttctgtgaaaaatttcattggtactttgatagagattgcactgaatctatagatggctttaggtactggacattttaataatattaactcttctaattcaagaacgtggacatcattctatttaagttcatcctcttcaatttttcatcaatttttatagttttcagtgtacatatcttcaacttcctttgttaaacttattttctaagtgactttttggtagtggttgtgaatgggattgttttcttgatttctttttctgatagcttgctgttagtgtatggaagtgctacagattttatgtttattttgattagtgatattaagcatttaaaaatatacctgttggtcatttaataaagtttgtttattatttgtttaccaaatttgtttattatttattaccttttcttggagtatttagggttttctgtaaataagatcatgttatctgaaaagaggcaatttaactgtttccctttttatttggatgccttttattgagttttcttgcctaattgctctggcaagaaattcaagtactatgttgaatagaagtggcaagagtggacactcttgtcctcttcctgatcttagagggaaaggtttcaacttttcactattgagtataatgttagctgtgggattgtgatatatggcccttattgtattgagataaattcctcctataacttatttgttgagagtttttgtcatgaaagaatattgaattgtatcaaatgcttttttgtgtgtgtttattgagatcatattatttttgtcattcattctgttaaagtggtatatcatgtttatgtctttgtatatggtgaatcatccttgcatcccagggataaatgtcactgctgctgagtatggtttgccagcattttgttgaagatttttgaatctgtgttcataagggataatgatatgtacttttattttcttttagtgtccttatctggcttttgtatcagggtaatgctggccttataaaatgaatttggcagtatatcttcctctttgactttttaaagagcttgagaaggattggtgctagttcctttaaacgtttggtgaaattcaactgtggagccattcatctgggattttatataatggggaattattttaaaatgtttcattcaatttccttaatccttattggtctattcagattctctacttcttcatgattcagtcttggtagtttgtatgtttctaggcatttttccatttcttctaggttatctgatttgtttgcatatacttattcattttattctcttatgatcctttgtacagaattatctgtatatttctttaaggtccatttggtctcaagtgtagttcaaaattaatgtttccttattgattttctttctggttgatctagccattgttgaaagtagagtattgaagtcctctactctttgcaatactattgtattgcagtccatttctggcttgtatctattaatatgtacctttttatctaggtgtgtcaatgttgggtgcatacatatttgcaattcttatgcaacattttaaaactgatccttttgtcattatgtaatgcccttctttgtctctttttacagttttgacataaagtctatttcatctaagtaccacctctatactcttttggtttccatttgcatggaatgaatatccttttctaccccttcactttcagtttttatatgaccatagaaggcatgacccacccccgccacagagcattcctaggggatctgggtctgggctaagctcccacggcattgctgcctctgctggtcatggggcccccaggatcagtattacatacagcatcatggcagtcattggaccttccatgacttctgaagcctctgatgagtcacctcaaattgccagaactccatggccacagaaaaccacagagtaccattgtgagcctcctgcctaaaacttctcaggacttgaaaaccaaggacaacctcactcaagatgggacaaggaaaacagtgcctctcaactttctccatgtcttgaccacaaagtcaatagtcatattacatgatcctcggagtaaggactaagctctgtaggccagagtggatagccagggcctctggctaccctaaccccttcctaattgactcagtaaataagaaggaaaatctctttccacacctgtgatcattcttggtcaatagttgagaagttctacagtggaggaatgcaagtctacaacattggccactgatcctctttctctttaataaaactttgcattatttgaccttggagacctaatctatctagagatgatcagagaagactccagctgtcagttcccttcttggtcttgtgtctggctggtttcagctatgcatgggaagggtggtgtaagaggtgtgaggatggagaaggtttatactcccttctctgttttcatttttaacaactaaggaagaaataataggaattttcaaagtcttcacatttcaggaatgtgtagtctaactgtgggatattttgttccactcacatttttccccttctgactgttcacatttatgattctgacttcgtgaatcagaaaggctggctgctaacatctaactctttagcacctatcttttgagacaggtagtacctcccactttcaaaaattggggcctgctattctccttattctattttcagctactctctatgtaataagcagatgaggcactttttgttgaaagattacccaaggaaaatgtcaatagaaagcatggtaggttttggtagagtcagtattaggatgtgtactaaactcttcagtgacatttgtctgtacagtggaagcacaatatggatagtctgatttagagatgatccaaactcatttcatcagatcagcagtagatgtttgatgctggatatcatcgttggggggaaggatttgtgtgtttcaatgttaccttcaggttttggtctaagaataggaaacctttattctcttacttgggtggagaaggactctaaaaacacccccccccccatatttccaaatgacatgtagttataatttccaataataaagtagtaactgttaagaaaaattacccaaaacctgaaaagaatgaaaaatattacttatactcctccaattatttaaggtgagctccttgagccatctctagttacatgtaacttttttctttttttttctttcttttcttttttttttttttgagatggagttttgttcttgtcgcccaggttggagtgcagtggcacgatctcggctcattgcaacctccgcctcctgagttcaagcgattctcctgcctcaacttccctggtagctgggattataggtgtgcgccaccatgcacagctaatttttgtgtttttagtagagacagattttcaccatgttggccaggatggtcttgatctcctgacctcatgatccgcccaccttggcctcccaaagtgttgggattacaggcatgagccaccgcacctggccctagctacatgtaattttttttttttttacttactatttcatcactttatggaccatactaagatctgtaaagttagatttaatttacagaagattgataagtagcaaataatttttgccccatagagttataagtgatatttgcctgattgagaaaacaaaccaaaaagttcttgttttatctgaaaagtgtcaatcatcttgtaaatctgacattaatattgccgtgcttcttcttgtaaggagtataatgctaatctctggtattcacctttcaagcagcttgattgtgctgtttattccctcattaagaaattaagcaaaaaatatttcacaactgctcattacatattttttagagtcatatttttaattttttttggaaattatactttgacctaacacactgagaaataaaaggtctcaagaaaataggttgcttatgatggatggtacttttttgttgggaagtgttagaaacttgaattcatttaactgctccccaagtaggggagaaatcattaaatcatgggataattgagcagatgtaatatgctgcaaatgtgggaactgagagttgaagaagatgttcctacaggatgaataaagggcaaaaacaaaaaagaaaatgaaaaacaagaaatgaaatatatactttgtaacaataaagaatgcaatccatagtgaatatcgagtagttaggaatgtgccaaatagcaacaatatacatgtaacaataaattaagattaaaacatcatagaaataaatataaaaattgaagatgaaacataatagaaatagaaaactggaaaaaactataggcttattatataattccaagggcacagtggaattactggatacatttgctttaaaatcaggaataagacattactgtcaatatatgacatggtctaagttaatgtttatattcaggcactaattaatacaattagacactcttacaactcatcaattaaaaattaacccagcagaagatgggcatacacactctccaaagaaggctgtacaaatgagtgataagcaaatgaaaagatgtttaacattgttagtcattagtggcatataaatcaaaaccacactgagacagtgagatgccgcttcacactgagtaggttggctatatttaaaaagataaacaagctggacatgatagctcagcctgtaatcccagtgctttgggaggccaagatgggaggattgcttaagcctaggaggtcaagaccagcctgagcaacatagcgagacaccatctctacaaaaaaaataaggattaggtaggcatgttggcacacctgtggtcccagctgctcaggaagctcatgtgtgaggatcacataagcctgggacatccaggctgcagtgagccatgatcgcgccactgcactccagcttgggtgacagagcaaggccctgtctcaaaaaaaataataaaaacaaagataaatagtagcaaagtgtttgtgaggctgtggaaaaaactgagcatgcaaacattgctggagggaatgtaaaatgctgcagtcactttggaaaacactttggcagttcctcaaaaagttaaattgagagctagcatttgacccagctaatttcatgccaaggtatattcccaagataacataatatatatatatccacaaaaaaaatacatagatgatcatcacagcatattcctaatagtcaaaaactggaaacagtctaaatgtctatcaactgatgaatggacaaataaaatgttctatatacatataatggaatattttttggtaataaaaaggaacgaagtactgttacatgccacaatattattggaccttgataaataaacttaggcatattaaaattttaaagtatatagctgagcagacaggagttaatgaattggtcagtgccagacctcaagcgattgggacctcacagaaggtgtgtgagggaaaagcgtttataaggtattcacggaaacaagacaaaggcaatatttgattgataaagggaggacatagtcttaaagttctagatagagattccttggctatttctgattgcttaagtttacgttttttgtttttgttttttttttgtttttcccctgggatatgactgtatactctgagttgggtttccgtatgtatatgtcggagtccagaaagctgatgccacctcagtctaatggcctcctaattaattactttaacacggtttgtgaaagaagtcagtccaaaagaccgcatattgtaagattctgtttatatgaaatgtccaggacagcaaattcatggagatagaaagtagattaatagttgccaggggctaagaggtgcaggggactggggagttactgctaaggcaatatgggtttttttggagggggtaacaaaaatattgtaaaattagataatgttgatggttgcactactctgtgaatataacaaaattcactgaattgtggatttcaaaagggcgaattttatgttctgtgaactatataacaataaagctgttataaaaaaattacaatgtatacttttgaaaattgactcatgcaaatagaaaaccagtatatgccaggaagtaatttctatgtgtgggtttgttctttctgttggcatactctttctgaggctttggagactcagaggaataatgtgtcatttaatttgttattcactatgacatattaaatatgtttttagaaacattttgtctttaacactacaaggtccttcagataaaaaaaagttctcatatatcaaaggttttgtttgttttccccacggatgctcaactttcagatcctgaaaaactatttttgttatttaagaaatttatgagtctgatacatttaagtaagaggataatctcaaacattcattcgaatattcaagtaatgtatattgagtgtttacagtgtcctaggcactgctagacattgggtattaccagctgggcatgcagctacactgctgacactccaataggttaactcactttttcatggccactttaacctccctagtctactctctacacagaagtcagaatgctatttttaaaagataaaatatattatgcttgaaatcttccaatggtttttatttaccttagaatgaaatttaaaagcctttatactgacctttagtactttgcacattctggcctttaccaccactttacctttgtctggcaccactcgtaatactcccttgctctagctatgctggagttctcttggttcctttagcattcggtcttctctcatgactcttgttggtgttttgaatgaaataggctctcccctggccatcctcccaagcacctttatctagctaatgttaatgctactcctcatttctgtgttgcgaatagataccactaactatgggaagctttcctctgtagaaatggttgggtaactttgtaatgtactctggcaacactgtaacttctcttttacagcattttgcatgaatgcaattatttattttctatattttatattgatttgcagatgcccaaaggcaagagactgttggttgtgcttaccactgtatccctagagttgaagtcttgattcatatatgattccccaatgaatatctgatcatcaacttaagaaatctggcctttatcatgcattggctggaccacagcaattgtctccaaattgatctttttgcctgtagcttggccttctttgtatctgtctgaaaaaatacaagccccatagcatggtgtaaagttccctttgtagcgataccacccttgtcacatatcaatctcattccaagtctcctgacttgccctcccttcctgtcatgttccaggtctattaaagtacatgcagtacttcagccattcatcttaaccccatgttgtgttgaacattcttctatgtccacctcaccagtaaaactggaagcttatacagataattcactagactttgtcatttgtttatccccagtgattgttaaagtgtctggcaatatttgttaaactgaaatgacctcaaatgccacagcagaaacttcttgatttaatgcattgaattagatttaatttcaggcatttataatattttattgaatcttaaattactaacacttcatatcttccatgagagcacagcaagacaactgtgataatctatgattcttctaatgaatgcacagaatgcttccatttaaacttttatgcagataaatactctgatattattagcgttgtatctgcatttatcttaagtcctgtcaaaaatcctgcttatcaaattaggttattggaaataagggcaagagaaaaataataaatattaaaaccacattttggtagaggtgtatataatctattctaaatagctctgggagtgttcccatgctacatctttcatcttccatttcttaattcaggaatgcaaacatcaggcatttgggcttctccactgcatgtactgtctgggttctaaggcagcccaagctgcccagggcctggggcaggactgaggcttcactgacaaactagatgcatttagactgtacaagtgtatttctcatttacagaatccacgtggttcatctaaagaagtttttaaaactgctttttttgtagttcactcatgttcatttagatgttaataggtattctttgaagaaaaaaaaagttgcatgatcttaattaagttcagggaaagcctacacacaatagtcatctcctagagggaaatgtgggtggtttccacgcagatcatgtcaaaggctctaagaaatcctgctattaaaaggaatgcttttacactgttggtgggagtgtaaattagttcaccattgtggaagacggtgtggcaattcctcaaggatctagaactagaaataccatttgacccagcattcccattgctggatatatacccaaaggattatacaaatcatgctactataaagacacatgcacatgtatgtttattgtggcactattcacaatagcaaagacttggaaccaactcagatgtccatgaatgatagactggattaagaaaatgtggcacatatacaccacggaatactatgcagctaaaaaaaaggatgagttcatgtcctttgcagggacatggatgaagctggaaaccatcattctcagcaaactatcacaaggacagaaaaccaaacacctcatgttctcactcatggtgggaattgaacaatgagaacacttggacacagggtggggaacatcacacaccggggcctgtcagggggtgggggactgggggagggatagcattaggagaaatacctaatgtaaatgatgagttaatgggcacagcaaaccaacatggtacatgtatacatatgtatcaaacctgcacgttgtgcacatgtaccctagaagttaaagtataatactaataaaaaagaaatattgctatttaaaaatacctgttaactgtattaagtaaagcatttccagtatatatttaaccaagaagcccatttttgactgaacaagttatggattttctgctaaaaacacttagaaaaatgctactctgaggtacatttcattacttcccaaagtggtcattttaataattgtgcattatttcgggtttgggtcacagcaaatttattttgggggatgttgaagggaatgtggcctagtatgtggctgggtagcttcaagtttatggctaggccattggcagctgtgatcatcctcagatgggtcccccacattaaagaaggattggtcatgctgaaatttcccaaggactctaagaacacggttcagaaactgaatccctttgaaaaatctatgtgcatttgattgaattagattttttgcaggtgcagcaatgtgaaaataggactaaacattatcttgacctcctaaaagtggtttatttccagagagatgagagtaaacatgtctcagacaaatatctttgtctggatgctatgcttctagttttataccaagcaaccattttattcaatgatttatccatatgcaccgagaattattatattcacaaggaccattaagatggattctctagttaagagcatacatcaaaagcaaagttgtttccagtttaatgtgtgtgtgtgtgtatatgtgtgtgtgtgtatatatatatgtgtgtgtgtgtatttatatatgtgtgtatatatatgtgtgtatatatatgtgtgtgtgtgtgtatatatatataatttgaatatattggtgtttctcactaacttgggtgaaagtatgaatcataaatatttttaaaatccataatatgtaatatggattagaatgtgatatcttcgtcatttgttgatcaacaaacaatataatctatgtaattaaaatgcacatcacagtcatcagtgatctctgatagagtgtccttcattcacattggaaaatccgtaacccacaacagaagataatacagaaaagctttccaccccacggcctggtgtcgtctgactttgctattggctttttcatacactgatcatcagctgagtagccttagaacaaagaggtattagtagtatcacaaaaccactcttaccctgttcagagacaataaaggacactcctggccatagtttactaatccgccatcttagaattattaagcctgttgaaaaaaaaaagagatcatgttaaatgtaagagatggatgaatacaaacaaaaataaaaaacaagcggccaggtgcggtggctcacgcctgtaatcccagcactttgggaggccaaggtggggagattacctgaggtcaggagtttgagaccagcctgggaaacatggtgaaacccaggctgtactaaaaatgcaaaaattagctgggcatggaggtgcacacctataatcccagctactcaggagactgaagcacgaggattgcttgaacccgggaggcggagggtgcagtgagctgacatcgtgccactgcactctagcctgggtgatagagagagactctgtcataaataaataagtaaataaataaataaataagtcacaagccttcatattatactacaagcaagcaagattttaaaaatgaagccactaaacttatatttatgaaaaaattgaaaggagtaaggaagtgccccccacccccctttaaaatactttctcgaatgcctaaatagtcagacttggcaggatgatgatagtaactgtatcttctcttcatcattttccaccgttcctaatataaaaccgaacgtggaaagcagtcatgtcttttctcctttcctttcccgtcattttctctacctctgatgatttcaggcttttgggatataaaaagtagtttattcctagagtcactttagagacccttgtcacatcagcctggtagaaattgatttctcaggttcagttaccaccttgtttatatgtatccaagaaatctctgagcaccagctttctacttgacactttctctcagaatgtcacaaagactctttaaaacccagaaatccagaactgaactcatggtcttgtctcccgaacctggttactctttagtacatccacttagaaacctaagagtcatccttgacacttactttacctcccaccaaatttccaatcctgattcctattgattttataacctaaatatgtctcaaataggtttgagttgctcttttatgtagccaactatcatattcttgcttggagatgattgcaggtagatatgtcctagttagtctaatctcatccagtctccctctctcctccactgccctatcccatcccattccatcaccagaataaccattgaatctcagagcctcagaataacctttcaaaaactcagtggtaacctgattttctcagggtctaattccttccatggtaggcttgattaatttctttaatataatcatcaagactatttatctgcctttcaaattctcagtcctattctctcaccaacaactcacctccttccttggttagcctggagttattttatagactttaacccaacagtcaaattcttgggactttattatattaaaataaaagcactaatagttttcaaagatgcagaacaaggttgtttatattttcggcaacattcagatcacaatactggaaagaagtaaatatccaactgggggattgttgaatacattaggatacaatcacacacacacaccgtggaagattatgcaaggttcataagtaatgcattcaagctctgtccattgatatgaaaagattttgatgtcgtattatgagactgagaaagtgaaacaaatcgaagcacatataatgccctatttttgtaaatgattccattttaaatatactatctttatgtttagaaatagatactatatataaatgtgtgtaaatgtgcttatgtgaaaagtacatggacatgtgaacatggagaaaacagaaaagaatgtgtaatgatttgctgtacctgattatctgggaaggacaagctgtgagtcgagataatagggaggataggagttagagaagcaagcaaaataataggaaaagtctatggcattaaaaaaaaaaatgagaacccagtgatgcaggacaggtgaggccccaactggggcttaggctgggagggtttcttgctttgcccgggaaagaacttaagggtcaacccacggtagaagaaaacagctttgttgaagcagcagtgttccaggtccgggggtgttacagctcaggcagtgttgcagctctgtgactgctcctgcagagcagagctcctccataggcaatgtgttgagagtagcagctcagggcagttctgtaagtcgtgtttatacctacttctaattacatgcagattaaggggtggtttatgcagaaatttctaggaaaagggtagccatttctgggtcatctggtcatggctgtggaaagaggcagcagctccagggtgttgccatggcaatggtaaactgacatggcacactgtaggggtgtctcacagaaagctgcttctgccccatccctgttttagctagttgttaatttggtctggtgtctgaacctggcctccagagacaagttctgcctcttacttcaccaggatgtatgatatgatcctgtgtataaaacattatatgagtatgtatatgtgtggatatctacacgtacacatagataaattataaaacatatttgtatatatctactaattgctggatatattcttgaaatacatgacatttaagtgacaaaatctgtcgtggagaagtatagagtataattctaatttggtaaaatcagacaaaaaagaacaaaatgtaaatacatgtgtttgtaaatgtgaggataaggttatagaaggttgggtcttggccagcttgctttcccttctctgtcagcatccaccatttgggattgcttatgtacccttccagacatttaaaattcatttatatgtataaataactataacaatagaaatatgtggtattttaatttaaataccacacatgataccttatcattttcagttttttgttcataaattatcttgaagttgttttttttttttttaagatagggtctctctctctctctctctctctctctctctgtgtgtgtgtcacccaggctagagtgcagtggcttgaacagggctcactgtagtttctaacttctaggctcaagcgatcctcccacctcagcctcctgaatagctgggactacaggtgcacagcaccatgctcatcttgtttttaaaaaatactttttgtagagacaaggtctcactctgtatcccaggctaatcttgaactcctgacctcaagcgattcttccacctcaaattccaaaagtgttgggattacaggcatgagccaccatgcctggcccatcttgatttttttttttaaagattacaaagtacataaaaactatataacatactatggattttatagtcgttgaagaatgatgggcattagttttcagtttttcattattcaaaataaatgatctattgagcatccttgtatatgcctccttgttcttaagtgtagttgtttttttaggtgagatatggttaatgagaattactgcctggtagaaagtatacacttacaaacatcataaaaacagccaataccccacctccacctcattagaggatttaccactttacattcacagtaacgtgagagactattggtttctcataccttgacaaacaattgatactgtgaatatttaaatgtttttctatttagttggatgaaattatattttcaatttcaaagataaatattgaggttgatcagcttttatgtttattgccatctgcattatatctgtgacttatgtatccatatcttgtgttcatttattttttatttggttatctttttcttagtttttcaaatattctgcataataagcatttgtctatcaaatatgttgaaactccagtcagcagtctgttttaactgcctttctcactgtgcaatatatgacacatgaatgtgcgtggaatgttataggtaagtagatgtgaggaatgacaaaggcagaaaaacttacaaggtctccatgcgatcagaaggaaggcatgatattatatttgagtactctaggaaaggagcatttaaatcgtctcctgcattgtcatgtgactatttccaacaaatgagttattgagaacaaaagtattaattcatttgcgtaaatggctattagctttgttctggggactgggagagggattggtagttactgagaacaactgtaaacacgaccaaacaaaatacttcctctgctctactccacattgctacaggacaaatcccaccggggacgtgcaaaccaaatgctggcaaggttgataaataaactcaagttgagagatcgagagcaatttaatttcataggtgatattttaaacacatctgaagaagtggaaacaggcaaggagaaaaaaagaaaagtagagactgaaaagtacagggtgactccggagactgtaacacaatttagctgaagtgtaggatactcaaagtggagtgctgggaaatttccagcttcagctgtaaattcacatgaaataatttggtttgtcctcattaggagatgggaagaaccaccaaaggctttggttcagagcagtttgatcagaactgtgctttaggaagattaattgggggacctggagggaaggattagagctgagagagtgttggagagaaagtcggcaaggtagcccttccatctatctgagaagagctagggaaagctcactcttgagtgaaggaaattccagtgcaggagcggggaagtgaaaaggcgagatacctgatgaaagcagaacagcctttgcttgcacatttttttttttagacggagtttcactcttgtcatccaggctagagtgcaatggcgggatcttggctcactgcaacctccacctccgggattcaagcgattttcctgtctcagcctcccgagtagctgggactacagatgcctgccatcatgcccggctaatttttgtatttttagtagagatggggtttcaccatattggccaggctggtctcgaactcctgaccttgtgatctgcccacctcggcttcccaaagtgctgggattacaggcgtgagccaccgcgcctggcctgcttgcacattttaaacccctagctggtgctgtttctagagcatcttcatacattttcagctttggaagagtagagaaaatatggtcatatcgatttcttctccattttgcttttatctagttattatttttaaaaaattgctttttcaatgtaggattcttacacccactgataaatgaaatggtcaaattttgattttacatgtctagagatattacttagcctcccactttcccctaatctttgttgttgttgttgttgttgttgttgttgagatggagtctctctctgtagcccaggctggagtgcagtggcgcgatctcggctcgctgcaagctccgcttccccggttcatgccattctcccgtctcagcctctggagtagctgggactacaggcgtctgccaccacgcgtggctaattttttgtatttttagtagagatggggtttcaccatgttagctaggatggtctcaatctcctgacctcgtgatccacccgctttggcctcccaaagtgctgggattacaggcgtgagccactgagcctggccactttcccctaatcttaaacttgcttcccagtggcttttttttcccttctctgtggtttctcacaacctcagtattgatattgtagtagctggctttcttctcttgatgaagaagagttttgtagtttgtggtgctacctaactcatgagggtttaaaatatcacaaagctcaatggtcatgtgaggaaaattattatattttcttggacaccatatttaaaaatgtgattgaatcaagctttcccgagtataaccaaattaatagcacagtttggaattctacccccatctgcatactcttgccctcagggtagaattcctctcttttctttccactaattattcagggtttatctaaagatttccctgaagaccctggttcccagtgattttctctggctcctataccactcatggcttatagcatttctttggcacatactttgtaccccattgagatggtgtttctattgtactgaagttaactttatataattatcaatacatttcatacttagaaattctacctccctaactagagtataaactctttgaagataagaaattagagggcaaaatgtattttatttccagtttttattgccattattgataatacttcacacagttaaagagaaaaaaaaaacctacatttatttatttatttacttatttatttaccaaatcctcacatcacagctgcatgtgaatcaagtatgtctattttgcaaatgtcaaaggatggacagagcttgcaagtgaattgattaaggtcaatagcacgtgttctagaatctgcagttgcccgtttgctctggtgagtcagcatcctgctgactgctgccaaagtcttggcctgcctccacagatgtgcaagctgccatgaccctccagccgcccctaggtccttgaatatgtgtgctctgactgctaggatcaagtctatgaagccttactttcctgtttataccagtgaccatcaggagctgaagacttttgcattatccaagatcattattccaacctgtgtgtctgatttcttctgccttctcaaatccaacaccaatacctgcactatctctgaaatctgcaagtcagatatctcacattatggtcattatttcctaccattccagctaacttactccattatttttacttttattcagttattgacatgatattcacaaaatagatctatggtttaggaaactgtttgcaatgcaattttaattgaaaaagaagaatataaaattgtcatgtaaaaattcattggaaaaagacagctaatataaaaaggggtgatggacttatgggtgtttttgccaattttagaataaaatatattctactcctttatttctaattccaaaatcactttatcttatggaaatgttcaatgtacttactcttctccctcattttttttttctcttatttctctctttactaaatctccatttagatgatctagtaccttcaaagcaggtgaatacaattctaatcagccttggataaagctataaagaaaggcatgtcaaattcaggttatatgtttaaactgcatgtctccctgacacttccacactatggaaaatgttgtctcacttgttttgcaatagaagtattttggatcaaattatatgaaacgaggtctctacattaaaaatataatcatgtggtaatggctactgtccccccaaaaaacaaaacaaaacagaatctcactagattccatcccttctctaggctttgtcccataaatctgccttccttctccaaaattccgtgaatgatttgtgtatttcttatttatctttatctcttgcacccccactgatcactgtgctttcttacctgactctgtgctgaaactacactttccacgaatcactgatagtgttcttctgattagagccaatgatgaattttagtcttcattttacttgcattttcagtagcttttgaaacatttaatcatttaatctttaaaaacaacaataaatgctttctgcatttgtagtttgagataactcactcttctgagattgccttacttctccttgagcttcatctcagaatcattttcaacttcctttggtctccacatctaaatgttggaatgcccaagaatcagtcttcagcactgtctttcccctatgctcatccaactgcctgctgttgaaaaccacatttttgtaccttgcctgatctctcccttgagctttcagttcaggtaactaacagcatattggacagctcctcttggatgagtgattgtcataggaagccaaatatgtccaagagagacttaatttcttcccaaatctcttcctttagtcttctctatctcatttaatgataccttcatgtgcccagtcgcttcagacaaaagataccagagattcatgaatctgtctttctttcacttgctatgtttaatccacccctcaagttctgctgtctcctccttcaataaatagatccagatagatagacagatagatccagatagatagatcttccaactggatctcagtcctcatagaccacccttagcaaaggcaacatcatctctcccctgaaacacactcaaaacttcatagctggattcactatttttatcttgtccattttctttcttccttccttccctttctttctttctttctttctttctttctttctttctttctttctttctttctttctttctttctttctttctttttttgggtggggggactgagtttcactcttgttgcccaggctggaatgcaatggtgcaatctcagctcactgcagcttccaccttccagggtcaagcaattctcctgtctcagccccttgagtagctggacttacaggtgcctgccaccatgcctggctaatttttgtgtttttagtagagatagggtttcaccgtgttggccaggctggtgtcgaactcctgacctcatgcgatctgcctgcctcagcctcccaaagtgttgtgattacaggcgtgagccaccgtgcccagcctcttgtccattttcttatgccctgtgcatacatctctccaaatgacagccagtgtgatattttttttgaaacataaaagagatcatgttactgccatgctcaaaattctccagttacttcagagcccacttagaacacaaatttagcccttggcagagcatgtgggaaactacccgatgatctggccagtctgcctcttgcctcatccccctaggctccccagtactatgtggcatttttcagtttcagtggcctttctttctcttctattttagagttgttctctctgcatataaagtttttccctgtgatcttcccatggctgtttgttaacattattcagaacataacctaaatactactttccaaacaagtagaaaatagtatttaaaccaattgaccacctggctggagcaccccacccccactctaccccattccactaccaatgatgcattcttaactaaataacattcatcaagacttaaagttgtctatttaatgtcataattttagttttctcactggaatataagctcctagagagaaggttccttgctctattcccatctactacaataatgtcctaccaataatgagggctcagtgtattgattgacattgtcatctgcagctaaacaagaacaaaaattgatttggctttcagtctttgaacttcttaaacaaaggcatctttaaaactggaaatcaggaaggaaagaaaaagagagaaagagaaaaaggggaaataattgaaatccttggtcaattctcagtatctctattcctgactttgagagagctcagtctggacaaattagtctacaattatgggttggttttccatttcttatttaacgacattggccctgcagcctcagcctggtggttttccataaaagactagatttttctgaagatttctcatatctaagcacttgtcacttgggcttacaagttggattttcctttaagagcctgaactaaatgctttaaatggacccatacagtaagtttaattaataattatgaataggaatgaaatgcagaagcgccctctggtggtttaatatataggaatgcaaaaatagcaacgtggaatcaagattcttttcacagtggggccaataggagattattaaaacgtgcttctgcttctccctgtctttcccttcctctgcctcttcctccttattcttttccttaattcaaaatataatatgagttagaatgggaaaatttatgacaatatctagcagaaatccatgtggagaagcaacttgtggaaaactgaaaggatccatgcctccaagtaaacactttaaacagaagaccttctttactctttgctaaccatagcataaacatacctctaattcttgccaagcagagatagtatgtgtttcctctcttacttaaccttaacattactttatttggttttccccaagaactgggcaccttgtacaaatttggaattttccttatgggtagcttgtttaaaggcagtgctttatggagtcttaataatttataacttcctataaatattccttgttgcaatactagaatgtactagtgttttaaaagtggtattatggttataacttttatatgttttccgtacctggcttatggaattatttgtaccttgaatgtagcatatctactatttggatggcagttgtttcatagttttagggcataatattttgtaatcacttatttttatttatttttttttcatttctattgatacaaacgtagcaacatagtaaaagctcttctcctcctccttttttgtggggtggggacagtatattatacgagttctctttctcctgcatctgaaagattttccttctgccatttacattttatatacattttatgatttcatctatttgcatgggtttaactattggctctatgcatgcaattctattcattaacttggttttgatctccaatctattatttagagctgtcttttagaaattacctcacaattaaagctcaaaatgagaattaatctctccctccaaaaaaaaaacaggtacaccataaactaaatttgttctaccttctaacttccatatatcagtgtctggctctttaatcatcccgattactaggtttaaaaccaccaagagctttaacttcttcattcttaccttatatagggagtcaacccctagtcaaataccattcactgcactcataaaggaactttcccttttcctctctgatttcactggttctgagtttattccaatattctcttacctcacctattggaatagtccctttgttgattgcaatgactatagcagatctttctaaaacagggctttgataattctgttcccttgcccattagttattaatatagtacaatagtctgaaaaataaaatccaaatctaatgtatctgggacattacctctgcccccatagtgacctggcccaacttactaccttcctaaatttgttctcattgaaataaaactaaaatcgtggactttctctctgtgttgaagaattagcttctccaacactgagaagaacagatttgtgggaacagattttacccctaaaatcagccagcaattttagaaactagttctcagaatcataagggaactgaacatgagaaaataaactcaaatttgttgttataacagaaaaaattaccaatagcatagttcctctggacagtttaaaattagcttttaatataatgatatgagttatttaatataatggagcacagcacatgtgtccacaaactactttgtttcttattttatttatgtatcattattattatcaaggatacatgcagactcatgccttatgtaatctattaaccgcctctctgttaacaccaagcatcccagatgtggcctgaagcaaagcaatcagttaccctgacatccaagggactgtgaagtgagcctgtgcctcctcctctaacccagtgtgcttaataatcactcgaactacctccttttttttttcaatttgtaatttccttttcaatttgtaatattctaaacatttttgcttttcaacttgtattattattaataaacattaaggaagtaccattgcaaaagaaatggagactatggggtaggcacggtgtctcatgcctgtaattccagcattttgggaggctgaggtgggaggatcacttgaggccaggggtttgagaccagccctggcaacatagtgagatcccatctctacaaaaaaataaaaggataaaaaataagccaggcatggtggcatgcgcctatagtccagctactctgtaaggccaaggtgggaggattgcttgagccagggaggtcaaggctgcagtgagtcatgatcatggcactgcactccagcctgggcgacagagtgagatcctgtctggaaaaaaaaagaaagaaaacaaaaacaaaaagaaagaggagctccgctttttgagtctaatgaaaataaacaattgaagttattctttacaaagtttttttgtaaaatgctttgaaaatctgaacatttgaataagactgagtgcacagttgggggaggctctaaagataagtttgtgcttttgcacgtagtgccaagattacagtgagaatggggaaagtcagctaagtgacaagcagttgttgaaacaaatacttgatcagaatggtggaagtgatatgggctaggagcaactaagagagtcatttcaaggtgagatgggaacttgaaaatcagtgggaagcctgggaaggaactgaaaaccggagtagataagcattagggaggaaaacaattttttccaagacatttcagactgattgcaggggaaaatggtagagaccagggaggagaattaagaaggaaattgcagtataagtcagagacgaaaaattgtcaacgtaagtgtgaaggttttttcaatggcaagaaggtactagtattgaaaggtgccacccaaattggctcacctctagggagctgaggtgacagggtagtgtcctgataacagatggttttccttttcttttcaataaagtatgaagttaatctccctcatagcaagtcaacaaatataagggctttgaaatttacttgcatttattagaatcagctatatatgcttttatctttggatacaatcaaagatatcttataagtctatggctagagcattttcttttgtatttgaaaaaataattgcaaagatgataatggggataaaggtgttgcaaggctggtatttttcagctctcagtctgccttcctaggaaacatgttcaataaatagcagttacaatctgaggtctgacgagggagggacaggatgagataagatttctctgaactcataacttcaaagtcgttttattttcttgagtttcaaagatgagaaaactaagatacatagaagttccataacttgcctcaaaccctatgacaaggcacactggatcgtgattgcagattctgtttcccttcctctttgcttctttatttcaaactgttctgtggtgtggccaaataatcttactctatccacttaaaaccactgtcaacttagatcgtcttccttgggttcttgttactaggagttgttgatgaacatacagcgaacatactttcctcatttttgtgaataatttagcacgtttctaatagatttatacttcactatcactatttttcaaagtggaaattcactttgagccttttaccaccttatccttatgcttcttttacttctcactgtcaatcatttgcccggccctgttgactttgcctctcttctatctgtaactcatgaacactgtcactactgcagttcaaaattaagatttcttattcaggactacttgaaaagtctattaacagtttacttgccttgaatggttttctctctctagtccaacttctacagtgcggcctcatgcatttgctaaacttcagctgtggcattttacattttgagcaaccatcaggagcttttatctaaaaaataaagctccttagcctggcatttaaagccctccaaaatcttttctctgacttaccctttaaatataatttccttttatgcttaccagtcaggaacccatctttccaagcaaagcaaaattttgtcaattgtccatgtcagcctcatgttttctggcacctaccctctgaggacttttcctttgcccatcatcactgttctttgttctgagaaaactctctatcaaatccatatccaagtgctactcttgtccctcctgtgcgtctctgaaatccactccttccattttactgcttctctgccgacttctggccttgacattttccatgggcctgctgaaggacctccctttttcctccatctgcacagctgctgtgatgagttttctcatgtggaaatctgaagcagcgctttccctgcttggaagcttttgcctgcattccatttgctctcacaagtcctttagctcggtatccaagtcgtatgatggcatgtttatgtctttcacaccagccttacctcttcttgctacacccatttctcacaccatgtacttcttgttccaaatgcacagtgtagttgctagaaccatgtgttacaacgttttgacatccttgtaatgggttgctcttgtcatgttatatgacagttgctattttacctgtgtaactttcatctcaactgtgtacatgaggccatgccttattcagatttgtatctctagcaattaacatagtagggtataacagatatttatttttaatctgattgaactgaaataaacctcaacatatccaggctcaacagatgctccaagtctcatcccgatggatagtagcctttcccggggtagtctttgctgatatccttcttcacccaccacccccactgggcaaggatcccacctctctcagacatccattgtcagcctcacttttttgacacatacaacttgcattttgatgattggaaggattcctttatttcttccctcttaaattacaagctctattaggagaaactttagttactcatattttccctattataacatttaatatatgtgctttgcaaatactagaaataaaataaatatgggtaaaataaatgaaatggatgcatagcttcttcaatactcattacatggaaaatcaaagagatttataactttaagggaactttggaataatttgttctaacttcttcattgtgcacattaggaaatcacattcaaagaggttctgttatatttttaaggtctcaatataaagaaaggaaaaattaggaccagaaccagagtctcctgattccaggcaatgcttttacgtatttccagttatattactctgccttttcaattatacaaggtatcatataaatctttttgatgctttatatggtaaaataattacttaattttttcaatgataattatgtaaattatacagagctctttactggataagtattaaagaaacaatacatttttcaatggggataaattattttttaaaaaacactgtaataacaccctaaaattacaccagactgagaaagaagatgcagaactattatacaaggagatcttcatattaaaaatattaatcgtcatttctaagaaaggacgttaagaagaaaactacaaagatatttgcttttggccttggaattcatttagaaaaggatcccatattcaacagcaacttatttcattttaaaataggacaagtatgtgattagttatacatataaatcataaataatatctattttggtaaagtaatgttacacaaataagtcagtttattaatatagttgtctgattttgcgtatcttacacatgtatactgcataccacataaatgtccatgacatccatttatcataattgccgtattcagataatttactttcctctgttagaaaaattgacaaacattatatatacatattatatttaagattaatattgaggtgaaagcaaaaacgtgtcattgttttgggccctatgaaacatcacattctcagaaaggtggagtacgatttctaactaccttttaatgttttctatttaaaaggtaaataggatttgtggccgccctgtaagaacacccacacaaagcccccgttgttcttttgatcagagcaaagagaagcatggaatgaagaccaccacaaggaacagtgaagagacgcttgccaacagaagaaagtaagacatttgttttacaaccagaaagagaaaagaaagtaagccattaattttacaacagaatagaacatattcaattaaatcgaataaaattcaatatggacaaaaaaaaaaaggatcaatattcattaactttaaaaatcagtggctgcacctgttccattaatttggaagacaggttccacttataagaccaagaaaactttttgtgataatggaagatttccataatataacatggaaggtcatattgggggccctgggcacatgtgacatcatacgcttaaaatgtgaccagtgtgactgaggattgaattttaaattgtaaatgtggctagtggctactgactgatgattataattttaaattgtaaatatggctagtggctattgtattggacagtgaaagacagaaagataatacatttacatgatgtgataggtattactgaatgtttaacatatattttaaaaagttgaataagaagaagttttcataattttacatgaaatgctagaaatggttatctgttgattcaaaataatacacatcccatagggctcgctaactcacatttctaccaccgtgtccatcatatttcacaggttaaattcaggcctcattttgtgttcctttgcttgataatggatgcttaaaatgtaaagctcttaaaactagaggaaattattatatgtgtgtgtgtttagttgaccagtcagtgtatgtcctggcaaacactagattctaagtcagtactttttgaattggactgaaattcagaattttatattcatttagtaaataattatttctaataatactctatgaataattcatatataaggtatttcacataagctttctataatctaaaatctgtttctttcttttttgggataggacacctaattgcctcattctctcatcagatgggctgtatgcatgggataaagatctgggctattgctggctattttctacagctaaaaagaattagcattttattttacatgtaaagtagctgttctttttatctaaacacctacaatgatcagcaatcatttcttgcacttgaaaaatcagtatattttgtctagggtgtttttataataaaacccatctacagaagatctgaagtccttcgaggtgttgtatttcaccagcaaaacaacccagttggaaaacaaaacaaaacccaacctttaatataatctattcactagcaaaatgaaaccaatgcaggtgaaatgttacaaactggctcaggaacaataaggggctcatacaagtgaaaggttttaaaagtatctatcctggccactgaatagaccttcttgtcaccaatcttgcaaactcattgttttgatgtccctgaccatccagccatgtttagccattgtccatgaatcagcatagatccaacacatgcttgtctcctgccacacggagtgaacaaccataggaactgcacatgagtccacttatgcatttcaattttacactaatttttattaccactctttagaggggcttcattgccatggcattatatttctgctagttgcttatttattgtacaggtttctctgtaaactaaccctgaattttatgtatccctcatcaactgattattccccatgaggtcataaatttccattgaaatagatgagcaatgtagcacgagtggatgctgagtctgggctaccttctcgtgtgccttgttctttctctaccgcttgagcctgatttccaatagatcacttccacttggttgtaattacttctattcgagcctagtcttatagcctggcagatcaggtagtacttagttcttcacggcaatctcaggttgcacggtcacttgctaggtcatggtcaagtgtgtagtttctaccagagctcaattgcaaagcaactaaccaaataaccagctaacccacacagccatgaaacttcagatagcactgaataagtaaacaggcttaactggactcaccatcagagcaccttgcaaatgagtaagcaacagagccttttctttctcagattaaagctcttttgggctattctgtaaatgggctagagcaacacaccaaagtgaataatatgatttttttctagtatgtaaaggaatctaaaaagcactctatctcttcctgagttttaggttatcttaggtgcagaaattttccttttatataagaagaatatcccagtaacatccaggccacatttagaaacattgctgaattgtcaagcactggaaatgtcagtactttccaccacagaggcacaaatatgtctactaagacatttgggtgatgtgatccatattttattgtcagcattatgtcccacaggatatctagacaatcaaggctcctgtctaccatggactgggaaagtttttgacatctaacagtgaaggggtccttgccagctaaaagtgaattatttccaactgtccttactaattggtaaggaggtaaaagaatttgccaaatcattagctgcatagcaggtgtcaggacatatttggatttgcccaagtagtcaccacgtataaaggaacatctgtaattggagtcaccctctgactctgtttctgataagccaaccttcaccaagtccatctcagtgtgcacagaccagccaaataggcgaggtaagtagcgaggtgttaggaatcatcaccactgtgtttttcatgtttttgaagtggccctaatctcagcaattccacagggatatgatacatttttgttttagtatttttgtcaggagaggaatgtcttttttttattgtgttcagctcaacttttaggtggtttattttatttttcttttcctttattttattttcttttattttaggttctgggataaaagtgcagaaggtgtaggtttgttaaatgggtgtatgtgtgccatggtggattgctgcacctatcaacctgtcctctaggttttaagtcctgtatacattagctatttgtcctcatgctctccctctccttgctccccaccccgactggccctgctgtgtgatgttcccctccctatatacatgtgttctcattattcagttcccacttaggagtgagaacatgcggtgtttggttttctgttcctgtgttagtttgctgaggatgatggcttccagcttcacccatgtccctgaaaaggacacggtctcattcctttttatggctgcatagtattccatggtgtatatgtaccacattttctttatctagtctataattgatggacatttgtatattgattccatgtatttgctattgtaaatagtgctgcaataaacatacatgtgcatgtgtctttaaagtagaatgatttataatcctttgggtatatacccagtagtgggattgttgggtcaaatggtatttctggttctagatccttgaggaagcaccacactgtcttccacaatggttgaactaatttatgctttcaccaactgtgtaaaagcattcctatttctccacagcctctccagcatctgttgttttctgactctttaatgatcgccattctgactggcgtgagatagtatctcattgtgattttgagctgtatttctctaatgatcagtgatgttgaggtttttttcatatgtttgttggctgcataaatgtcttctcttgaaaatgtcggttcatatcctttgcccactttttgatgtttttttttttttcttgtaaattgaagtttgtagattctggatattagacctttgtcagatgggtggattgcaaaaattttctcccattctgtaagttgccttttcactttgatgatagtttcttttgctgtgcagaagctttttagtttaattagatcccatttgtcaattttggcttttgttgcaattgcttttggtgtttttatcatgatgtctttggccatgcctatgtcctgaatggtattgcctaggttttcttctagtgtttctatggtttggggttttacatttaagttttaatctgtcttgagttaatttttatatagggtgtaaggaaggggtccagtttcagttttctgcatattgttagccagttttcccagcaccttttattaaatagggaatccttttcccattgcttgtttttatcaagtttggtgaagatcagatggttgtagatttgaggtgttatttctgaggtctctgctctgttccattggtctatatatttgttttggtaccagtaccatgttgttttggttgctgtagccttgtactatagtttgaggtcaggtggtgtgatgcttccagctttgttctttttacttaagattgtcttggctatacgggctctttttggttccatatgaaatttaaagtagttttttctaattctgtgaagaatgtcaatggtagtttgatgggaataacattaaatctgtaaattactttgggcagtatggccattttcacaatttttgttttgttttgttttgtttttgagacagtctcattctgtcgcccaggctggagtacagtgacacagtctcggctcactgcaacctccgcctcccaggttcaagcaattctcctgcctcagcttccgagtagctgggattacagcatgcaccaccacacctggctaattttggtatttttagtagagatggggtttcaccatgttcgccaggctggtctcaaactcctgaccttatgatctgcccacctcagcctcccaaagtgcagggattacaggcgtcagccaccgggcatggcctgctatattgatttttcatatccatgaggatggaatgtttttccatttgtttttgtcctgtcttatttcattgagcagtggtgtgtagttctccttgaagaggtccttcacatcccttgttagctgtattcctaggtgttttattctctttgtagcaattgtgaatgggatttcattcatgattttgctctctccttgtctattgttgagttataggaatgcttgtgatttttgcacaatgatttttttatcctgagactttgctgaagttgcctatcagcttaaggagttttaggctgaaatgatggggttttctaaatatagaatcatgttatctgaaaacagagacaagttaatacctgtcttcccatctgaataccctttatttctttctcttgtctgattgccccggccagaacttccaatactgtgttgaataagagtgttgagaaggggcatccttgttttatgcccattttcaaagggaatgcttccagcttttgctcattcagtatgatattggctgtgggtttgtcataaatagctcttattattttgagatatgttccatcaatacctggtttattgagagtttttaacatgaagggatgttgaattttattgaaggccttttctgcatctgttgagatgatcatgtggtttttgtcataggttcttttatgtgatggattatgtttattgatttgcgtatgttgaaccagccttgcatcccagggatgaaggtgacttaattgtggtagataagtttttcaatgtgctgctggattcaatttgccagtattttattgaggattttcatattgatgttcatcagggatattggcccgaatttcaggaatttcaatttggcgttcactccgtgagttggggactctttatggggattgtgcgatgggtaagtatgtctagttcaaatctgtgttcaggagtgtgaaataactacagggtgggtctgtggactgaatgtcccaatgtgagacagattgagcctaaaactcgattttcatttgacctctgtaagcctctatttagactcacaggataatggtattctgggtctttgggataaaagtcagtacagaggtagtgtctaataattcctggaaggaaaatagccacaggtccctgtagggaatggatggaggaagatttatattacatagtggttttacttatgcaaggttctttctcaagggatcccagccttcagtcaaggtgctttgatgtgtgaactgggaactgggtgaaagactgaattcctttggtggtgaataaagtgatgtttcttttcatatctttaatttccaaatatttttcattggtctctttttaaattcacatcccattcttgtttcatggatgagttattttcttatcgttcttaacattaactatagtttttgaaaaatgcattaccatatttctattttttttctgttttatctgaatttccttttcagtgttagctgggttttctactagattttttttcagattaaatgtatttattggtagaagttcctttttatattccatatattaatttgttccttttagacattgaaaacattttttatctaagaaaatagttcatttaatgtaaaataaaataaagtgattagtaacttagtctaagatgaccttgttaaatataaattcttaactttgatatcaaggttatcaagttttcttttttgtttaaaatttcttgcctgcatcaactcaaaaagagattctactatattttttctactagctctatggttttttctcttattatacataatacatagggaatatatctgtatatataaggtaagtttccaagtcaaattttccatattctgatccaatttccccaaaaaaccctaaaacagtccatcctttccccctttgtgttcttttctttcacctcacactcattctaagttcatgtaattatactggcctatcgtctgttaataagtcagtagttgttttctgcagatttttactgatttctgttattgcaattgcttttgcttttaaggattttataaaatcttgtaaggtaagtcactatatttactctcattttcaaaattctcttagatattttgaaatttagttttcaaaatatagtatctttttgttggatttcaattggagttatattgactatatagattgatttgaacaaagatattaggataatgctataaatggctatttttctgaactctgtttctaatggttggccttttgatcatattaggttttctgtgtggatgatcattttgtgcactggtacagtttcctcctgctgcacctggcaaaactcacataccctatgcactagagtctactacttaggatgtgtcctaaggaaacttgcttatacccagaggaggcattcttgattatttgtgatagctgagcattagaagcaaactatccacatctaggaaaaatggaaaagtaaaatataagactttggaacattatgaagcagtcagaagcaatgaacacattttcatacagcaaaaaatctcattgagattacagagaaaacacattgtgcagaatgagaacaatagtacaatgccattatatgaattaaaaacattattaaataaaatcagtatatattttcaaggatgggatatagcagagtatttatattatatacattagaatgagtatttatagaaaagaaagagggtgagggatgaattaaaaaattaagataataaaataataaagcaggaatgttcaagggtaaattgtgatagtatggcaggaattgaggaatatgcttaactgaaccttctgtatctgagaaaatataggtgtgtttatatatgcatacatattaacacacacaattattttaaagtttagatgaaaagtgttttttaaaatcaagttcttctaattaaaaagtagttcaaactcccttgtcaaaattttcgtgaaagctaataatactcaatttttccacaatcttttttttgccatctcatatgctgaatgtagatctttttttattatactgtattgtagatacagtgaccatccacacagagataaaatataaatgactgagaacagttgttgacttgtttggatttcctactataacccattaattaaaataaaaggaaagattacttaaaaaaatagacaaggaaaacatccaaattattaacaaaaccactgctttgtgtaattcatacaaaagggaagtaaaaattaatattttctaagttagttttattaattagttgtatatcctcaatagtgttaaaagaaaaaattacaacaaatttagttgtagatctaattggcttttatttgtgattcatgaatgagagaatcctctattccagaaaatggaatgagaactcccactgggcaagttcaggacagtgggttttgtaaggtggaaatgagaaaacagaacaataggaaaaaataaaataaaataaactgattggttaacatcaggttacttcagattattattattattattattatttttgatggtagtcccagctattcgggaggctgaggcaggagaatggcgtgaacctgggtggcggagctttcagtgagctgagatcatgccattgcactccagcctgggcaacagagcgagactccgtctcagattactttttaaaagggttaaagcagaggggacttccttattacagtgactcagatttcctggaatctcctgtttttaggaaaaagtggtctgttttgggatctgtttccttaaagtttcagtttgatgatatggcatttagcatgactgattccattttggtttaggctggtctgttgaggcctagtgcaagagttcagttcaaaacaatggcctataatatttgtttaacaatagttttcctcaggtatccttttttaaaatttactttgagtaattcccaagagaatacctctagcagaaactactttctataaatttaaaccaaaccaaaaccattaaaggaaagctatgaaacaaaataatttagcagtttccatagcttagtttctgtaatagctgaaaaaataggaattgtaaaatccatcagcgtctttgccaacataaatgaaaataaacactattctatgtttgccaaaaattaaagatgcattttacattataaataaggcataaccttttcaaattatattgtcatagtttatactttagattttgtgtattatgaaaattttgttgtttaaaattatgttagagatatggcaccctaatttagaaaaactatttcaggtctttgtgacagaggaagaatttaatttatattttagtcttccagtattcaacctattcttttgaggtaatgttaatataattgtcagggaggggaaaatgtcttccttccacactctgaaattctttagctggagtacagattaaattaatataaggcagattaatagaaaaacgattttaattacatatataggaatgggagtcccacaaaaatatggggcttaaggaaaggccaggtaattgaagcttatatagcatcctgagctaaagaaaggaatacagagctggatcttctagtgggtagtgaagacaaactattgagagggtgagtggaggaaagggatgggaaataaaatttgccttgttacacaggtaaacttcgcactggtgataaagacaaactaggtctcctagaagttctcttcctgattcagatacctttactaaggaaaattttctttatagatgtaaacttcttttacaaaagagcaggttttcagagcctttcctgtgtcttcagtttctcaaaataaccagttcaaagtaatcaaaatgacaaaaagttatattttggggtggcatattctggtctcctacagttatattttggggtgttgtgtcctatgcacatggttatgcctcaccataaccgtggttgacttataactaatttaactagctacctttttttgggtgtaggccaacagtatttattaagtggtgataaatcagtctttatcattggaatatttaatccttttgtatacagaaacatacaatatcctgaaggtagctgggcttaagactgctgtcttgctcttttttttctctttactgcatgtcttttttaaaaattcctcctttcttgccttcttttgagtttaacaaatatttattatttttatccttttataactttttaaatttgtatttctttattctcttaatggttattatagagatcacaatatgcatttttaatttttactgtctaaattgtaacttttactacttcattgaacaatataagaaacttaggatagtttcactccattaccctcttccctttttttatgctattttaccaacaaatagcttactcttaccaatattttcacaatccccaggacaactactgctatataataatacttacttataatttctcacacattttatcctttctggtgctcttgtttttttctccagtttcatgtgtttatctagaatctttttgctttagccttagtatagcttttgttgattattacaggtgatgaatttttgcagctttcatttgtctgcagacatcttcatttttgaagaatattttcacaaggtcttgaattgtacattgttgccaattaacattttaaaaatgaaaatgtctaagccatcgttaagttcatgactgagccctcattaacttcataacattacacgttgtgtctaagtggtatggaaagtgtagtggaacaaatataatatgagaaataactaaggttgtgggtgctgctgttggccctactcatatcctcttcacctggcccttttacctgcctcctggctgctgtgttccaactcatagctgctctagtccctgggaaattgccttcaacaaataggagccattggtattatttcttatctattgcaatctaacaaatcattccaaaacgtagtggcttaaaccaaccataagcatttattatcctattttctgttaggaatttgggagctaattagttgcggggttcatgctcagggtcattagagagactgctgtcaagaaggcagctagggctgtggtcatctgaaagctcaagtggggctggagtatcatctcccaagattgcttgctcacatggctgttggtgggaggcctccgtttgttgtcacagtgacctctccataggactgcttgagtgtcttcacattgcggctaacttccctcagaacaagaaatctaagagagagcaaggcagaggctgccgtcttatatgagctggactcagaaatcacatactattgtttttgcaatattccataggttacacaggtcatccctcttcattgtagaaggggactatgcaaaggcatgagggatgaaactgtggggagttatcatggagactggctctcatccatctcatccacctgtggaaagggattagactgccacctacctcaggctcttggcagcaacttacaggcaatgactgactgacacagggatagaagaggcttgccccttgcttcaaggtgtgggaccaaacctggtgaaatgcatgcttcagtgcttcttgtggtatctggctgaagctgagcccacatccccacttagcttcttccgccacacctgcccttgcttccctttctcgcttttacctaaaagcactccctgatgagttgcctgcatactgattactgtcttaggcactgcttctagggaatctgacctagagatgcctgaatttttaaaggtacctaaaataaatgcagaatgagagtaagtgaaggcaggattacagtatcctctccttaggatagagaaatctcttaatattcccaagttcctaaccatttttttctccctgtttttctatattcatttcacagaggtcccttctgttaaatacattgctttttccttgttttgcttctaacatttgaagaaggaaaatttccttattcctggataagagttgtgctaagctcctttgtggacattgtgagtcttcttttagcttggagagaggggagctaaaccatagagttggattcttttattttggagacgtaattgtcctgattcaatttccccaatccatttctgtttatatagcatgctaataatgtgcacatcaaagaccctgagtgattgatacataccagttacggaggtctccaaagttgagcaaagtaaggaagagctactgctcctttaaacagccagcaaagcatcacaattttccctttttgagcagagaccaaatcaacacagctgtaaaggacattgcgctcatatagttgtctaaagcaggccaggcagagtgatttccctgtggcagttcctgctctctgcttgatttcttgaagttagctggtaagaataagctattagcaagcttaaatcggtgataattagctgtacattattatttcaaagtggtgtggctgtgccaattaagtaggtaattaggaaaaccccaggacaataaattaagatggagtctcaacaccagtgccccatctgttctccagcaagcattccaattagccaggcctctcatttcagaatgcatgattaaggggattggctgcatgcatgagtgtgtatttgcataatagggagtgtcctaggtgcttagtaaaaataagatatttttactatcagacaggattttgatgtcaaggtggggaatgcagaatttttagaaatattggatttttttgaaacaaaatataaattttgagtttttttcaattttgtcttcagaacttaattgaaatattatatcattagacatttccagttcattctaatgcatttattaaatcgtgatttgagtgagaattttatcacttggaacattaacagttttatttattaagaacagaaagcaaagaggacacttgaaattgcagtttaatgaaagaaatgaggcagggcatgattctcattcagaatgtcactgtcaactaaagtaaattaatatcctgtacattacagaaaaacacagggaagtgttcaaaataattaaacgtgggaaaaaattttaaatgtttattcagtgaagaacacttaatgttatttaagattattgctaaggtagatagattcatattaaatggcatcagttagtttaaaatgcatagagtttataataaaaaaacatagagcttatagttacatagtcaaatcttatctaatacaacactttattaatgaatccaaagttaaatttaaaaattcttgatattacacactgagtatatatgtttgtttagatggtaaatcagtattgagatatactggacttaatgatgaattgtatatacaaatattcagtggatgaaaatattcataggtctgaaaaaatagtcgattctttcagaaaaatttaatatcatttatagtagcagagaaagcagtttacaatctatttcctcgtaagtgaaagttagtgcgtctttgaggtgccatcattatttattacctgtaaacttaacttgtgaaaataaaggtcatgttttcaatgaaaaaaaatctgcttaatgtaaaacagtgcttgttaggtggtggtactgagggcttccagagcagggcaggccaagacaaagctttggataggaggccagagcaggtatggagggaacatgagctcatgagctacaaggcaggccagagtcaagacctacatgaataatgaagatcaggacctgcagggggtcaaactacaggcgcacaggaaaagcaaatgccagaaggcagagcaaacatatggcaaaagttcaggctagtggttcttaacctttggggatcatgtatcccactgagaatcccatgaatgttcccagaaaaagaaagttcacagacaaatccatgcagaattttgttgcattgaaaagtactttgctccacctaaaactaatattaaaaacagaaaatgttttaaaaatgctcttactttctagatgttcatgaaaaaattaatggccatttcatgaatcatcttaaatgaaatccacatagtagaaaattatattatgcacactagtcctgaaagaagaggcaggttcaactatttggcacgaactagaagttgacattgcagttggtcttggatgtggctacgtgcccatatgtttggtattcaacagatgcccactttttgttttgagggtaacaattactggaaattatagaaaacgtatgcaactatcatatccagtggctgcaattggaactcccctagtttgctttcttagatgaggataggcttaattcggggagcatgacatttattcaaactcttcaggctccattggtgtttcataatgcttacatccttaagttgcattatgatatttgctgtcaaccttaggttagtgtgtgtggaaataaatctctccacatttctaactacagaaagaataataagtataattttatagccatagacatggctagaaattggacagttttcaaactggtcatccaaaaaccttctgtttctatgtaggcgctttgccgaagagctagaagcttttagtaatgtatgtaattattaccgtgggcctatctcacttatatggctgaaaacatcttttccaccaagaaaaccaaactgtgaataaattatccttatctaatatatctaagagtatgttttctttttgcttttctcccaacaagtgaatcttctaccccttttcctttggaaagtcagtaaaggtctacagagttggaaagaacctcaagttcagctcctgttgttacaattttttttactgaacttctagaagaggtgaagaggattcaagttcaaattacgatgaaattgatgattttataggagtgtataaaattatttcagaatttttggcagaatctgtgggggcataatttaagataattgaagtttgtctcttacaaattaattgcatttagaaacaggatgggtccttcatctatagcatctatagcaagagtatcaagcattatcttctactttgtttttcatggtaaagaaccttttcaacatttaaaatctatcaacggcatttaaaatgtagaaaggatacatatgtataataggggaaaatgggaagcaggaagcaccaaggaatactcatatttgtatccaatggcatggaatggaaatgccaaagctgccagatccaccacaattgtcttcgaactagtagaaaaaattgtgtctctagagtaggttacacatgtgatagagagacacttcctttccctttttcatcttcagtccaaaacacaaatcagattaaccatttccagggcacacagctccaccatgatctgtagaatcatgtgtagcttcttttgcttggtgcagcaaatgagaatatgaaggaagtttcaaggtatctctttttgtttttgtttaggctcatatttgtagagctctcaacttttaaattaagcttccttctcagaaatgtgattcattctggtttgatgacttttgaagtcaaggagtctgaggctctctttttgatctactggtttcaccctctttcagcaagattcttgttatataaggaacactaactttgggatcttgtaaactgagtaaaaccaaaggatttatagtcttcaatgtattgggtttgtctacattttccaatttaagttaggccttatataaacaaacacatatatggattaacataatggaaggatgcataaccttaatccttatcacataaacatattttggatggcataattaagtaaaggtaactatacattaattattcctggtcagtaatattctaggccacccatcagaaaaactgggaataaaaggatacctaggtgacatgtaacattccacagcaatatttttcaaaatgaaaattaccagagtaataggaataaaattgaagactaaaatagcttattttatctgagcattgctatttatagatttcctagtgctaatgcctatctttataacagagttcagggacacatgtatttggaatgaaagatatggaggatctgaaaatgcaagcatgaacaatttgtactaagtatataccagccattagtcagataaatttgtgggtggaggtaaacaggaatatctgattgtaattgcaaaatgcaaaagataaaagaaggaagaataaagaaggcttttcattggcagattattaaagggcaagtattttattaaagttctgctaatgctgagagaggttaataatatctagattatatgcttgttccgtaagtcacaaagtttattgttaaaatgttagcagccacagaaaatatcttattgccaaagaggggaatattcaagatttgacctaaaatactgaatctcaaacaggtactcaataatgattgtgtgaagagcatgtattaatatcattagatttgaaaatggaaaattagtaccatgtttctttaaactagtagactgaacaattaattgcatattttaattaaagtgaccaaaaaattataagaggtagacactgtatcacatctcttttgtgatagatgaccaatttccctagtattatctgactggttttaaatcttgaacacttggtcgagtgtttattttcattaatgggttgaagtccttgtttaaagtcctttttaatggagaacagaggtagtgtttttttaaggcacatttttacaacaggggaaaacgatgttagaactaattttgaaaacccagttttgataacaggtttaaatcactctttgtagaggaggatgctttcagaaagggtgtttttttatggggacattaagtggtaatgtgttgggtttggaaggtctttgaaaagtgaggaatagaggcatctatcctaattgcatagatggctatgaatttccagctcaaggctagaatcaaattacaagagagtgctaaacatgaaacacctgtttgaaaagaactttctgcaaagggtctctaaggagcccactctctgagctcctttccatctctttcctattactttccctgttgctccccaacctaccaaccctttagttttgttttgaaatcacagtaaatcctctaataaaggggaatcatgtcatgtgagggagatgacttcctatgtggaggggaaaacctggaatgacttaggggaaaaaaaaatctgtctctttgagaaaggtgcctatctttacgtcacagtttctgtaatgagcaatgagttcaggtggggttcagagagcagacttaacaacttgctcttttggaaaaaaaattttttttcttttgaatcaaatatgaatgtcatgtgcttgaaacacattttcatttatgataaacgtgccatatattgcattgcttctcagtgatgtgttcaccctctcttcccagaatgggccaagaaacgagacttccattctccatccgactatacaagtttaattactttcaagcatttgcaatgagagtggtgtttgctctttctattctattagaatgaaaatctaatttttgtattctaaagacttctctaaatattttgtcaaatagaatgacaggtgagaataacgttaaatgattaaatatagattcagaacagcaagagaaaagagttcttatctagaaacctgtaattatatatttcctctgctgagcaggagactgacattttaaacgtctactgtttgacagctgtggtcagacatctctacagggttgagcctgctcattagtgccacattaaccttcacgttgcctcaggccattaactagcaaactgcacatttgacctttgttctacagatattttcaaacagtgtgctaggcattgcttttaatttgggttctgtattatgtgtggactgactttaggggtaaaaaaaaatcaatatatgtcattaagtagagaaacaagcagtctgagacatttcagaaagaaaatctccatttgaaaataagatccttcttggatacttttctagataattagctttggtcaaaattagaaatagtctcttctgtgttgtattcaatggaaaaaaagaggggtgcaatatatgacaatttataaatgtttaaaatgaaacaagttcctgtgagatgaggacataggattgagaggtatgcctttcgaacatagttttgtttctagcaaggtctaattaaatgaagtgcaaggtcaaatgtagattagagccataggccttaaggcaaacagcttcctaaaagatgaacaaagtttgaaactatatgtcagccttataaattaaaatataaatttacttaatgaaatattttcatagactatgctaatgttgctatatccagtttatggaatattatacagctaattaaaaataagactctatttattaacctgaaagggcttcatcatatactgtcatgtgagaaagatcccatttcatatatgtgtatagcttggtacagattttgtgaaaccaaaccatctctatatccttctctatctttctatgttggtctgtctgtttgtctgtctttagctgcttgttagtttgcacatagcaaaagctgaagaataagataaacaccaatctgttatattggttacttcaggtgggagggatggaaagactatggaaggacagaaattaactggttagtcatgcacctttttattattttacaccttactaaaagatatattacttttataattaaacatgattaaagtcaattataacagtatagccagttggaagtgttactcaatttaacagtagtaactggcattcctttgtcaacagattcagaaacaactacttcagggtgggttgcattcccctttatatatattttgtaccacgtgatgtatcaggagacctttctggcactgttggcctcaagggcatgggaagcaatgaagcaataactatgctagtccatgtttctcccctgccttcagtaagctcagggcaaacaaggctgcaggctatgaatgagcaattgtgctacagcctttttctactttactctgttgcacagtgtacaaagctgggcattagccagtgattagaatttaccccactgcctgcttcctgctccagacattttagactggtcaaaacgtgtagataactcctgtctgaacatattgcattctcattgtagctttttgtcattgtagcgatgtatctggtttttttttttctaatctaacaatctactaatgagtgtgtttttagaatgtgataatttccataaatgtttggaaacaggtggaaatactcttctatctaaagatttattcaactttgattaatcaaatatccactggcagccagttattgctaagcaatgagattttcagttaattaattaaacaagatgttgaagtctgtatcaactaaatgcctaactaactgataatttagtgacttctcatgagtctttttatttctctcatttccacttttgttatttataagagggttggactaagtcactggttctcaaacatggttgcacattaggatccttcaggaagcttgcagaaaacccaaatgctcagttctcatcccggaccaataaatctgattgtttgagggagaactccaggtgtacagtttaaaatgtttccttggtgatgacaatgtatagataggacaggagctgtttgaacagatgatctctaaggctctttctatctctgtcttcataacgcagcatatctgtgatgtattaattatgatagctatcttacacagcagtgcaactaaatattaatgtgtcactacatattaattttaacattacatataaataggagctgtcttgagcctctttagtagagtctggctcagttgttgtcctaccttagagattccttctattttttaatgcaacacaccagaaaggtctctctgatattttgccagaatctaggaataggtcccctaatttaaagtttcccaagccacctgtgcacttaaagaactttaaattatcactatcattgtgtaacacatattccttgtaggagcttctaattctagaagttgttaaaaactagtctggggctaattcaaaaagaatttgttaagtgcctgttgggtaccaagctgtggtccaaatcctggagacatgaggaagacttggcttttgtctttaggaagcacattcattaattgggaaggtagattggcatacagggggattataatactagagagcaagggctataatacaaccataggcaggggctagatgagaaatgaggatgaaccagttgctataccagttgattagggaaggagttggagaggatgtgaggtttaagcaggatcttgaaggatgggtagaaagttgagagtaaagtaggaggagaagacaattctgggtggaggaaactggatgttctaagcctggaatcttgttcagtaaatattgagttgttttatgcaatgcgtgtataggtgtgtgggctttggctggtgtgtgtgaatagagagaagggggactgtcatggaatgaggtttaggggaaagagtcgagcgctcttacgccatggcaagacattttattgtttcttatttttttaattttttatagatatagtgggcaaaagtgcagttgtattacatggatatgttgtgtagtagtgaagtctgggcttttagtgtaaccatcatccaaatagtgtacattgtacccattttgcatacctcaccccacttccacctcccaccttcctgagtctccagtgtctattattccactctctaagtccatgagtacccattgtttagctcccacttataagtgagaacatgtgatatttgactttgtttctgattaatttcacttaacataatgtcctccacttccatcaatgttgctgtaaaagacatgatttgattcatttttatggctgagtagtattccattgtgtataatatagaccacattttatccagtctcctattgatggacaattaggttgattccatgtctttgtttctgtgaatagtgctgcgataaacatacgactacaggtatcttttgatataatgatttattttcctttgggtaaataccaaatagtggaattgctgggatagtggaatttccaaataccaagtgggatttcctttgggaaatacccaatagtgggattgctggatcaaatggtagttctatttttagttctttcagaaatctccataccattttccatagaagttgatttatatttctaccaacagtgtataagtgttcccttttctccacatctttgcctgcatctgttattttttgactttttaataaagacattttatataaatgggttagtattttaaaagtagggaagtggtattttttggagacagagtctcgctgctctatagcccaggctggagtgcagtggcacagtctcagctcactacaacctctgcctcctgggttcaagcaattctcctcctcagcctcccaagtagctgggatcacaggcatgcaccaccaagcccggctaatttttgtatttttagtagaaacggggtttagccatgttggccaggctgatctcaaactcctgacctcaattgattccgtctgcctcggtctcccaaagtgctgggattgcaggcgtgacccaccatgcctggcctgtatggctcatttctaatgttgattctgcattcaacttggaaaatggaggcacagggaacaaatgctacactgttacaagcccagatgacaaattatccatttttattggtccagacatagaggctttgaataaatattcagatgagcaacatttttctattttcttttaaatatggtcaaactgttactcttaataattatatttcatttctgtgtactagagatagatgaagcacaagatgagcaactgacatatgaaacacagtccctgaaggataattagatgggactggactgttaacatctccctgcatttattatgatcctaattttaacggcaaatattctcataacagtagagaaataattgcatggatgcagtcactctcccagcaacttaaatttagaatctttctaagaatataatattttgttcattgaaatatttcacgtaaaactggaaaagtagtcgtgtgctagcttgagcattgagctggcaactgagatttgaattctgataatagggccaacattaatttgctctgtggtagtaggtaagtcctttttttttttttttttttttttgagatggagtttcgctcttgctgcccaggctggagtgcaatggcgccatcttggctcaccacaacctctgcctcccggcctcagcctcccgagtagctgggattacaggcctgcgccaccatgcccggctaattttgtattttttgtaaagacggggtttctccatgttggtcaggctggtctcaaactcctgacctcaggtgattcgcccacattggcctcccaaagtgctgggattacaggtgtgagccattgcgcctggccggtaagtctttttgaccagttcactatgcctactagtgtttcaatcccctcctttaccaccatctcaattatttttgtttaatatacctaccgtagatccctggttctactatttatcagtgcaactgcattttgcaacacttctcatgattcctgccacctaaaccctgccaaacacagaatatagtgttccaaagtaggatctccccccaaatttctgtctttacaaaccaaaacccatcttaataataacacagactttcttcccttattttagcctcagaaaattcaaagctaaccactgttttcagtagcctttccttctctcttttgcagaatttctgattaatgaattattagttttcttttcctatcattgtagcaaccgtgagagactaagttatgatgtgatagcaaactaccccaacataccattggttgagaacaataacattgtgtttctgtttagaacctgtgccatttcagatcagcagccattactgcttaacttgcctgggctttaggactcagaatgacagggcagccttcctctgaaacattgccagtcatcgtgctagagggaaacagaagctggcaaaacctcattagttcttaaagcttcagcctagaaggagcatacataaattctgcctacattttttcaaaccccaaacaagtccgatgaccaaagccaacttccaagcgcctgtgtgcccagaaggtagatagactctccagaaacaagctcattaccacaaaaccttatctccttctttttatacccaaatattttcaactgtcttccacattgaaacgagcatacataagaacaaatctttaatttttcttttttggaatctctacttatggtttcccatgctctttctaatgctcactgtacagcaaatgtgaagttcattactttacttcaagtgttttaattcctatatgggtttgctagggctgtcataacaaaataccacagactgggtggcttaaacaacacaaatgaatttcctcaatagttctggggttgaaaggttcaagataaaggtgttggcaggtttggtttctgcagaggcttctctccttggcttgcagatggctgccttcacccggtgttttcatgcggccttttctctgtgcctgtgtgtccctggtatctcttcgtcttcttataaggacaccagtcatattggattagcatctacccatatgaactcatttaattctaattatttttttaatttttaaaattttatgtgtgggtatgtatgtatgtatgtatgtatatatgtatgtatgtatagacagggtctcactatgttgtccaggctggtctccaacttctaggctgaagcaatcctccagcctcagcctctcaaagtgctgggattataggcgtgagccaccacgcctggcccctgattatttctttaaaggccctgtctccaaacacagttaggatttcaacatatgaatttttttgtggtggtggcaggaggtgatacaatttagtacataataattatggtcaccacatatgaaggacactttcagtattttatttaacctctcaggatggcattttgtactgtgaagaatctaccttcaaattcactcattctttagttttcatagtgctttaactttgaagttttcttccttcgttcttttcactttcagctctttttggctttttattactgcatattactttcctgaaagattttctccatgtccattatttcagtcactacctgtatgggtggtgggtctcacgtcacatgtccagtccactaagttccaaggttacatctttaacagcaaacttccaggatgtgcacagttcttgaaccagtagcatcaacatcacatgagtgctgctttgaaatgtgcagtcttgagccctgccctggaactactgaatctgaatctgcattttggtaaaatcctcagatgagatttacacctagtaaatttgaaagtagcattctgtttgatttctctatctagacattccaaagaaatctcaaactgaacatgttgagaatgaaaccattaattccttagtcttcactcatgtattaatttgatgactatttattggggctactgtgtgtaaagccactgctctatgatttatggctgtgaacaaaacaagcaaacaacaaaatgtctgcctgcctgaatattttattctggaccgtagagacagttaagaaacaataaggcctgattaatccgtatattacataagtggctagaaagtgatgtgtgccttggaaagatgaaaatatcaagcgagataaggatgatcataaatatagtgtaggacactgagaaggtgagatttcccttcctttatttcttatctcagggaatgacatgaccatcccctcacatgagcagggggaaaacacaattagaaattgtgtgtgttatcttaacactcttactttaacctgtcaattctggattcctaatgtctttcaaatctttcacttgtttttctgttcactgacaggctccttctcacatcctcagggtttctcctgctcaggttatagccacctaagtgacctcactgcttttctactcccaagttgctgccatgatgatgataacacctgcttgctggaaaacttaatggttccaactgccttttgaataaaacagaaacgtcttatgatgagcaataagactgatgataaaatggtttcttcttaccattttaccataattcattcccataagcacagtcccctctagtgaaactgcatactacccgtattttctttcctcttacccttactcatccaggctttttgtttggtttgcatggaacactgaaatactgccttgttttgtaaatatcttctgattcctctgtgcgctaaaatttggcactattagcactgtattatcattgtaggttttccccaaaatgtgtgttcttagaaggcaggtgctctcttgcttacctgtgaatccttagtgccaataaaaaacttagtactcagtagcatttattactttttgaccaataatttatagatgatggttcatagaatgactggaaatcttctaggttaaatcctttcagaataaatataggcaaaggtatgacggtgtgtttggaaaacagaacctcacttttgtgggaccctaaagtatggtttgggttgttgttcaaattgaagtgagaagataccttgcacatctttccaagaaacttagataaaatgctgtagagaagcctttgaaggactttaagtgagtaacataatctctggaatatcaaatttgaattttagaaagtgactgtcattgagaatgggaagagattggagggatgtaatcttagtgtagtacgtccagagaaagatgataaaggcttggactaaggcaatggcagtatagccgtgggaaagaggactggaaaagaaagacataaagctttctctatgaggatctattgattttgaagggagaaatgaaccttgtgctatccaccaagactgaattagggtccataaaaatatttacaattttacatcatcaatttaaaagtctcaacattccatcaatttgggcctggtcttcattcctagaagactctgattccgaacaagtgatcatttattgtgaataaaatttaggacaggagtcacacatcctgccattcattaaatcccacctttctaaaaaagaattagtctgcttcctcaattatgttttaatagctgcaacatataaattgatatttgttcatgcattacaattagtaaagacatagctgtctttgaggcacttattttctggcagaggaaacggacttaaagtagtaaatatgtaatataattactgtgctatcaagagaataaagcctttgttgtaatcaatctaagttacagttaagtcagaattgtgcttcttgcaaccactttatcacttatctggtccatctttgctaaaaactcgtttaaataccaaatacttatactaaaaacttctgattttctctgagttttgatgttacatatttgaaagtaatatttatcttttttacaaatcaactccagcaatattcacaaatagttatttaaaaaccgataggtttgtgtccagcctgggcagcatagcaagatatcatctctaaaacaaacaaacaaaaaataataggagagagaactaaaaattaatgaacttgagtaacagagctgacaaaatgagatttcatttttaaaaaattagttactccaggcataatttagaatcacctgtcttctttgatctcatttttaaacacattatatttttagtcttaatgagggtgacatttcataattgctacattttaactgcatattccatgaatttctaaagtttactttccttccaacatttccttcttctgccccttccttctggtctagagagcatctcctatgatcagcctagggcttttcatttctttttccaaaacaattgtttatgtcaaaaaaaatcataatgaaggcctttaggacttggccttgaaatgttaaaactcaagttcttggtcctccaaagccttggttttaaaactgaaaagtttttggtttctaaattaaaacaaaacaaaaaacctgcttgttgttgaatttttcctctgataattgatatggggaaggaaagtattgtgggaggaaaaaatcttagttaatatactaaatattattccttccaataacttttattttcatgcttctgaaatatcttacatgtctgggttttgggtcatatttagtaaagacattactttatgttcttagataccaagaagacccagataggaaaataacctactacacttttcatcagtaagcaatcacttggcatgttgtaagtctctgacattttccacagggaaaagaaaattattagtactctcgtggtggcttagatgatagcaggtagtgaggacttttagggaggctaaatgaagtgatgtcgttctttatgcatcagtatatactattcccaacttcttgcatgtgaagttacacaagattcatacccagtgaacctttttattccaagaataaactaaaatactagctttttttttgaaaaaaaaaaaaaagtaatgtattttcatcttggtggttagaaaagtatttaaaatatatgagaacaaatagagaaaatgtaaaaaattatattctaaacattatgcataacaatataaaaattatatcctaaacattatgtataacaatacatatcatttttgatggcctttattgtggatgtttggttttaattgttttctttcttctttcatttagagaatttatcaacagccttcgactgtacaggtcattctatggaggtctagctgatcagctttgtgctaatgaattagctgctgcagatggacttccctgctggaatggagaagatatagtaaaaaggtattttatgtggtctgtgaaaacctactagttacatcatccttgctttctttttctgaatcttaaggggattaattcagtcttaactttgtcacacagtttacagtctacattaaatacttatctttagtttgtcaaaaaacaaggaaaagaacaacaaaacctgatccttttaggtatcttaaaactataatagcattctgtggtattttgaaagtcttctcttttacctatctatgacttaccaacaatcctacttttgaattaaacaccgtttattttttatccagtctgtctgttgtttaccaaatattgtatttctttttagtttaaattcatgagtattagaaagtgaggaaattcagtgaaatgtgaatacctattcaaagattcattggtatatggatatgtgtcctaacaatgttaatgtgtccatcctacaatggtctgatagaaagagagcatgcaagaaagagagagagagagattgagaaagagagagagagactatgtaatagtgggggcacttttatatatatatatatatctgtttgaggcattgttcattgatatgttgtcaattattctcaaacttagaagtgaaattccatgtttactttttttcctgcctatctagaatttctttgacagtttcttttcctttatttcctataactgattgtactttcaagcaatctcctgagcttgagaaagtcataaattctccctctgtggtcaattaaactggttggggaaaagtctcttgatttgccaatactggtggttattatagaatgtaggataatgaggttttgtgtttggatctgaatctgttaaactataaaataaatatattttttatttgtacattttacattttggatttgaatccattaaaaagtatactttggatctgaatgtgttaaaatatatttttgagcagtctccaaaatgaaagatagggtgttaagctttctgacagatatggtttggctgtgtccccacccaagtctcatctcgaattgtggttcccgtaatccccaggtgacctgggagggacctggtaggagatcatttaatcatggggatggtttccccgatcctgttcttgggatagtgagttaattctcccgagatctgatggttttatacggggcttcccctttgctgtgcacatatacttctctttgctgctgccatgtgaagaaggacgtatttgcttccccttatgccatgattaaaagtttcctgaggcctctctagccatgctgaactatgagtcaattaaacttctttcctttataaatcacccagtcttgggtatttcttcatagcactatgaaaatggactaatacaatgaattacaagtaaacctcctctatatgcagataggtggtttagttaccacaaaagtgatgagttcatttaaaacattatttagcaaattaactttgctatgataaacatatactataatcaattttaatagaaatttatataactaagccacttatatatttctgagtgatcattttcattatagttaaaagctacattcctgaaatattaaattattattttactaatatcctgaatatctgaatatctcatagagacttagacttcacagaaaaaaaaattgaagacaaaaactgtatttaaatttaaataaaataattggctgatatgactagtgctcttttttcattatgcaccctggatgttgcaatgtaacaattttgcaaatatttctttattgcttttactgagagaagtgatagcattctcatactttgagttcttagtgtattcatgtcaacatttctgcttcttagatctagtaattaaattctagtttgacatagtattttttcaaactgttcaaactggaattgaactttttgtatatttttacaaagactaatgagaaacccagagtgattaataaaaatttattatatcatataaatatgtttaatatactacattacattatgttgaattatattatctgaatctacagctgcaagaaccttaatctgaatttatcccattcctctcttgaccagttggtctggggtttgtgtaatgggaaatactgttggagaaatcaatgatttggggaaaccttttagagtgatagtattttcagctcaatgaatatattttattctacataatatatttttaaagacctcattcgtggtttatgaatttgaaaaagcacagagttagcaaggactctccatgaaaaccgtccacatttctgattagcgaagtgtgtgattcttagtattcccatttgcttccagctaatgccttccctttcctgtaccaccacagactcctgtctattagctacttccaagtgcatagagactccagtctttcgtgaacaagcttcactgtgtctttaactatcttcaaacaattcttccaacctcatcaccttaatggacattttccctttcttgagcacatctttctcttccatttctgtctcatgggtccccaacctactcctgtgccctttggttctcagtgccagcatatgagcctcacacactcctaccacctctaaggctactgccaaaatgagcatgtttcagccctgattattctgttgccatgaactgagggtttcagaagcattatttaattcccccaatacttcacttttaatgccccaagtaagttgattggactctatctcttttctatttgacgacgagaaaattctgtgtcttttgacttaaaaaattaacttaaaattttaattttagtcatgactcagtcaattctttattttttttcatttttaatttttatgtgtacatagcaggtgtatatggggtacatgtgatattttgatacaggcatgcaatgtgtaataatcacatcagggtaaatgaggtacccatcaactcaagcacttatcatttctttatgttataagcattccaattatacttttagttactttaaaatgtacaataaattattgttgactgtagtcatcctgttgtgctatctaatactagattttactcattctgtctaactatattttatacctattaattatccccattaccctcttcccactactctacccagcctctggtaaccatccttctactctccatctccatgaattcaattgttttaatttttagctcccacaaatgattgagaatatgtgaagtttatctttctgtgcctggcttatttcactcaacataatggcctccagttccatccccttgatgtaaatttagaatgagattttttttttctcaatgccaactcaatggtaaaatgtaagtatccatcaattctcgttgattgattatggtatcatgaaatgttacatagcagtcaaattgatacatatttatatctgctactgtggaatgatgtcaaataattaaacaaaattaactagaaacaggataggacatattttaccagcagatttcaaaaaaataaaatagatattaatattggttctgcatagagtatttctggaaagttacaagaaaattgttaatgtgcataaatttaggacaaagtactagggggcagggaggtcttttattttttaatttgtattgtacatacttattttaaatgaaaacaggtgttaaagtgatacaagaattatgggccattattgttttttatgttttataattctcaaaaaaaagtaaaaattaacgttgtaaaaagtgctatttatacatttaatttctactaattcagattttcctaggaattttgtgatatagttttgtcaaagagttaatacatatgcttcaatattgaactgctgaatttatctaggagagtttctatacaaagtcaagtcctgatcactgttacaatcttaaattaaccactttctccttgagaaaaaatgaagtatagcagtgatctgtggtgaaaagctctaagcaatcctcacatgtgagattcatttcagagacctgcagttagttgaagtaagtaatgccattcagttttgaggaaatggacaagtgaatgtatactacatttggggatgatagagtgttttcctgttttatgggaggttataatacccatcagcttcattctagaggagttaagccaaacacatcaataggtcaaattggtggccaagattaagtctattcttcattataagagtgaagcaattattttggcaagatttcttctcctgcaggcatttttaaagaggtgattgatatgattatttgtgtgcacagacattcttcaaagactaggagagccatacagactattttaatatcatgacagtcctgtaaaactgtgtgaaatcacctatgtgctgatcaaaagaggtggaattcctttgtgattgtagatgaaaatgtctcaaatatctgtagtgtaaaaagagtttgatttttgaaacaaaatctatttaactcaaatgatttcgaagactgtattcatatcatatactctactgcaacactgaggtcaacagttcaaacaatttctgatttaagaagaaaatattattgaaatccatgtagtctgtatctcttacagtctcttttatctccccttcctgtctcttcattacaaaacaacattgttctctgaaaggcatgttagtctttgttctcagttctctgtgattgcaaattgattgtttgatgattcgttcttttctttctgggcattgaagttcaggtgacagctccttaattaccagggcttccttttcccttttgattaacagataatcctgtaactgtccctcagtctccaggaattaacttccacagtggctcttaaaccagccagtatctgttaagtacctttttgaagaaaactctcaaaccatgtttttcctctgcttttataccaccgcaacaatcatcaacacggaacttctgtgaccaaaattgtggggttttttttcaccacacaccaggcatccaaaaccagatgagtgtcctccaattcaattccaacactatctacctggagatcccacaggctgggagctcagtccccaagactgccctgcctttctgagaccagttccaagtcccatcctccagaacttctgaccaactggcttcaagttggggtttctacaaccccctctttgggttcaatgaatctgatggagcagctcatggaattcagagaaacacttatgtttaccagttttttatcaaggatattacaaaggctacagatgaagagatgcctagggcaaggtatggggcaaggggtgatgagcttccgtgtcctctctgggcagctgccctctaggaacttctttgtgttcagctatccagaagctctttcaaccttgtcctcttgaatatttatggagacttcattatggagacaacattaattttgccattggccattggtgatcaacttgaccttcagcccctctcccctccctggaggttggtgggaggggctgaaagtcccaaccctctaatcatgcttctgtctttctgaagtgtcagtcaactttagcatacaaaaagcactttggagattccaaggattttagcaaatgccaagaaacagggaagaagaccaaatatatattttgcaatatcatagcaccctggtaaaattaatatgccacattatttctacttcatcttgattaagttaatgttcttgaatgcttctttcataatccagttttctcttttctagcttttatgataagctgacccttttcctcaactggttgtgtgtgagtttttaaaatcagataaaatagaaaactttataaatctctgagagtttgtactctaccaattctcacttttctttccacccaggcaatgacagttttcctgaccataattttgttaacctcattttttttttttcttttacccattatctagctggaaagccacttcaatttcaatctttcttttttcttcctgaccttacagcattcaattacatttttcctatttaacatctgtcctagtttccaaaagttttgaacttcattttaaaaacgatcaggtctcaggattgtctgaatttctgaattttattaatgtaacaactggttgcttttcctatgtttcttgtgcaaaggcagtatgttctttatgacttaaacaccagtttgttttctatttcttttttttttttttcctggcaaattctacctatccaatcagtttctcatatcctttgtctataccttcctaataattatcattatcatacctatagcctatcatatttggttcagaattggaggttgctttaaaaaagtgtgatttgaagacttcttcctcacttcagcaatttaccatggagcttgaaatgcccacaattaactgaataattttcaattaaatcattttctccatgcaactgtatatgcagctttgccaaactctcacttttgtcttgaatcttaggggtatgaatcccctcatttgtgtttcattttaacccctaaatgcactgtgacacctataatacattttttttgcatttatatgtcacacatcttctttattcttctctattgcagtttcttttggaatagatctcctggattatctaagagtctaagaatgattaatatcattgaacatcaatgagtaattctttgaagataacaagactctgagggaatgacatttttataagcattagtgagaactaagagatttaggactttggacttggtgataacgctctgatgggtaatacgtgggtccaaagtgaagttgatgcctgaaaggaagattagatgaagggagatgaatcatacaagttacaatctatgctgactctggatgctgattttttctcccccccggacaactttaagaccatgtacatctcatggtacgcactttcatggacatttttgttaaatgggaatctaaagaaccccatgaatctgaaatgttttgggttagagacatgttgggtgggattgttcctatcaaaaagatgaggcactggaatgaggagtagatccacgtgcaaagacctgcccaaagtcaaaagtctgagtttgcagtcttcattaagggaagaactgaaacatttgtgctcatttgtgacaaaaataaaaattgcagtttcagatataagggactacagaattcatcacattgcagattacacattctaggttcaattagacaaatccaggtatggctgatggtttgaaatcaacagaaaataaatttgcaggattcttggctgtataatatccctatgccacagttgtactctccctgccttcctctattacactttcttggtaggtaatttttatttcattgatagtccctaagtagttatctcatggtttgggtctataacaaatatagtcaccccttggtatccatggggaattgtgtccaggacctctctcaggtaccagaactcaaggatgctcaagtcccagctataaaatggggtagtatttgcgtataaccgatgcacatcctcctgtttactttaaatcatctctagactaaatatagtacctaatacaatgtaaatgctgtgtaaatagttgttatactgttttttaaaacttggtgttgttttttatttttatatatttttttcttcaaatatttttgattcgtggttggtcgaatccttgaacacagttgaatccttgatctggaactggtggatccagagggccaactgtaatacaggagatgtttgcaaggacatgcacattttatcagcttggctccaagtcctgacattcctaactacggttaaagcttagggaaatattaatcattctcaggtcaatatacacattttggtcttttctaaaaatgctctatgaatgcggcaataattgcgtggtatatcatcttctgagctgagacaggtcttccgtatctctctttaatgacgtattggcttggtaatcagttgtctcttgttaagcgtgtgtaatcattacattcagaaagccagactcagaaaggtctgagtagaaacattaaatcctctaggaatgccatttttactttgtcaccagaataaaatcatggccagctgtcagaatttttttgctcactattagtgcctgaaggctctttcattatgggttagttccataaaccgtgtaaattcagtaatgaaaatgtccagtccaacctaataatcaaacgtgtgaaattctcttactcttcgtttttcccctcgtccagttaggttctgcttcagtctaagagtccctagtagggtgtgtatgtgaaccttttcaggttcgtgtgccaaccttgcactctcctcgtccttcaaacaatgtttctgactcccctgtgcttgtagttggcaggtttcgagctggggagatgatggatcaaaagtgagaaagaagaagtgagagaagaaatcattctttgtgactggtaattttatgatctctcattgatgttttctagcctggcaggtattaacagctgatgccctagtgcttttgtgtgcttaagacaatgtctctcccctctatttctccatgtgatggtaatgttttggcctctttctgctgagatcttttggtgggttccttttctcccatatcatctattctagcccatagaaaccttccctctcttttctacttttggtggaagtacagcctacacctaatgcagctgcctctctttactctgccactagacagccaacttctgctacaagaatgggctgccttccatttgcgtaggcataggccaactaccagcccttttagtccttccagctccaaggatccttcaacacttctctcacctaggaccaatgaatgagggaatgccgtagcagttcaatcagctttcttcaaacaagttccctgctttgttctcttcaacttcaatccttttattcaattaaggtggatgtcaaactgtgggactgaaaacaaggtttcagtcatctgcttttcatgtctagcacctcactgaaagtgaggggtgtatgccatctattgtcccttgttcttggctgaaatggaaacagaaagagtactattttagcacccttttccatgtacttggaagtggtgcagagaagacagaaaactagtttccaaattcaagatactgcaatagaccttgaatggaacgcaaagttatatgagatattttcccaatctttcagggacttggaatctcaaactggtagaaaacatgttcacaaaacacattcacagcaaaacaggttttgaaataaaagaagtgtacaatcccacagactttcaaataggggaaaattcttttttgattgagaggattcaacagtatttaatgaaagaggtaatatgtgatatgagttttcattcaattaaaataaattctttaaaatatggatgagatgagataatgactgagaatgctttaaaataattcagtgagtgggagaaagagggtcatattatatttgaagtgaagttttctgagtgagtaatcattgaagctgtttgatgggaacggagtgttatactatattttctgtatatttgtattcacttaaaattctgtaatacataaatacaaaaatatagtaacacaataaaaataactttgtcactgtctactctttcacaaacactgttctagatgctagggacacagtgatggacaaaatagacataagtccatctctcatgtagactaggatatagaagagaagaacacagaacaaatatttacaagtgggaatagtttacaaaatctttcaagttggatggaattttaatcagcagacttggaagcaagaaagcgagtgggagcaaatgcattcttgagtgaaatgctctgagttgagtggcctctacactgcattactttcatttgtgtacaaactttcagattatgttttctccttctcactattctctttcatttcagcttcatgggcatgtcgtgactatttagtattagaagccttctctcattcattataatgcaaccattcattcataaagccaataaggctcagtggttaggaacaggttcaggagccatgctactaaggttgtcaataaagattaaccacttaccagtgatgtgaattaagacatattcattaatctctaagtgcatcacttttcttaactttaaaatgtgggtaaggccgggcgcggtggctcatgcctgtaatcccagcgcttcgggaggctgaggtgggcagaacacgaggtcaggagttcgagaccagcctgaccaacatggtgaaaccctgtctctactaaaaatacaaaattaactgtgtgtggtggcacatgcctgtaatctcagctacttatgtggctgaggcaggaaaattgcttgaacccgggaggtggaggttgcagtgagccgagactgcaccactgcactccagcctgggtgacagagagagactttatctcaaaaaagaaaaaagtaggtgaaagtaatacctacctaatatttgaaaattaaatgagttattcacatgaacagtttagaatcctagatataacatagtcaataactgttaaatcatgttattgttaaataaaatatgctcatttacttcaatggaaatgaaactattgtattgacattttctcttcattggatgggttctgtcttggattagaagacttccatttgtaagacaaaggcatatgcattcttgagtgaaatgctctgagtttagtggcctctagtgaagtttcttttatgagttaataaaaattagtattagggatttgggtttgggaataggagatattcccatatcaatactttaaatggttattttgttggatctgaaaactgagaaattatgtcttaatgggcagttcatcagatactccaaactggagagtgatagtcacttgaacccatgcactatatcagtgttttcaagggagaactgaaagttaagatacaaagataaagcactatagagataaaagtaaaatgcttatttctaaccagtggtttgggaatgttcactcactggttagtcttagagctgatcttaatgaactatcagttgattggaaataaatttctgaagccaggctaaatttcagtgtatcacacaacagattgttttgggtgacacggcaatttcaacgctgctacaattctagtcatctccctttatccactgagttcccaaaggaaataggtattttaaacagaatccctaggaaaaaatgaggttaaacatccgcttttcccatgtgtctactcagtttcttgccatgctgacacagtatgaggatactatttttaacttgttacacgcgtccagaggttgaatagaggaagataaaaagataaaagatagcaagataaaagttcactgaagtggaaacctaaaggaccttttcccatctgtttggcacagaagttgttatctctttgggagtacagatttcatcacagttctatagacttgtgacttccagattgtgtaattgcaaaacagcagcagtcttcaaggctccaggatgcctgttcttactttagccagagcagtttcttattcatccttcgttttcatattgaggttacacctgaaaagctattcccttttcagttaaatggatgtaagtttgctaaactacaaaaatggaaaatattgtttattagtctagttccagtgtttccatatcatagcatataaattcactgttgaatgatttattatatattaaagtaaaatgctagaagggagattggaaaagaacaggcacctattcataatatatttttcttcaaatagactacagtgtagtctaattgaatttataagaatagctcatcagatagcacattttattgtccaaccatccaaatccttcttttctgatgtatttttcaacccaaacaaaggaaatttgttggatattattgaaaaaacttctacaaaatttgatttgaaattatttttacattaatgccacattttggcttacatgattaatattttttgtgtggctgcaattatgtataaaactgattaaagatcaaactctgaaagtagattgtctaaacacacacacaaaaataattcgcatgcattacttcttcaggaaaataaagaaataaaaatattttcttatttcagagtagtcatgaagaaatgaaatattcagaaaaatgaaaagtataattatatgtgtgaaatattgttcatttttggattattctagacagaatctagacctttttagttatattagatcattaaaccaacaacagtttagaataaatacggttaaattatttggtaccaaataaaaatatcatgtttataacaagcaatgtatatttaaatataacaagtattgctatttactaaaacatgtgtggtacattggtttggaattgagtcattgccatttaatatgaaatcatgcgtctcaaattagaatacagttctacagaggtaagtactcatgctctgtagggtagagagagccacagcataaacatcacacctgcagtcagagggcttactatgtgactgcatatagtagtgtattagtcattgctgtccagaaaacaaaaacaaaaccagtctttctctctctctttctctctctgaaagcaacttattttaaggaattggcttatgtgatcgtggggactggtaagtccaaaatctacagggaatgctactaggctggaaattctgcaaggaacctgccagaagttgcagtcttgagtccaaaggtggtctgaaggtagaattccatcctcttctggggaccttagtatctcctaaggctttcaattgattgaatgaggaccaccaacattatggaggctaagatgctttactccaagtctactggtttaagtattaataacatctaaaaaatacattcacagcaacgtgtagactgctacttgaccaaacccactgggtactacagcttagccaagttgccatataaaactaattatcacaggtagtattttaggtgaggaatgagatggcaagcctgtgctctcatgaagctaatgccatagaagttgggttaagggcatgttagattgagtatccaggaaaaccttctctggggaaatcacatttaggctgaatatgtggaaagatctgaattttccaagtagagagaatatcatgcttcatgtgtctaaggaacagaagggaaatcagcgtgtgtggctcagggtgatgcagatgatgctggaggattgtctggaatgagactgtagcttgggcaagtgtcaggtcaaataagcccgggaagaagcttggattttattctatgtgctttgagaagtcattggtggtttccacctgggatgggggtggggagaatctgttttcctctgtattcacactcaacacagaacaattctgtgaccagaagtgtgggagtttctcccacaccaagcaactgtccagttctctttgaacaccaactgtatgtcgtataattcaactgaattaccacactaacctgagttaccacagacctcacatgttaagggcttagtcccacaagatgccccccactttagatgccactcacaagtagtaggtccccagattatgcacaacttccatatgacttggctacacattggagattctcatgagtcccttcttgggttttatcatttgctagaatggctcacaggactcagagaaacactttacctgtgtttactcttttattataaaggatgcaattcatgaacagccaaagggaataaatacactgggcaagcaatggaagaaggaatgtggagcttgcaggtcctctctgggcatgccatcctcccagcattttcatatgttcagcaacctggaagctctcagaacaccctacttttgggatttatattcaggcttcatcatgtagacatgatcaatcaatcattgagtattaatccatcatcaactgattaactccattcccagcccctctcctctctggagaatggaaagtcaacctgaaaattccaagcttctaatcatggtttggtttttctggtgaccagcccccatccaagaggccatcagaaattatctcattagaaaaaaagatgctcctatcacccaggaaactccagaggatttaggaggaatgtgttagatgcttgctcctatcactcaggaaattacaaaggtcttagacactatgtgtcaggaaatggggtcaaggaccaaatattagacctgaaaattatcccagtcgccgctttaggagctctggttcaaagactggggagactgtgtgtttgtgtgtgtgtgtgtgtgtgtgtgtgtgtgtgtgtatgcatatgcatatttcttatttcacacaagcaaagatttatataatttgaatgctttatgaagggtaaatgtgaatataaagtttgagggaaaacaaacatcttatttcaaattggccaatttttgtgtggtatacatgagagggagaataaaaaagagaacaaaaccagaaacatacctgtaaaaaataaaaacttattattcatagtgaatgaaagtctgtcatgtttgtgttatctggaaaatataaatcttctttgcagagaaatgcataccataaagaaactacaaacacataaccacactgagaataaagcgtatacaacttttctcacaaaaggtcaccctgccactaaatgaatgaatacttcctcaaatgaattaggaaaatgccaaaaatctgatagaaaattaggcaaagtgcatgaatagataatttacagaacataacagtgacttttaaacaaagaaacaaaattctcaccctcaatgttaaaaatcaaataaatacaaatcaaataactattttttcacttatatttgcaaagatcattaaatttgataattcatagcattgaccagcaggtagagaaaaaggtatttcaacatcccaatagaggggaagctattcttgcgtctttgaagggtaactgggcaacatgtatcaatattgcaaatacacatgacctttgaatcatctatttcatccatgtaaacaaaagagcatgaattgcacatattttatgctagcacaaggtagaacaaccaaaatctccattaataaggaaataattaaatggttatggcagactaaaatgaagaatataattttgatttttataaagaaggagatagccttacagctagtgatatgaaaatgctacagaagaagagggttaaaggacatgtgtaggaggaaaagttgattgattatatttctatgtgcttccgtaatttttttaccaagtccttttagttgttttccgaaaaaggaaaaaattaaaaatataatgattcataaaaatgttataatagaatcatcatatatttttacaaaatacagaaagatatgatatcttacttcagaacaatagaaatgccagtgcatttcaaataaaatacaagcacacattgtcaaataaaataagagcaaataaaaatctgttcaatagttcttcaatgtcagttttataattatttgagaaatgaattgcataaagcagaaagaatatgggtagttactgcactgtcctaccagtggattggagattaaagagtggaagtggactgactaggactaaccgaacactgcttgccaacctttgtgagtggaaccgagcccaatctgattctcatagcacaccctggatcaggaggcagacaaggacaagaagagaacttcatctttggtggtgacaatttttcttccctatttattttattgtagttcctgtagttccgtatcagaacacagaagtttatcagtgaatgatttactgtattttaatgtaaaacatgtcataatcttagaaattcattgatactacagtatgtagagagcctaagagtggtacaataaaaaaaattaagttaatcccacatactgaaacggcatgtgatgacatttggaaattggctagaaatcgttactttgtatctgaaattctttatataaatccatacattcaggaatgttattgtcagtacataatcatacatttgggctcattttgagaagtttacatattggtttgccatatgtggttttgatataagaactctactcttcccttataatttttttatttcatctaattaatttgtcaagaatataggtatttccttcaatgtcacctaatttattagagaagaaggaagatatttaaaagaaataccaattacattatataagattaaggagaaatgcaatgcgacactcccgaaggagacaaggaaaaaacttttaagaacttatgcttactgatttcccaagcctcaagtgcagtggtctccaaagtgtggtccccaaattctcaggtccccaactcagacctctagtgaataagaaaccctgagagtagggtcccagattctatgttttaaggagctctccagatgattctgatgagcacataagtttggggaccactgcctttggccatcacaattacttttttgggtaattttttttctaagattttagactattaaaaaaatatggaagaacacatttgtattgcaaggaagtttggatttcatgatatgactaatcttactgtagaaatgatgtgagattcttgtttgactattttagagcagattcggtatctaatgggattccatcttgatgtacagagcaccttctacataatgaattttgcatttcagatggatgaagcctttaacacagacagaattttaagtattgcatatttctggaagaaaagcattgatcacatcctccttagatatttagtaacaccgatagaaattaattatttaagccacattcagatctgtaacattgctcaggaggtacagcgttttaaaaatcactgctctttcatacaaatatacataatacaatatagagagttttgcataataatggctatttttggatttttaaatactgatgataatagactgctgagtaactaaagtagacataaggcaagtatcagtcatatctgttcttagtctagcatctccagaaaaaaaatctagaaggaaaattcatggtttattaatgataatattatttcatttgaaagccataaattagaaataaatatcatctctaatgaaggttgaatttttatatacaattttgagtgcagatattttggttaaagatttctccatgttttgaatgtgatagtttcaatatgatctggttctacaatttaaaaatattatttgaccaaaagttcttgcctagtccagaccgatagatcaagctatttgtagaacgtaaaagcttgaggactaagcagctaattaggaatttattcatgcagacatgcaagtcagcttctctttgggactccatccaagtcaacacagaaagcctcaagatgcatacacaaacctgatccgttagtctatatattgacataatttatcattctttctcatatgtgtcttttgggagctattcaccaacaaattttattattatttttattatttacttatcttaaaaagttcttaatgctattcctgggaaaacacattgttgttctgggattcctaattagcaatttcctgttcattttacttgcaaatgcattgcttttctctctaaaagttttgtaacagccaggattacaaactgttcagcttcctgaagatttcaccaagtaaacaaatgtttaaattttaattcaaaataaactgaagagcaatttacaggaggtacagtgtagagagaaatcacacctgttcagaggattcttactaaaaaaatgtgaatatcaagactctgtctcttgcccgtcatgaagcagatgatttttaactgcatacaaatgagcacaaataacttgacatcttgaagagtgtaagctgcttcaaaagaaattccctactgaagaatttctatgtgattttagctttctctgttcatcattaacagatctttattgggtgcctactgtgtgtgaggctctgggctaccacattaaaaatacatagcagtaatttctgctgccttggagattatagcacctgtgatagcctgtgaaggatgggctggtgcagggcaggatgctacaggagtatattggagaagcagccggaaatcagtccgtaaggaattatagtggatattcccatctccactctccccttgacctacagcgcacccatccccctactgctggacatgatggtgacagtgccttcttaacagaattgccacctgacccaaagtccatgctctgctcctcacaccccctccctacaccctagtcatcaatcaatgactgaggttcagaagatgggcctactagcctgaagatgaaatcaactctgtgctgcaatttgtgtttcattgcttcctggtgggatcagaggagacttgactccagcccagaccgcctttttgcgtaacttttatctcctgctttatcttgcctccctcactcctctttactgagagcactacccccaataaatctcttgaccaagcatctacttctagggaacctaatttaacaatgtgattttcagagacttgcagggtaagtaggagctagctaggtgaaatgggtaagagaagagagagtatcccatacagagaaaacaccagcgcataggagagaaaggagttctagttaaagaacagaatgatatgaggatgggacagagtttaaagattgtcaggagatgggagcaaaggagtcatcatgagagatgagcggaagaggtttaaaaacatcataagcgaagttatatctacatttgtttaatgacaaaaagttatgaaaaatccagactcttacctgtgttttagtctatataatatttgtgatatttgtgataattgcagttgtattactcctctatttcttggactggtgtctccattttaccaccatttctactgcacttgggcctcatttttcccccctctgggtttttataacagattcctaacctatcgatctgctacctcccttgcaaactaattccccacgtagatgattgttattttaaaaatcaacaatgcaatttttttgtgtacaaatcccttcactgtgcattttatctgcacctctatatttctcttttttccactttccaacacatggaaacacatccaggcatacaaaatgccctttcatatctctatggtttggggcaggcatttcagttggagttttctcttcccagtctttcaaaatcaaaagtaaatgttacttctttataagacttgatcaactgatcatttctttctctggcatcccttacacttgatgtatgtcccgtgatagcatttatctaagacatactttaatcagttgtttagatgtctgtttcttttactagattactccatgagtgagtgtcccaggtttcatctaagtgagaatcagctatatctggctaagtgaaactgagagcttaggtggctagaactctacttatgggaagaatcatccatatgttagaaagagcaggcaccatgagcatcatgggtacaaaaggagtccaatttcaagtgcatcgttgtgtctgccactaaaatttctttcccatctttgtccccattgcatctggtcagtagaaatatgggaatgaggggtacttccacatgttgcctcagaccaccagaaagtttttggatgtctgggcattcatatatccatgacagcacctggaagatcatcaatgttggacccgagacagctgagatgatggtccctgggtgagaccacaattgtgggtgcagcagcactgtgggtgcagcagcttggtgcctccctcagtagaagcacacttctgagggacattctagggattctcagaaacaccccatttcaagggttctttagagacctgaggtctaggttttgcaggctgtgattataaaggtggaaattaagttaatgtggctttgtttgtttatacatccttataggttcagaatagacagcctatccatcaatattaggattatgtctagttaattagagtagagaacattactacttacttgaagactggccacagctaagtactttgtattatctcctcatagcaactctattaaagaggtgtcattattgtcgctatttccagaaataaaaaactaaagattggagacattatttcaggaactcacgatcctatcagcagcaactcgcagagcaaaaactggaaatctagtgctagagctcatattatttccattgttatgctctagggccagtccctaataaattacctgtgcctgtgatgagcaactgaatgaatgggcatgaaaatgactagtgtattttttcatccaagaaacagcacagtcactgtgtacactgtaagtatgaatatttttcaaatgtcagtggtatggctcacatgagtaataagacagtgttgaagtctaatttactgttcaaatttcaatccagtgcctgtcatcatgcaaccatcagaaaataattaaatctctctccataatccttcaaaagctcttttagctcctgccagcatacacctactttaaccttataatgtgtaaccgcccaataaaaatgcttttaaagcccttcctgctaacctttaaccctaacgactgtgcataatttattatcctataaacaatcaaatcctttcctttctcatgtttgagagatttcctttcttcctcctcccccaccaacattgcttcatttgctggataatattgaatacagacatgtttattatttgtcattttcatttaagaggtatgctccctgttcttatgtagcattcaatgaaagtggaatttgttatttagaacaaaattgttgcttatatccttttttcttgtattctttgttgatttctttcccttttttgaactagtaattgttgtatgaaaaagttagttatctgcttctgttcttagttatgctgttatgctttgacagtgttatctgaagcaaaatgtagttaactccttcatcttcttatatgggttggttagagctatttaatgtgaagtcacctgaacatgtaaatccatgctatgtggaaacgacagaagattataaaatagcagtgcccaattacagaactaattctgttgattcattacataaatatatagagatgagagtatgttccgtgaaggcgctgcaaagttgttaatagatttcttaaatttccgggctctatacaaaatttattgtattttaaattaaaaaatgtccttgatgtaaagatggaacttgattttgagtaagttcagaccttagataggaacctgaaaactcaatttttttttcatttaatccctgaacctacacttcttgctattttcttttcctcaacattctgagttttctttacctaaaaatacttcttaaaatcccattttcttcaaaacagtttcagaatatggtcagatgacttcctcttcatagtgacatcttgcagtggcatatgtttagctgtcgggagttcagaggatatgcttggcaccgcaatagactccctttcttgagcacctcagaaagtcaggtcatctctgcccctcacagcacttccggaagctcaccctcataaaacttgtctaagtgctcttcaaattctagggatggctaaaaggatcctttcaaatacacacctctttatagcacagtccacaaactcctataagtaaaattttcagagaggattttcagaattcttaaaagaagaaaatgtgcctcggctgtgaaaaaaacttaataggtggccaaatttagacttttgttctcttttcaacatcatgcaggacaaactagagcaaagtcttcaggagttcaggcagtgtttttattataaaagtttcagctgagtagccagttgaagggagtatacaagcaaaagtgaaaccgagtattcaaaccaaagattctggagttggtctccatcttcttcactttcagattcaatggttataagtttcgtgtcctgacaaataatttccagggcttttcctcctccttccatctccattctttctgtatgggactggaatctcatctgtctctgggctcctcgccacccatttagttctctgttccatcctggcataacttatacagtcgttgttcacaaatatcaatacagttattaaactactctgcttaaaattctcaggtggctccctgtgtccttccagatcaacttcaagcttctgtgcttgacttccaatgccctccaaggtctagcatctacctgtgtgtctccaaccttgacccttgtccattttcatttgctgtgtatactttattctcaatcatcacgtaactaattacagtcatgcgtcactaaataatgaagataattctaagaaatgcattgtaagatgattttgccattgtggaatattatagagtgtatctatgcaagcttagatgatacagcttcccacacacctagactatatgctcctaggctaagcctattgctactaggctacaaatctttgcagcatgtgactacgctgaatgctgtaggcaattgtaacataatgttaagtatttgtgtatctagacatagaaaaggcacagtagaaatacagcataaaagctaaaaaattgtattcctgtatagcatggagcttgcaggattggaagttgctctgggtgagtccagtgaatgtgaaggtctaggacattactgtacactactgtagatattataaatactgcacacttaggctatactaaatttataacaaattctttcttcaataatgagttaaaattagcccactatcacttttttaccttatacacttttacattttttaactttttgagtcttttgtaataacacttagcttaaaacacaaacacatggtggagctgtacaaaaatattttctctatattcttagtctatagacatttttcttttttctttttttttacttttgttttgaaacagggtctcatgttgttgcccaggctggagtgcagtggcgtggtcttggctcactgcaacctccgccaccctggctcaggtgatcctcccacctcagcctcctgagtagctgggataataggcacataccaccacaacgagctaatgtttgtattttttgtagaagcagagtttcgccatgttacccaggctggtctcaaactcctgggctcaagtggtctgcctggctcgacctcccaaagggctgggattacaggagtgaggcactgcacctagctgttttttactttaaaaaattgtaattaaaaacaaagacacaaacatacatattatcctaggcctacagggtcagaatgatcaatatcagtgtcttctgcctccacatcttgtcccatgggaaagtctgcagggaaagtcacatgcaagactctgtcatctcctatgataacaatgtctttttctggaatacctccttaaggaccggcctgaggtggttttatagttaacttaaaaaaaaataagtagaaggagtatactctaaaataaaggttaaatgtatagtttagtaaatacataaaccggtaacatagctgtttattatcagtatcatatactgtatataattgcatgtgttatatttctatctgtctggcagcacagtaggtttgtttataccagcatcacacaaacaccaaacatgtgagtaacattgcactatgatgttataaaggctacggtgtcactaggctataggaatttttcagctgtattgtaatcttacgggaccactgtctataagcagttccttgttgaccaaaacattgttatgcagtgaatgactttataattccttatatatatcatttgccttccagctccatgactttgagctttctccttctctttgtcaggaatgttctttaccctcttgtctatcttaaagatatcctatttctcatttagcacctaccttacaagaacatttctcaaagaattgccccagattcctcatgtattcattatcttgtatgttcttccagttttgaactttttattatatttttttaaaaatttctctccttccttcttcctcactctcccttcctttcttgctttcttttacgtttctcttacctctacccttctatgagctttaagcttcttgtttcagaaacaattatctgttattgtttccccaacagattgtttggaaacttgaagtcaatgcataatgtggagatttgttaaaatatcataattgctatttagggatgtttctagtaaagttcaactctggggttgaacaacagtaaatcagtcaaacatttcttttgtagtaaaatttttatttgaacacttgcatataatttcactgtttaattttatcctccaaatgtattatgtttataattcaactttgttcaaggtcaacgccacaagtagaatgagtgttggaaaaacataataacttcgtttttcttgatgaaagaaacatataagctttcttattcttagttcacatgtagccccccactccctataatctactattcccacatttaaagcaagaatcacatttttgaagttgcaagagaagagtataggaagaaaagcgaaggaaaagtgaagtatgggtaagtgggagagagcattctctattatttgaggctgtataaccttttctttttctctccagctgacttgctgtggcctacaagctgaggtgcttgtgcacaagtgcacaagcttaataaaggcagagtgaaggtttcattcccatagtcattgttgggatgactttgttgttcagcttgatctgccaccgcctcatataagaatgtatccttatcctgttgccattttgaagctgcattttcttggccaacactggcttccagtttgaaagaactgtgcttaaaaagttaactcaacaaaacacatgctatacttacgatagtgcgtatgctgtactgagaatagttgggtgctgttgcattttatagaaaagatgtactgatttacttcaatactcactaacaaatctaaccttttatttataaggtattcttcaggacagcatcaaacagatgtaataagtaaaagatcatatgtggatcatttcacttttgatccagtcaaatataaacaaaacttaagcatttttaccacggaacaagtaatagttaccatttgctttgtgtcttctatatgccaagcctaacaattggcacctttgcctaaattagttcattttgtcccttttaccaaccgcatgaaataggcatatcttcctcattttgtgtatgagaaaactgcagcactgataagtcgaatccacccgagtgcattcttaagtttaaagcatgtaggttaaaattaattctacctatttccaaagcttgtgacttttaatcttcgcaatctcacttcagtaatctactataaacaataaacttccactcttcctcacctctcctttcttcaaatgaaggttccatcaaagaaacaccttggaagctgaacatttaaaaatttattatactctgagctagtcctgaagaataagaacgagaccatcactactttaggtattttttttctcaaaacatattaaaatatgacttgttgaaggataatatattttagttaaacaattgccccttaattcacagactgtaattatatatatttttacctgctgaatgcattttgtttttagtctgatgttttagaattctttttgaaatgctgaagctctttcggctgtttctcaggcattccaagtctttctgtgtctttggttgccatccagtggcagcagccatatacttcagttgagtaacagaaaagagaaaccctctactttccaagctgtgttttctcattcaaaagtgaacggtaggtggattagtccattttcaccctgctttaaagaaatacccgagactggcccatttataaaagaaagaggtttaattgactcacagttctgcatggctgtggaggcctcaggaaacttacagtcatggtggaaggtgaaagggaagcaaggaccttcttcacatggcgccaggaaagagagagaagagcaggagagactgccccttagaaaaccatcagatcccatgagaactcactcactatcatgagaatagcatgggggaaccgcccccatgatccaatcacctcccaccaagtccctcccttgacacgtggggattacaattcgagatgagatttggatggggacacagagccaaaccaaatcaataggtattaattttgtgtacctaatttatgaaacttttagcctaaaattagttcagtattttcctttttaccaaccctatgaaataggtgtattttcctcattttatatgtgagaaaactgcaacacagataaataaaagaatcaactccagttcctataattattaagtttcagggttatgggttaaaattaattctgtttatttccaaaacagatgcctttcttaaggaaagcatcacacagataaaatcagtaaaagttaatatgtcttatgtttttctcattaagaaaaataaaagtttttttcctaacatttattctgtttgtggcattgattttgaaaaaaaaaacttgaattataaatatacaatttcggatcacctgaggtcaagagttcgagaccaccctggccaacatggtgaaaccccatctctactaaacataccaaaaattagccaaatgtagtggtggacacctgtaatcccagctactcagaaggctgagacaggagaattgcttgaacctgggaggcagaggttgcagtgagctgagatcgctccactgcactccagcctcggcagcaagagtgaaactccatctcaataaataaataaataaataaataaatacaatttgaagacaaaattgagagataaaaggaaattatatgcaattggtgaagtaaaacttttgtccccactgagtccaatgaagatacacatgtatttagaaactgacaaaagacagttttacctaaatttaaaaaatagtttttactttaattaatttatttattttgagatggagtctcactctgtcgctcaggctggagtgcagtggaacaacctcggctaactgcaacctccttctcctgggttcaagtgattcttatgcctcagcctcctgagtaactgggattataggcacatgccaccatgcccggctaatttttgtacatatttttttttagtagagatggggtttcaccatgttggccaggctagtctcgaactcctgatctcaagcgatctgcccgccctggcctcccaaagtgctgggattatagttatgagccactgtgcccagctatttttttaatcagaaaatacataaccaacattttccccttcagaaaatcattgaagtatttgtgttaaaagttctactaaagtcaataattagcatgtctctatatcagtgattaatgccatcaaatcaaatgctagctttctcacatttttctcaaatatggtttcttaccaatgagagacggttagtataaaggtcccaaaagataatttataatcataaaatgtatttagataacatcttcccagatggacaagttgtagtctatagtgtggatataatttttaggaagtactttaaaacagagatatattagaaactatgagacatattaaatcagagacagattagacactctgtgaacagaggtgaggaacatgtactgccataaaagaaaatggggtttatttaagccactaaaagtaaggatataaaatggacaatcctgatagttaaaaagtgtcatgttcatctattcaaaatgtagtataattttatttgagattgtctttttttaagttttaagatgaaaaaaatttgtatcaaaagaattatttgaaaaatattcttcatctgagtaaaaagtcctgggtctctgggtagataataatttcatttcaggtgatttaacaagttgcaaattggagaatgggatgaataaagcagggaaaagtcatcccacttaaaattacctatttgaggccgggcgcagtggctcacacctgtaatcccagcacttcgggaggccaaggtgggcagatcacctgaggtcggaagttggagaccagcctgaccaagatggaaaaacctggtctctactaaaaatacaaaattagccaggcatggtggcacatgcctgtaatcccagctacttgggaggctgaggcacgagaatcgcttgaacctgggaagtggaggttgccgtgagctgagattgcaccattgaaccccagcttgggcaacaagagcgaaactccatctcagaaaaaaaaaaaatgacctatttgattaggatgtcaaaaagtagttgattaactatgccatggttatagccatatgtgatttttagtttaattttgaattcaaaagttggcaataactagattagaaaatgtatcatatgttgccaaacattcagaagtcgctttcacctcacactgctctaccaaaacttcttagtttaatgtcaccagtgacctctgattgctaagcccagtggttgctacttgggtatctttttatttgatctagcagcagcatttgacactttatttttccccgttgtttggtacagttcttctcgtggctacacggattccacattctcttggttgtgattctttctcaccggtcatcctgcctcacctccattgttaatttctccccttctctccaccatctttaatattggtgcacctgagggctcaggcttttgttctgttctcttctcttagaaaccctttgaactaggttttcaaaaccatggccctactgacattttgggtcagacaattctttatatgtggggctatcctgagcattgtaggatgttcagcagtatccctggtctctaatagcctctacctattagatgccactagtaattcattccccgattgtgacaaccaaaaatgtctccagacattgccagctgtcccctggggaaaaacaattgccttcagttgaaaaccactgacgtactctttgcaatcttggggatatcattcagagttacacctttaaatacatgaatacgatattgattaacatatttattttactaacccagtctttcacaaatttcaggcttgtatatccaactgcttacttggcatattcagctcaatggctataaatatctgaaacttcagatgttcaaaacgaaactgatcttccctcctaaacccttgatcttagtcattaacacatttttatgctaattccagctttcagtttcacaggctcaaaatcttgtctttaatcttgacttttcaccttatccacattccacattaatccacattcagcccatctgcacagatcttctaaatacattcaaagtgcagtcatctttcaccctgatgtgatacactatcatctccctctgggatttctgaacttatgctgagattccattaattccaactactctccctacttccacccttgctcctccccctgccctgggtaatctgtttctaacaaagcagaaatctgcctcaggtctgtcactctctactacaatgattcaaagtttttctttcttttttttgagaccaagtctcgctctgtcacccaggctggagtgtagtggcacgatctcagctcaccacaacctctgcctcctaagttcaagtgattctcctgcctcagcctcctgagtagctgggattacaggtgcccaccaccacgcctggctaatttttgtatttttagtcgaaatggggtttcaccatgttggtcacgctggtctcaaactcctgacctcgcgatccgcctgcgtcagcctcccaaagtgctgggattacaggcgtgagccaccacgcctggcccaaagtttttctatttctcagaataaacttgaaagcctttggatggcctaacaagtcctgcattacttggtccccagtgacctctctgatcagcttccctcctgctctcccttccttactcactttgcttttttgttacctgtacatctttttgacagagtgcctatttgatttttttattttttaaaaaggggttgttttcattgattattgaaaggtttttatatacattaagttacgtgtttaaaaaaacatttctctgggtttgtggcttgcctttccactttgtgtatgtgtcgtgtttttcatatcgtgatttaagaatttttaccataccaatggtcataaatatttctcctatatcttattctggaagtttttcttctttaaactataatatttatgtcaagaatccctttcaaattatgtgttatatacaatgtgaattcaggattgaagttcatttgtttttacatttgattattctgttgcttgggggagaactgatctcttaacaatattgtatctttcaatctataaatgtttcttcatttatttgggctcttcatcattcttttttagcagtgttttgaagttttcagtacacaggtctggcacatcttttgttacatttatccataagtgtttctcttttttttttttttgaggctattgtaaatggtacaattacttttattttgatttgcaattgttcaatactagtatacagaaatgtgactaatgtgtttatgttgatcctacaaaattgctaaagtttctaattagttttaatgtctcctttttagattctataggattttctatgtagacaatcatattgtctgtaaataaagacagttttgcatttgctatctactctgaatggcatttattaattattcttgctattttgaactgtttagaacatcagataaatgttgaatagaagtggttagagttgatatttttgtctgagttttgattttaaggggaagtcattcagtttttaatctctagttgcaatgccatatatatggtctcatatgaaccttttatgagattcttagtttgcttagagtttttattatgaatagatgtgggattttttcaaatgctttctctatctgaggtgatcatatgtttttaaaatttgttaatatggtgaattacattgattggtttatgaataaaccaactttgcattcctaggataaacaccacttgattttgatatcaacatttaaataatatactcagtgctgaagaaagtagggggagaaatatgttctccaacatcgctgattgggatgtaaagaggcaagacatttttgtaagacagtttgcctatgtattaaatggtttacacatattggcatcatctcatccagcaattctgtttcaagaaattgtaagggggaaatcaactgtgaataaatatttataaacatgtatatttatgtaaaattatgaaaaaggtagagatgcaatttttcaataacagaagagggcttaaataagtgacagagaaatgttattaacattctgtcattttgtaatgataaattaaatgacagtacttacatttaaaataacatgtataatatgatcccctttatataataagcatgcatatatttatgcatgaaagaaacactgaagaatttaccagctaattttaaccattttatctcctgagggtgagagcttttttttaaagctataatttctgatttgtatttgtatgtttcaattctttccaataaaaattcatacttgagacttcttggcctgctataacaaaatgtcattgactgggtgacttaaaacaacaaatatttatttcttacagttttagaggcagggcagtccaagaacaaggtgctgacatgtttagtatgtagtgagggccttcttcctggtttgcagaaggctgccttcttgctgtatcctaacatgggcacgacagattgatgtctcatttcttcctctttttataaggacattaatcccatcataagggacccactctcatgacctaatctaaccctaattacttccccaagtcctcacctttaagtccatcaatttggggattaggacttcaacatatgaatattggggagacataaacattcaatctgtagcaatgcatttttttgcattaggaaaaaaataagaaacagaaaaaatattttttcaatgtagctaatttggatcaattcatctgccattttggtaactgttttgctgcataatccttgatggggaatccagaattatcctaactttattttacattattttgctacttgttaaacagtgatatatatactattattcaaaagatatcatttttgaggtctttctaggtttttaaaatttgtcataactgggagaggaaaatttctgagaaaatgttattgaagatcaagaaattgttaagtgtataaatagaggtggctgggccttgtttattttgtttcagaatattgccccagtggtaacacttaaatattcaaaacaatacatttggggggaataaaaggaaactttgtgttacatgatgtgttgttaatttttagatattaatggcttttattctatgatacagtgcagcatattgaaatcttacttttaggcagggcatggtggctcagatctgtaatcccagcactttgggaggccaaggcaggtgtaccacctgaggtcaggagttcgtgaccagcctggccaacatggcgaaaccccatctctactaaaaataccaaaattagctgggcatggtggcacggcctgtactcccagctactcaggagactgaagcaggagaatcgcttgaacccgggaggtggaggttgcagtgagccaagatcgtgccactgcactctagcctgggtgacagagctaaagtccatctcaaaaaagaaaaaaaaaaagaaatcttacttttaaggaaatttatggacaattaacttataaaggtgaataagaaagttaatatgtttgagtactttaatgctttctaatttatcaaaatagaactgtgcatttactcaaaaagccctttgataacatcttaaaaaataatattggtatggctgctcaatagctctgatcttaaatagtatttgtaatgtatcaaagtgaggtagaaaataaaaacaatttttccatataattggaactaaaaacacacagttatttagcattaatttttttcaattgtgagaattttggacagaaataaaatctttttctttatccccctgctaaacttggctttattccctaagaaataaagaaaacactagcaaaacattgaggtaaaaatgcacgctgactttctactatacagacaatgtaaagggctttaaatttgttataaaaattatgtgtacctgttgtagttcatttctgttgctataacagaatacttgagactgggtaatttataaacaaaagaggtgtatttggcgcactatcctatattgagataggatagtgacttcacactataggctgggaagtttaagcttggatagctgcatctggtagcttctggtaagggcttcgtgctcagtcaaacaaaacacagcggagaaatagaaggggagctaggcgctttcacaaaagggcaaaacacaagatacaacctgactttaaaacaacctattttgggggaactaatctattcctgctagaattaagccagtcttcagaaaaatatattaattcctcttaaagacttaatcatcttaaaggcgccacctcccaacattgccacgttgagggccaagtctcaatgtgagttgtggtgaggacaaaccaacattcatcttttatattttttatacattttaatatttttatagcagccattataacaggtgtgaggtgatatttcattgtggtttaattttcatttctcagattgttagttatgttgaagatttctttatatacctgttgactatttctatgtcttctcttgagaaatagctattaaggtcatttgcccaaggcatacactcttaatactttgtctcagaatagtattttagatgtaagttagtgatgcttttcttgcctattcaactttttcatgcatttactactcattagctcttgcattcagatatttattcatgcagccatgtttatgtttctagtatatgctacaccttctactagttgctgaagatatggctttgaacaaaaacaacaatgctcctaccctcatgagctatattttagcttatgttaggggtataatgttaatgatgatttctatggtgtaaatcaggactttaaattttctatgatatgttcagaacatttattatttctttgataatcaaatgaaaagcatctgatagagtgtgataaactgagaacttgtaattacttctcctcaacctaaatatttaatgtgtattgtaaatgtagtagaatagcctctttgtggtagcaagctggtttttggattcttgaaatacaaatgtatgttaatgtattctaagtagctattcatttcttttttacacatttcctgtgatgaatggctgtgctaacaacataatctgagataacattgtctgaaatgctggtgtactccatacccgtgtttctcctcatcttttggtgcttacatgaactaaaaatctcggtgtgaatgaaagtgtattttataaattttagaaaagagtgatgctcctttagccagacttttaacagagactggattattgttttctagcctcacagtgtgaaacacaaggtactcacttcttggctgattttaaaattaaaagccgtgagacccagaataaatgtggttcacagagacaaggatctccatattcctaatactttcatttctctctgacactagaactggtggaacaaagagaagagatagcattagcagagccaagggcccatctgaggaacctgggctcatattgggtggtgccaggtggaagtcaggaaggaatgccgaggtagagccaatgctataggaattggaactgtagagaagacacagccgctacctagatgctccctggaaaatgagaaaaatagaactatcctggcttctcacatgctgtagcactccaaaatcctccagagtctctcattggctacacctacctagaagccagcttgtaaggaagcctaggaaatgttgcttgcatggtggaaatgaaagtatgagatctgagatcagggcagtaaaggactagtgtgacccaactgtattgtagctaagcttccattctcatatttctgcccatatttaattgctttacatcaacaattacatgttgatgtttaattacatcaacaattacatgttgatgtttaattacatcaacaattgtatgaggcagctctccgttgtaaaattgaaaatactctcttccactactaaacaggagaggtccagcatcctatcagtcactacatacatctcaaagtccagcatctctctctctagatggttaagcagatctgaatatggttactcaggactggtgacttataaactaaatcttaaaatagggtgatataaaatagaagaatgtcaaagggaaaaataaatagttggttaaaatacgtatgtatattcataacgctaatatgaagcttgattctaatagtacttggtttttataattgattaaaggtcatattgataactatcactttcttctttcataacgaattccatgctttcagacagtatctcagagagtaagagttattgcttggttggataattcaacctttattcttgaagatttctcagtgttcctggctttattgaattgctttagtctttcattatcttttacttttgaacatggatgaaatcagaggtgtccctgtgaaactcttggttacagaaacagtctttcctgacttcactgcgtagcagcaacccagtcatttcttgataaccagaatcaaccaacacatctagtatagtaacacatgttaactatgactattggtttagtaacataggaggaagacaaaagagcaaaatgatagtctcaacttgcaattaattaaaagctctgtgtcttctggtggtagcatttctcccacaggaattaagaagtcctaaaccagcagaacccctgattatgggattacactgtacaaattctactgatagggcattcattataatagagtgaccactctgactttcaccctttcattcttagacccatgtagtttggctatgagtgaaatagtatcatttgttgatggctcattcaaagtatatttctcttctctatgatcacatctcagcctagcagggtatttttttctaacctggagccacagttgtgtcttcaatagctattccactgttaggttaggtcagctgtttctaagtaacagttcatagtaaaaccagtaaattccatgggcatgagtttttctgcatttctttggcttcgaatgaattcttcgatcaaaagcaattctgtataaaatgcatgtggttgctacattttatacagcatgtggttgcagttgtgttttatgcagcatgtggttgccgcgtgagtctctctgaatatcactatactaaggactgtaatgtggacagatgaccctgaacagtagtgggatctagaagagctttgagggaaagtccatcttttcgaggccattcatgttaaacccttcaagtcgttccattgaaactcttctcactaggctaatgataaggagatgtattagtctgttctcattctgctgctgaagacatacccaagattgggtaatttttaaaggaaagagatttaattgactcacagttccttagagcaggggaggcccaaggaaacttacaatcatggtggaaggggaggcaaacacattcttcttcacatggtggcagcaaggagaagtgcagaggaattgccctttgtaaaatcatcagatcttgtgaggcttattcactatcacaagaacagcatggggaaaaaccgcccccatgattcagttactgcccattccgggtccctcccatgacacgtggggattatgggggctacaattcaagatgagatttgggtgggggcacagccaaaccatatcagaaggtaacattcaaacagctacatgtagctctttccaaagaaatcttcttcttaaatcttttgtcagtctttcacattatagaaactcttttataatcactgcacagtgtgaggggttccagagtctgttctagaaaagcatagcacatttaaaataaatccactgagcatctgttatccccttgtattagtccattttcacactgctataaagaaactacctgagactgcataattaataaagaaagaggtttaattgactcacagttctgcatgactggggaggcctcaggaaacttacaatcatgggggaaggcaaaggagaagtaggcaccttccccacagggcaatgggacagaatgaatgcaagcaggggaaatgccagatgcttataaaaccatcagattttgtgagactcattcactatcatgagaccagtatgggggaaaccacccccatgatccaattgcctccacctggtacctccctcaacatgttgggattacaattcgagatgagatttgggtggtgacacagagccaaaccatatctcccctctggtgagggtttgagactttatgctaaaatctttgcatttgggtctggtaccttgagttggaatgtagtatctattgtattccagtgtcgagtcaaaattctattatataaaattattagtaatgtaataatgcctcagcattattcctctgttttattttctgccttctgatccattttcctcaagaataatttccttaaagtgtaaatctctattcaagacttatttaattccaacaccccaaagttgaactaaggactttttatcttagactagtgagacagtagagggctgatttctagggttagaaattataagcccctgatccagaactgtagtaaactaattctttttgttttaaatggatcttccctactctccacagacatacccaatgggccctttgtgccttcactgtcaacagataccatctcagcctgtcacacgattctaacacctataaacctccaaaagggacaggctctggatcaccagcttccaggaagctttcctcttctgggtattggttagagctctctacaaatgtcttctgattttcttaaagatattacatgtctggctgctaaggaattttaggagagatggctcctgttaattttggaaaatatcctattctatcaatttgctaataaataagtgactacttgctaaaataaatatttaaacagctacaataaattaggtctagggtctaacgtctagcaagtgagtcttccctttagctataaaccctggttcaaggacaaatcctgagtctgctcaaacagtgcagtgggctacttttaaatggcagttttttaacatacttattgtgattattagtttataggtgtgtcttccccattatccagagagagaattgagtaagtagttttcattattcatctttgtgttctagaacctaatttaaaggtcagctactgaatacagagtaaattaattacagaatgcatgtaagcataaaggaagggaggagaggaaggaagaaacgaagggagggaggaaagttaattttatttaatgaagaaatttgacaagatcaaaagtcactgtctctttatggatgaaccacagatgtctgctaagattaaattaaaataagaataaatttataatagttctgccactgtatggatatttttatatatatagtgtttttatgatcacaaaacaatgaatacttattgaatagaagtttggttcaggcattaactgttgatacatcttgaaatttagggaacagattttatttctttaaaaatgtgtatattggttcatagtttttatttttattaatttcaaataagccatgcactttaaaaaagtgaaatcgcattaaaggatttctcattgaaagcaacaattcccctgacttacctcatcctaacctaataggcaacaaactatagctttctgttttgggatcattttgttgtatcttcacattattaaatagatatttttattgctgtttcttggcatatctattttagccatgatttgttgattgcttttggatggatgccaaagaaaaacacttaactccttagatacccttcttaccttttcatgtttgattacaatatgttgacttcttctagggtatcttagttgcttcatttgctttcaataagatgcttacttacacctttattttctggcttgcctaccatgggtcatagcttgcgagtatacttggtgaatgaggtgctaaccctgcccttccctcccctgcccctgcatcctgtgtgttgaacactcacccctccttggctgcaacccattccatgagcattccgggctttctctacctgcttgactggacaccactgttccacatgctctctttatgaaacctgttacagtttttctctttgctgttagtgcattccttatccttatttgtgagtttaaaacataatgatttctttacttccatagtaataaagtatgagagggagaagaagtaaatgccttccttttgttaccgggggtctttgctcccagagctcccaagatggtggcgggctactcccaggatggtggccagccactcccaagatggtggcaagcctcttgctctctgacctggggtacttggcctcatggattccaaggaatggaatctggggccatgtggtgagtgttatacctctattagaagctgtgggtcatggaaaggaaccgtggaacccaaacgactagtgttcggctccattaggatgaatccaggcacttagctgcacaggaacaatggtgagccttcagcctgattgggagcagcagtgggcgccttgctggatcagaagtgcagtggacaccctgccggatctggagggttggaagtcaaaatggcgggtctgcaatgacagcaatcagcagtggtggacagcgagccaaagctcagcttgagctggaacaaacagaccagaagagtgtgcagttgcaagatttaatagagtgaaaacagagctcccatacaacaggaggggacccaaaaggggttgttgccactgctggctccctccccctgtgctctcaggcaatagatgatttgactatttctttaccttctgcttttagcctgattggtattttagtgagccctctttactacctgatgggtccggtgtgagctgagttacaagccccatgtttaaaggtgggtgcagtcacattccccagctaggcttaggaattcttagtcggcctaggaaatccagctagtcctgtctctcactttgactagattaaaccagagcttttttttgtttcttttggctcttgttcaatatttattggtctgcttcaggttttattttttctgctttatttgaatgaaagagtttgacttgatattttctcttctgccaaggataagaaggcttaatttcttttgcaagggtgtatttagttttaaaattagtatttttcctttgtatttgttacctgtgcttggtaagtttcaatttcatctcatatattatagtattactctactttatctaatatattgagccatactatttaacaatgatcataatttcttacctttacaaaatattttatgccacagagtcacataaattatctcacttaaaaaaaaatgtcattttgatagttgcctaaagaaaaacttcatactaatctttccgtccccaaagtcagcttaagtatagaaatattactgacctccagaatcctcatttttagattacttcccctttctgtgtactctcattttaatattatatcatttagatagtactagttcaattagaatgttgtggcaaataccgtgttaaagtttacagacattgttgctacaaaaagtagtggcatttttgttgatgttgaaaaacttatttttagcagttcaaagaaaaaaattttaaaaattaatatagagaacacacctccctccctaatagtctattttaataaacaaatgaaattaaaattccgaatttttgttttccaaatgaatcatctaagactattttgacaaatccctgatctttaggattttcttaactgagacagataacattgatttggccaagatatttagtaaaaagatatttaacgtatttaacatctaatttagatattagaaagcaggttcttgaaagacgaaattaagagctctacatctgcctctgtgatcagagtcagcggtttgaatgagtttcatccacatttgatgtagacagagtgcttttcctgctagatgggcatccagaaacacaagaaaaactgtgacggtgaggcagagcaggcgtcgtgctgacagctgagatgcttgtgataccttcgctggcccggtggtcttgttatttggttgtgttgacatcaaaagagcaccgtgagattcatcagattgacagcgtggttgacacatagctacagcttttgtaaatatttatattaggcctcaaggaaagggataagtaagtgcacattgttgggcgcagagtaaataggaaagtacaggttagggagattatcttgcttttctaagtaactgacataggatttgtgtgaaaggagtggttccaaaagtgtaggataatcagaagagtatgatgaacaaatttgcccaggaagggaaataagatgttgttttatcatcttaacattttactttacatatgcatctcatttaaaaatttccaaattctttctcttcaacttttaatttaagttctggggcacatgtgtaggaagcgcaggtttgttacataggtaaacgtgtgccatggtggtttgcagaacacaccaacccatcacctaggtattaagcccaacgtccattagctagctattcttcttgatgctgtcccttcccctgcctctccccgacagcccccaatgtatgttgttccccaccatgtgtccatgtgttctcatcattcagctcctgcttataagtgagaacattcagtgcttgattttgtgttcccccattagtttgccgaggataacagcttccagctccatccatgtccctgcagaggacatgatcttgttcctttttatggctgcatagtactccatgatgtatatgtaccacattgtctttatccagtctatcattgatggccatttaggttgattccatgtctttgcaattatgaatagtgctacaatgaatatacatgtatttttataatggaatgatttatattcctttacgtatatatccagtaatgattatatacccaaagagataccatttgacccaaattgctgggtcaaatggtatttctgcctctagatcttttagaaattgccacactgtcttccataatgattgaactaatttacactcccaccatcagtgtgaaagtgttcctttctctctgcaacctcgctagcatctgttgtttctggattttttaataattgccattctgactggcataagatggtgtctcactgtgattttgttttgcatttctgtatcagtgatggactttttttcatatgtttattggccacatgaatatcttcttttgagaagtgtcacacacactcatatgttccttaccgtactattcacaatagcaaagacatggaaacaacctaggtgttcatcaacagtggactggataagaaaatgtggcacatatgcaccatggaatattatgcagccataaaaaagaatgacatcatgtcctttgcagcaacatggttgcagctgtaagacattatcctaaacaaattaaggcaagaacggaaaatcaaatattgcctattctcacttataaatggaagctaaacattgggtactcacggacataaagatgggaacaatagatgctagggactactagaaggagaagggaggaagaggggcaagggttgaaaactaactgttgggtcttatgctgaccactcgggcaatgggatgaatcatacctcaaacctcagcatcacacaatatacccatgtaacaaacttgtacatgtgttccctgattctaaaataaaacttgagattcttttttaaaaagaaaaatttcaaaatttatttacctctcaatgcatatgatttctttgtttatgtctcttccccctatactataaaatgttttatagcaggatctataataattaaggcctgggaatatcgtagaatctatattaattgtgataccttctattttcaatctatatacagcataggatgtagtgtagtgttttgaacattatagatcctccaacagtatttgttgaatacatttattaaagataataggttgcttgcaatagattctagctaacatgattgcagtttgagaacaaactcagttcttttatatttcagtgttctactgaaaaccaaacacaaacatgaatattattgctaccataaaggttgacaacttttattaatatttaagattctttttaatggttcaaagaactatgggaatgttaatattggaaacacaacttcctgactcatatttttcattagtattaaaatgaaagtatcaagtatcaaccctagttttttttcttttacatctaaataattaagatccttccacaatattctaaacttaatttattaaataacaaaatcactgctttgaaattcaaggaaattgacattttaagctctgatttatgatttttcctgcagactatgtgagtaatctgattatttttatattgatgaaaaaatagttcaataagaaatttattcagacacttgtaccttgacattataatagaaaaataaagacacaatatttgtaaatttatgtacctgaaagttaaaaatatttgctttggattaatgagatatgagattagttcatttaaatagctatttaaatgtctctctcatctagttttcctattgtgtctttccacataaagaaacatgcaccaaaatctgaaaggtcaggagtctaaaatagtaaacatatgtcactcaaattcatgatacatactaagacccagagagaggagtctgtaggaatcctatagaacgtctcctattacccttctttattaactcacagcaatccagtttcctcttataatatcttcactgtttacgttttcaatcctctaatcatgagtgtggctatttttgtgcagagtacataatatgcttaatctcttttgttaatagaggttttttaaaagaccttttagaggtgggagtcattttaaaagcagattgtgcaatttttctccttcatatatttgaacatgttttaataatgtttctttctaaaggtttgggtacacttggcagatttttagacatggaagtctagagtcgcgtttctatttaatattttcaactttatgtgtagtatatatactttacacatttcaaagttgttctctcatctgtctccatagtgtctttataagataaatggctggtgtatcttgagatcttaactataatgctaaattttgtttcttttaatattttaaaatcacattaactttttatattgttatatatttattattcaaggcttagacaatctacatgcttgttaagtttcagtctaggcgccaattttttctgcctttttctcttagctttgaaattctcttaaatagaaataatgtgggaagattttcatagcctagtcattacataacaaatatcaaagccattaacagtaagaaagcatttgtttaatctcatcatcactctctttatggttttatctaaatccaaaccagatgttgagcagaactaactccctgtgacatccatactttgtgtgtgtgtgtgtgtgtgtgtgtgtgtgtgtgtgtgtgttttcttcagaaatcagaatgtttggtctgtttaattttgttttttgaaagctcagccatctgacatgatgaacacatttcagaatttacaattgtttcttggcctgaataagatcaaattttacaagcattcataatttttcttggcacagttcttccttgtgtttcttatacatgttgttcccctgtgaaaaaattttctggctgtgtcaaagaaatacatctttgaagttacggattggaccatatagctgatgacaaaatcaaattgatggtccaccaacaatagaaacataagtggttaattgctatgtatcttcatgtcacaatttttaaaagctacatagctacatcttgacagtggaaatatttctaataaccaacatttattgaatgcttcctacgtacttagcattgtggtaacattttgtggcagggaatattattgttatcactatttgctattgctaagttgatgtgggcaaagtcacataccaaatagttagttgcaccagtatttgaattcaagcagttccatcccaatgtccacattccaagtcccagcataccacagtgccacagggaggtgacagctctctgtggctaggcacttcatcataccacattcctaaataagaagattatcttctttgttgcgttttctgccttggatttctaggcatggttaaagcagatgtccctatgtactaaacatataagcattcaatcacagaactatttatttgtgtatttacatgtcagatcttatagagcaatatttaagttatcaaaagacatagtgtgtctggaattggttccttctggtgggttcttggtctcactgacttcaagaatgaagctgcggaccctcgtggtgagtgttacagttctcaaagatggtgtgtccagagtttcttccttcagatattcaaatgtgtccggagtttcttccctctggtgggttcgtggtctcactgacttcaggagtgcagacacagaccttcacagtgagtgttacagctcttaaaggtggcgcatcagagttgtttgttcctcccggtgggttcgtggtctcactgacttcaggaatgaagctgcagacccttgtggtgagtgttacatctcataaaggtactgcagacccaaagtgagcagcagcaagatttattgtgaagagcaaaagaacaaagcttccacagcatggaaggggacccaagcaggttgctgctgctggcttgggtggccagcttttattcccttatttggccccacccatgtcctgctgattggtccattttacagagcactgattggtccatctacaaacctttagctaggcacagagtgctgattggtgtgtttacaatcctttagttagacagaaaagttctccaagtccccagccgacccggaagcccagccagcttcacctttcactagcatgtggtagtgagtattagcataatattaaataaagtaccttggactcgcaatcaaaaggcatggactcattctgtctcttctacttgagaaatgaatgctttaaataagttacctgagcattgttggttcttagcatcctcactcataaaagaagataataatattaatactaatacttttctctgactggattgttacaaggattaaggggactaattaacacaaaagtaagagtaaataatgtagtagaaaataaatagatgatggtgttttttgcttctttcttaccaagtagatgttttaaaaatagtcaaaataatctgttgcaagtacccagaactcaaacaatttgaagatgggttgcttaacttttagtaattatgatggaaaccaaaaattgtcattaactaaatgattacatcattttatattattggtgagaaatcattttagtactataagtattgagatgttaatttaaatgattcaccctgttcataaaatttctaaaatgaaaatagtttaaaaagtgattttcagactgtaaagttgtggtgatgaaatcaatttacatctcattttggagatcatctttgtattttaatatttttgtatttaatacaaaaagaggagttatatcactcatagttaacctaagtattatttttgtgaaattttccatttgattttacacacacacagacatacacacatctgtacctggtcatacgtatgtatgtgtgtatgtattggtttatgatatgaatgttatttcttaccataaatttcaccattataaaaaagttgctctccacaatactggctgtcagtgtcccatacacaagatgatgtgtttaaaaggtgtgcgtgttacccaggcttggccaatcagaatttttcgtaagattgttacattaagtttaacaattgttagatttttaaattaatttttaaattaattgttgaattaaatttcctaaaattgttaagttgcctctggtagacattctagaaacatatataacagagacagacagacagacagacacacacacacacacacacacacagaggaaaagagatgagataagatatgaggtgatgagaaagagaaatgcagaaaaatagagagatgcataaagaaatgcagagatagaaaaatgcagataaatagtgacaacaaattagaaaaatagagagaaaggcaatgcagtgaaagagacacaacaaggggacagagacagaaaatgcagagagatatgcagaaagaaatatacaggggcaaagagacatggagaaaaggagacagatgcccagaaagaaatacaacagaaacagaagagagatgaagatctcattgaatatctggaactagtcacttctgaaatcaacttgaccctaggcttccttgtaccatgaacaaaatatatttgggtttctatcatttagaaccaaaaatagtacttttattgctggttatgctttcttaacaataaaagttattcttgattttaaaaaaagtcactcttgtgagggcctgttagtctctgatcaggatgtttgctgcatgttttcccaagaaatatgcagtagtatagctatagctctcgtctgtactcactcatggtccttgctcccccaacatcttattgccacttcaaagtgccagcacatgctttacaatcatgacattggtttttaatcccagtgctcaccagcttgctatcataacacataatttggaaaaatttcttgacatcttttgcttaaagctaatgttttatttaactgatgcacgctttctgctactagttgctgttagccatcaaaaggaggcttggcaattttaaaacagagagagggagagagagatgaattattcttttttatttgctcatttcctgataattctcgctaattttaatgggttttgatgtgcaaaaatgatctcctgagaacagttcaatcattgcagagcacattaaaataacaaggcattatgccatcttgagtccctaagagaggcaggtttggcagggcaaaagtgcaagaaagacctgcccattacagtgagactttactggagatgtgtgcatgtgaacttcactcaggctcaggcagctgaagggaaggagatgaaatctcaataccagacctggcaggccaggttgacatgagggccatctggttcctctcaagaatgtcaggtagcagaatgagcagagagtgagagcgcattgctgagttctggttcattgtgaactgatttagagctgcaggaaaattttgcttctctgaaccacatggcagaacataaccttcacacatctccccctgcctttagcaaactgggcagaggagtgggtgacttgaaaacaatgacaggatggagagagggagtggtgtggttgatgttttacttttaaacacatttttaaagagtatagctttacaaactcctccacggccaaccctcaagttccaccctctacccctctgtaaaactgagctggaaataattaaatctaaagctaaaaatgagaggtggggagacatgttgcgtgtaaaaatatggctaaagaagctttgctgtttctttgaatcccttgatacttcttttatgcatgtacttacaagttgttggaaaggaaaatataatattttatcttccaaattaaagagtgtattttgctgctattaagataccatgggctttgctttattggatcattaatttgactttggtcaaagggacttattcagtaagcatgtatctcgcaacacacaagacgtgtatattaatgaaagactagaacatacccaggagtctcttattgccttattaaaacatttataaatgggactttaatttaaagtgctgctaaaatgaaaatgaagtgttgtattgattctcatgccagatgctctttagaaaatgcagtgtgtgtgtgttattcccacttcaaattataacttcaaatctgacctggacatacttaaagataattctctgaagacaagatgtagcatataaggcaattaaactaagtcatttagatttctaggatggcttttgtacactaggtggcagaggcttctaagaatatctctcttatataaagtaccagagttttgtttggctttgcaagctcaagcaaaacattcatgaaaatgttgttttttagcagtggactaagattcgcctttttaaaatatgtggaaaagtttctactgaaatttcaatagcatgttttgttctatgtgaaccttcaacaaatacaataattttttttttttttttttttttttttttttggagaccgagtctttcctctgttgcccaggctggagtccagtggcatgatctctgctcactgcaacctccacctcccggattcaagcggttctcatacctcagcgtcccgagtggctgggactacagacatctgccaccatgctcagctaattttttgtgttttagtagagagtgggtttcactgtattgcccaggctggtcttgtactcgtgagctagacaatccacccaccttggcctcccaaagtggtaggattacaggcatgagccaccgcacctggccaaatgcaatgaattttttatttagggaacttattttttcatagaatagcagaatttattttttaatttaattaaactttacttggtttaattaatttaatttcttttttttttttactttaacgcaataaaaaaccattcttaaatgggaggattcaaatgaatgcatggcagggggtgatgcctcacattcttacaacacctctttatttttgaaagacttttcacatgcatttttaaatttgatccttaaaataacactgtactgtgttagcacaatttacaggacaggaaataaatttcagataaggtcagtaacttctcccagattaagtaataaagtgctcctgtgttttccctttctatttgagcacaaaaacattcaatagaattttcactaaagaggagctgtgagtatattagtgagagtgggaagtggaagagtgtcatctagtttttaaaaggtggcagatcaacaatatttagcgagaaatggggaggaggaaaagccaaaacaaatgaactcattcatttaaaaacattatcagcatctccctgaaaattatcaacatctcatatactatatcaatatatttttggaaccattttatgggaatattcttaatagagttttaatgcatttaatgcatgctctttttttcagttgtccaaagagaagtgtgccttttgcaatagatcaatatttctctaagcctgcttcccacaccaactaatatcagattcactaaagtttattaagaataggcttctagctcctactcccaaccagattaatcatagttttggggaactaacccaggtatcttcattttcaaccagcatctaagatttggctagtaagttgtgagaatcaacagattttaccttttttgatatgatacagatgcaggcagaaatatgtaaatagagttataatcaccccacatcttgttttttcagttatcataaattaccacaaaaattttgttcatatgaaaagatgacctaatgaatgataagtaacttggaatttaaagaaaatgggcacacactcattcatgcatgtaagtagaggaggcacattggagtagaagaatttcttttctagattaatggttgtaaatgtccccaatcaaatgttagttaataaggcaacattgtcctttgaaaaataacttgagaagtgagaacaattttgtttctgctacttatttttacctctgattgctaaataatctaacaactagccattgttctccttgtgtttgttttctattgtaaatttggtagacttaattacgggtgataatagtagcatttttgaggaatgacaatctgttgtgcattttcatgcataattataaaagcactcttgacaaacgaattgatcgcctaaacaaaatagacatgggtgtaaatgcaggtcaatcaaatggaagatcaatcatgtcaagcaatattttccaacagttcttttgagagatattcagagaaacaacaaggaaaattagttttaaattatcttggagatgctacattgtaaaacatactaagtacattttttgtttgtttttaaccacaaggtttcttaaagcaatgaacagaccaatgtgcagtgaatttcttggaggcaactgtatagttcactgttgaatgtatttggcatagtataatgtgggatggattcagaaaatctgaatttaagagtatacagctgtgatgaaccacattatctattacttctagactgtttaagatctatctttctaggaaaaaaaatgaattttagatgattcgtatactacatgtagtatggcccattgtaaaagtttaaaaaccttcccttatcctccttcttcccaaaagcatatataactcttttgccttgagaatgaataatggtttttcatcacttcagacatgattgaataacctacaaagacccaaataccatatgaaagacagtagagagtaccaattcattggttattgattgtagctctgccgattttgtgccttcccatcttggtcatttttatgggttctaacatattccatctgttgagcacctatctgtctgcatctttgaactgacactgaacacgtggactctaattagttattttacaatttcctggagtatgctcttacctgtttatttgaaatctcctggcctcttgacagctctttactatctgggttgttatacataattcaaagacagagaaagcacagtgaacatttacatcaactaactcatgctacaaaagaggaaatacaacatattacttcttgtctactcctgcccatgagactttgcaatgtaataatgattctttgaaacctcgctgatttctgtagtctccagacctaaattctccaaagtgataccttcaaactactgcttaggacacggcttgtcattggaggacactgaggtattccccagtccctgccactcacatagaagcatttatgggaataggactaagctaaaaatttcatgaggcaataaactatttctgagccagtgctagcattgtttcacatctctgtatttcaggacttagttttgcagctcttgcctaacacagagaaagccctcaatatctttgtgttagaagaataatcagaaaatatagataaataaattgaaagcaatggctaaattatataatcagagcaaattgtcaacaatacacactgtataacttgaaggacattgtctaaaatttatttttaaggtagaaaaggattatcatctttactatatttccaaaaagcatgattaagccctcatcaatttctgtacctgtgaatgtgctttggcattatacttacacaacatcagatattttatactctggataattagtggacagttttgtacctttgatttgctattataccatcagtattcaacagttattttaaccactactgaaatatttgaaatccactgccgtttaatcatagcaattatcctgtctgcagaagtttccagtgacagagaactatcctgtaactgacaaccaatgatgaatagttttttctgacactaagtttgactaacaagtaagtgaggatccttcacatttgctttgctttgccttgccaagtgtcaaaactgtaaatcctctggctgacgtttgacttggtggaactataatggccttgttggttgtggctctgttagagaaaagttatatatataatcaactgtcagctcagatgaatttctcagctatattgcttacttttgtttgttacagaattaactggaaatttattttcctctcttatctcccttagaatataataattgaattcatttcccacacataaaactcccatctcctgctttgtttttttaataaagagaaatttagcacagaatacatatggcccaaagacatgttgaaacatatactgaatatactctacaaaattttaaatatatatgtgaaaaattctcgtgaatatgtgacatataaggtaaaatgaaaattgcctttttgtaatattaatctggtaagaagtggacattaggaaatagttcattcgtttttttgatgcatatgctaataagcctttagggaaggttatggtgtgaaatctaagattcagggattcagatttttctcagggaattatgtgcaattaaaaaacaacacttaataagtgtggtataaaattgtcttaagtggttctattccaagggaggaaatcatattttttttaacattgaaactacaagaaatttggagagaattcagtaaataaaaacaaaattagtttcagagaattaattagtgcgatatcagaatactaaaactggagtttcaagtgtgttaaatatgaccaggccctaagatgtcatttttcttatcttttggaaagatagaaaatgactatgatggcttatttgttacattctagaattcttattggataattatgtaagttgtattatttaatgcttcctacaagagacattattatatctcttattttgcagattagggcacagtatttgaatattaagtcataataccttatgttatagtgccagggaatggttgaacttaaagtccaatctgaatgcaaagacagtgttctttctataaactcttcaattatgtagtctgtataagagaactctctctttttgctgaatgaattaatcaatttagttactacagtaaaactgttataatttaatttctcaaagaccttggcttaacacaggaacataataaataaaaatagagtaaaaatctgttgaaataactatgatgtgtctctcaggataatgaaaaagggaggataacttcaaggtccaatagtagacggatgattgaaccaattatgctatgtcgttataacaggttatacatattttaaatcattactttagttgtacaatataaacttttccatatgtcaccagatgttatagtaaaacattaaggaaaaatagttaatactaatgaagggaaatcttaatctaatatttaatactttatcacttaataggattttgaggaacacctttcttatttctttgttcctttttatttagaatcacagagattttgtgtaaccaaaaaaaaaaaaaaaagaacccaggaaatattttacatattctaaaagttctcacattctcaacattatttagcaaatgaaaggaaaatattgacataacactaactcgtgtctgccttcattaaatttcaaaatcgttaaaactgtcacaacttccttaaaggtaaaatgacctattttacaatttaaaaaatagtctgggtgctaattgaatctagaattaaaacttgaatctttgagtgccttgacccttaaaataattttgtttcagaataccaattagaatttgacctaaagacatctgatatattaagactaatttttaaaatttgcatgaaagtaatagtaatcacactaattctagttttctaacagggaagacagataagtgttacttatctgtaaggtgtttctctaattttgaaaatttcatataaaatattcttaaatggatgttttaggtttatgttcatttgaatttttttctcaattatgttgtataatgataaacagtatattaacagcacattaacagaaataattgtgtagagacaatggaagaacctataagctctattggtgatgtaattttttaacaggtataaactgtgttattacaacgttcagtttctatccactttgtttaattttataaccactcctatcctaatagcatgaacataaagcaactttatatttagagtattttttgagagatcacttcttgtggaaattacattaataggtcattgatttctctggtacaaatgaccttgaacaaaatactgccatgggcaaaacaaagtcattataactatccactacactgtggactgtgttaaataatcataatccaaataagaagctccaaaatgttggtctctggtatgaatctgtagcttaaaagcagtcacacattggtaacatctttcctgaattatgttactacatcacagcgaagatctaaatacacttcaacactcagaacactttctcagcatgcctacaacgtggagctgcagtgtgaatgagttagacccatgctctgaaacaggttgctgagtctagtgaaacaaaatatatagactatgaataaagtggcgggtagtacctgaaatatactagactgactgtgaataaagtggcaggtagtacctgttgccttaggctgaagtggaaaggtctgaactttcattgaagaaaatatttatgaatgcattaactaagatgaaattagcagattcagacaaacacttgcagaagtccagactataaatataaaaatgtctttgcttttaagttgattaaatcttattgttctatttcttagaactgttaagttgtgcccctctatatttatgtgcctgttttttaaaacacataaattttttgttgctttgaaagtatggaataaagaaacactgctaggaaaatgaaaaagcaagaaaactgaaaatatggtttattagaaaaatatttatgaagtactttagcacactagctgctttatactctgccacacacttatgaagtgattagaacatgtgttgttgctcatggtttccaaatggggaaacaaggacttagaaagcttaaataacttcccaaatttaaatcttgtagtggaatctacaataatgtccaatttgtcctcttctaattccaatccagcatttttctagtacatattcatttttgtttggtatattcttcagtatttcacagtttcctgtgttgtttgagttcttattctgtacttatttcactctctcagcgtttttatcctattcaccagcagagaaagaaggtagctttctcaatttctgttaatctatatcaccaatcacttaactgttggagtaacataaacctcaatagcagaaatgaagacaacatttgaaaaatcagaaagctctcgctttttctaccctctgacccagtttgcaagagtctattggtaaaaatgtcttgacatctttggaatgctgtcaagaaacacagagcccaaatgaagtctgtattcattgtctctcacatacattttacctgttaaaaatgcattttctgcagtttaagcccaaagtgtcacggaagtactacatttctgtgacttgaaattccaaaatgagacatttccatctttaagctggaaacaattcttatacttgtcaccttttgtagtttataaaggtttcttttgatccttttgcagttacttgctgaatattgaaaggggcttttttgacacatataaaacagggtttatgtgtgcatgtttatttttataaatttatttgttgctaggtccaagaagcctttttctcccctttgcattactttgatgcacctgttatgatcctgctgaaagctcccttgcttctttggagctctgaggggagctttgtacctttgaaattttcacgagcttttgactagctgccaagatttcggctgctgtgatgcagtacagaggcagccatgcattgggctgccaagtctcaaattcttgtttagaatgacagtgagaacctccagacctcactaaagagaatttgcagaacagaactgtattctttcacaaggtggttggtgccaaggccgggttggtctttgacagagcagaaaccaggatgatcaatatcagaagcatcctcatgcatggttttcaaatcaggagtgggggttaggaatgaagtttgccgagtattggatataacaggggatatttagaaaaggtgccaggcattgaactgattcaaatttctcccagtatctactctttttgtaaaagtaagaaattttgaattggaaataacctaattagtttagaaaaacaaataaataagaaaataagcatagcattttttaaaggcttagctacttaagcatttaaaataccttctctcacaaaagttaaatcttgttcatgtgtacactggttttgataagataatatttagactgttggattatcttaactgattttttttttttttttttttttttttttttgagacagagtattgctctgtcacccaggctggagtgcagtggcgtgatctcggctcactgcaacctctgccttccgggttcaagccattctcctgcctcagcctcccaaatagctgggactacaggcacgtgccaccacgcctggctaattttttgtatttttagtagagacggggtttcaccatcttagccaagatggtctttatctcttgaccttgtgatctgcctgcctcggcctcccaaagtgttggaattacaggcatgagccactgcgcccggctaactgaaagttttaatatagctttcagggataacttatgtactcttgaaactatatctgatattttgtatttgtatgtatgtctgttgatgtctctctctgtatacatagaaacatttccatatctagctagctagctcccatttgcaggttttgtatatccagttacaacagcatagtaggggaaaaggaacctgacatcataatattcggtatttttacaagcaggatattaaaattcatttgcaagttcttagtggaatgcagtagtttttgatcatatgtattctgcaactttatttatttatttatttatttatttattttgagacagagtttcactctcgtcacccaggctggagtacaatggcgtgatctcagctcactgcaacctccacctcctgggttcaagcgattcttctgtctcagcctcctgagtagctgggattacaggcacccatcaccatgcctggctaatttttatattttttgtagagatgggttttcaccatgttggccaggctggtcttgaactcctgacttcaggtgatccgcccacctcagcctcccaaagtactgagattacaggcataagccaccgcacctggccacagctttattttttaattgaatgctgttatacatgagagtaggaaacacctatggttcagtttctctatgccatttggaatatttcaagaacagtatagacataacttgcattccaattgtttaaagaattgtatgagtctgaatgtggaaattaaccattttgttttcagtgctaattttatgagaccaataagcctgcaatagaatgactaggaaagctactaccttcattaaggaaagaagctgggtatggtggctcacacctgtaatcccagcactttgggaggacaaagcaggaggatcacttgaagccaggagtttaaaattagcttgggcaatgcagcaaatccccatctctacaaaagaaaataataataataaataaataaataaattagccaggcctggtggtatgcacttgtagtcccagctactcaggaacactgagcccaggaggtcgagactacaatgagccatgattgcaccactgcactccagcctggaagacaaagtaaagtcagagaccacagccaaccagaacatgcattgctcttggtggataagtgaggcaaagcaatttatactgtttactcccctattttcctttccttgaatttttctaatatttgtgtttttatagcattgtatccacacacaaaaaatgatatagacgctgtgatagtcagtgtgctgctccccaggcacataaatcatctgactcaaataaatgaaaatctggacattatgattccttagtgagcacgatgtgaggtatcctccctccagctgctgtcaatgacaccaccaggctcagctctgcctcccgctgtgcctccacaccctgcgtgagacccaatttctcacttaagactaaaacagtgcttctgtctagatctgtgtttttctaccatttctgtttcgtttccacatacatagaattcattttttcttgagttagacatattttattttcctgaaagcaaataataattcaaatgaagtggcctctttctccactttcttctttgtttactccttcttccttccctcatgccactcctccctcccacttcctctgctaccccagcacatcatgaaatactgtacatgttgatatattgtatttgattatgttaggagagcaaaggagtataacatattgttccattccctgggaagcttacctagctaaataatattataaaatttaagtgctgtgatcctcagagagatgagagggagagatcagtaaggcctactttagcaaggagaggcttcatttaataaatatttaatgatgatttactgtgtgtaatttatttgcgtgttgactgccccgcctccaagcccctcacccttctgctactgtaagctcttcgtgtgcaagtattgtgtttgttttgttcaaaattgtatactgtctacctgtgatactcaaggtgggcattggaaagtattgttgagtgaatgcttaaaagaatggcaattggaggattctcggttgtgcttctttctttcaaggagatggtacttcagcagggaagcatcacatgaagaatgtgatggatttgctttcagggagggaaaggatgcactcagttggggtccctcattgctggttcctatttttatctagtttaagaaaggacgaattcacccagcattgaaatcaagtagaaggtaatttactacttagtcatttatgtgatttcatcccagcagccagctgtttcctggatcatattttattacaatttttatttatagtatgtctttgcaagaaaaacatccggtgcagcagagcttagtagttagtatgtaataatgtgtatttgaaagctacatagaagacgctttttgcaagtttccctacaacagtgagagtatcaaatccccttctcccatttttaaagctgtgaaggatttcccctgagatttatggctttggtacaatggaaagtggattagacttgaggttagcaatcatgtgtctgaatcttcaccctatcacttagcagtgtggacttggtaaattgattaacctgggtatggctcagttaaaacttgcctcacaagtgagaagatgtgagagttaaagggaaaaaagatgtcaagtgtctgtactaagaacacgtatttctctttttccatctctccagtataaaaaatgtttgttctggaagtctattattacagcttaggaagtaatttaaattattctttctgtgttaattctgaattttagcttcattttaggcacttcataggaatgccagtatcacatacctagtccattttattttgtgatttcccccaaaacaccaaaatgcaatgccagctcttgacatattgttctatctttcgacaggaattcgaattcttttggattataaatgcatggattgcccagaacattttcatggtacataatgggaatgaattattcttcaaacttattttagtccaaaaaggaacaaatgttacaaaagaatcaggataataactacatcttttggaatccttccttataacatttattttgaatcctttcagagaagctcatggaaatgcgcagtcatgtctgtagatggcatccttgtaccggatgaaataaaatgataattaagtatgcgagatctttcccataacagtcagcccgtttagtgtaaagtgtatacttaagaatccatgataccagtttttggaattgggaaataatgcgtgggaagttgatatgtattttttggggaaaaaaagtaggagaccaaatacaaactgatgggttctataataattgtgttttcttcttaaagtgtcttagaggagaaaagttgaaaaagggtcaagatgaaaaggcttcacttttattttctggaagcatttaatcaaaccaataggactgtggactggttaatgtcatccctaagccaccccaaaataaaattctgcaatctccccattctttcaacatatcttatgtgataaagaacttttcgtacatatttttcatttctttgtgattagctttttcctggtttatgtaaactgttcatgtattttttctttcctttttttcttaaaaacaactataattggatttttgtgtttctaatgctggccagggtactaatattttattgtcgtatatgtttttgtagttcatgaaacagtaaggaaaatttcacctaaaagggtattttaatagtctgattactggaataaattgttgggataaattgtgcactcttttcctggaaactggcatctggggaacagcattacctaccacatatgatatatgacatgtataagttgtttattctaagttgcagttggtacgaaaatatttgaaaagaagcaccatattttttcctcctaagaactctaattccattgtttgtttttgtttaccagaatgtctggcagcttgtatatcacaactgctaggctatatccactttcaccaaatcagactgggacaaatatttcatcagcattcactgatagcaaataacacccaactttttatctcatttattatgaacaatgataataattgttatatataactgacattattaaaaagaccctatattacataaatgtgatcatagctacaattatgtaaatgttctagctctaaggttatttaaatttagctttgtgtagagaaatcatgtttatttgcacagttttagtattcaatggagaaaaatatgatatagaaaaataataaaatgctgggtctcattagactgatggagataaccatggtaagattgagcattgattaaaagacattctagcaccagcaagtactagcaagttctgtgctaggccctccagaaacaaaaccggggaagatgtagtcccagcccttgagggtcaataactcagtgcaggggaaagtaacatgcaaaaccgtaacaagacaaagccagcattataagatatataaatacaagatgttttagagacaaagaggacacaactaagtttacttgaatgagttgagtccgtcctcatgtgttggagctaactcttgaagacagccactggacttttttaatttacatttttttcagtggttaaatatgacacacagtgtaaaacatatatgtggcatttaatggatgcatataaagtgaacatcatgtaaacaacatcaagttagaagacagcgtaatgaaacatccccacctagaaacatgggcgtattgccagactgcaaactcctgtttgctgtcagatgtaagcaatatcctgacttaactgagaattatttctttttattaaaaaaaatatgcgcttttttttttttttttttttttttttgagatggagtctcacactctcgcctgggctggaatgcagtggcgtgatatcagctcactgcaacctccacctcccaggttcaagtgattctcctgcctcagcctcctgagtagctgggattacaggtgcctgccatcacgcccagctaattttttgtatgtttagtacagaccgggtttcaccatgttgaccaggctggtctcaaactcctgacctcgtgattcgtctgcctcagcctcccaaagtgctgggattacaggtgtgagccaccacacccggccatatgctttcttaaatagcagagttttgcatagttttgaacagctatcatactatatagattattttgtttctggcatctactgctcaatattttgtttgtaaaatccatctatattattgcgtacagctgtggtttattcattttaattgctgaatattttatgaatataacaatttattgagctattctattgctgatggatatttgagtgttttcacattggggctattcagaataacattacttagagctgcctgtatataattgttgcacgtgcctatgtttctctgcaatgcatactgaggagagaaattgctggattataagttttgcatgctctcagatttactagataatgtcacactgccttttgatatggttgtatcaatttatactctcatgatatgagatgacatctccacatcctccgcaacacatagtattgtcagactgtaaattttttaacaactcagtgagtttgaagttatatttttcttaatttgtatttcccttatttctaatatttacggactatttgccttccctctttacaaagcattttcttgaatattttgcccatttttcatttatgtagtcctgtctttatcttaatattggtaagaatttgtcattgtcattgttggtggtggtggtggtatttttgtttttatagtccctatttagttattttttaaaaaaatatattctcttacattatggtttgcatttgtaccattttcgtggtgtctgtgatgcactaattgtcaatatttatataatggaatttattaatcatttactttattatttgtgttttttgggaggctttaaaatttagtctttaccctaggaaataaaaatatgttgttaataattttctcatagccttataggcatgtttttcaacaaagatacctagaaatgaattttatacacagggccatgcaagtcccatttagtttattttctatttaaattgatttccactcggccctcattttctgcaaagcctccccccaccaccatcccactactctgcagtgcgaagtatctaatttgtcaagcgtccataaataaattggtctatctttgagcgtattattctgttccttttgtgtatgggcttgtcattgtgctactaccatagtttgctaatcagtagaaacttattataagtctgcatgtttagttgagctttattcttcaagaatatacttccagggccgggcgcggtggctcacgcctgtaatcccagcactttgggaggccgaggcgggaggatcacgaggtcaggagatcgagaccatcctggctaacacagtgaaatgccatctctactaaaaatacaaaaaattagccgggcgtggtggtgggcgcctgtagtcacagctactcgggaggctgaggcaggagaatggcatgaacccgggaagcggagcttgcagtgagctgagatcgtgccactgcactccagcctgggtgacagagcgagactccgtctcaaaaaaaaaataaacaaataaaataaaaaaaaaaaagaatgtacttccagataaatttttaaattatgttgtcaaattatatgaaatgtgttatggttttgggtgggataacattctattcatattgtaatgtttcaacttttaagcaatgaacatagtatgcagcttcattagttaactgcctttaatgcttctcaataatattttatatttcttggagatatctcacacatctatttacagttattcccagaatatctaaattgatattcactgttactattgtaattattgaaactttgttttcttgctgttgtttataaataggaatgcaatttaatacatatgtcaagtttatatccagcaaccttgttaaacatcgtaatctgtcctagacgtttactttacattccttggcatattattgtattgtctaggaaaaaggctcttccccacttttttcaatccttatacatttattttcttgttccgttgttttgtttaaaacttcctacaatgttgaataaaagtggagatatttcttctgataatgattctaaatcaaagtaataattttagttattcatcaataagtgtgaagttttctgtaggtttgatatatgttatgtcagataaagagggtttccctctatttttagtttgctaagaattttttaatgaatggatattgaattttatcatatggattttctcaatctattggaagacgtaatgtgatttcttctaatctattcatatgattattatattaatggatgctaactaatcatcaaaactccaaatcctacttagacattacatgtgatcctttttatatattgataaaatcaatttattaatatttttataggatttctgtatctgtaactatgaatagaatctggcttgaggtttttaaatgtgcaaaaaaatttgaactaaacaatcaaggtttaatgtgtcatacacatgcaaaatagaacgtatttttaattgtaaaattaattatccttaaaggaaagcctttatcttatactgcttttgtgcttttggattatttggaaaaaattaattcattgtcagagctctgactacaccgtagagttcaagtgcaacagaattggtagaacatagagtgggatttcctagatgtccttctcaaaccacaagtgaagagcaagcatgtagtatacagacatccccaaagtagaagttattcatgttacagtcaactataagccatcaatcatcaacttgagctccttgagagcacttgagtccctgattcgtttgtcagaaaaagacagacagacagacaatgaaacctggatgttgattaatttccatggacactctttgctctttggaagagtggcaggatggactttcatttgctgcacttttgtctgaagctatacatatagaaaagagacgcaagatcaggatgagataagaaataacgcattaaccttcacacttgaacatactttgtgaacatcgtcagtaagcaagttaaataaatatttagaatttcaagataatattaacattctttgtgaaagctttttattttactaggcaagagaacttgtgcaggggaactgccctttataaaaaccatcagatcttgtgagacctattcactatcatgaaaacagcacaggaaaaactacccctgtgctgttctcatgatagtgcataaggttcctcccatgacacgtggggattatgggagctataattcaagatcagatttggatcatagggtcaagccatatcacataagaaaaggaaaagtttgctgttgaaggaggatgaatatgataatcacaggtacttcaaaactagtatgttcctgcactctatcaatatcacatgagttggactctaagtctaggtagctctctcttcctctttataaagttttgaaaacttcatgttagacacatgtattaaattaatattattctcctgtgcctgtgaattttgcttagtttcattagtgattataagcatctcataatcatttatttatacccaaataaagtgtcttaaatgtttgggttctgacatctactaaaccaatgtagagaccaagtcagtatcactatagtatgatggaatatactgagaaggaaaaggttgaaccaataaagtatgtattaatagtaaaggtaatagcatttaacatgttttaaatcgcagaactatgaaaaagtaggagttcagataatgtattctattgcttagttttggcagtatatgttgttgaaagctttatgtgttatgccactacccccaaactgccaatatctggaaaagatttataatatagagattccatagatttagatgttcattcaccacagtctgtgcctgaatacaaaaatatttttaacaaaatgtctttttttgtttgtttgatgctccacagatgtgaaatatggatcaacagactcctcatgaccaatcataaattagagtaaaattaccaaagagtatgtgaaagtaaattaatgctcccacttcaacttaaagaattattaagtaatgtcttagcttcaccttagatgtttgaagcagagctgcgaaaagaactagtttcttctcagtcttgatccaggatttaccttcttcacatctcttttactttcttgaacttgaaatggatatttcatctttattcttagtcttttattaatctcttaaaaattatgacccaaactaacataaactgcacaaaaccaatttttgctataaaacagtgagtgcttttgagtaagatccaatgtcataatcactctttgtctattataatatatgtaactgtatctccaccccttatttgattgctatttcatttttgcttcattagttctttcaatatgtctataactaatgtttataatcttatgtgtaatacctgacatttataattctgtttctaagatcattttcctaatggctgaaccactttgaaatatcaatatggttggtgttgtgcatttggcaaagttatctaatcgagaccattcttcaggactgcttgaaatcatgggccagtacagaatgcattagctaagtaaaacagtaagtggtcacatgtgatttaataaaacaaatgcaatttaaaaagtcttcagggaaagaataagactgtataaatctatttcatttctctcaatgcataagacagtatactatgtggttatgtgctatttgaaaggtttttgagcatcataaaactaaattttgaaatcaattcaacaaaaatgacataaatggataaagagaaagacagaaagatgagattataattggactatgatggcatgaaattttgaaggaagaaaattagggcactaaattaaggagggtagaaggagagagactgaggaaagaaagtctaggaagcatttaaaccccagacagtgttttaataagaaaagttttaaatggctcagtattcattgtagattcatggcaatccagttttgcaacatggcaaagtgaaatgtgaaaggcagattaaagttccagtactggctgagataattaatggtttatgattttggataagttactttaagtttttcagctttagtctcttcatctgtaaataaataggagttatttactttaaaaaatgtgtgaaagtaaaatagaatcacatattcaaaaatgcctatctcagtatttggttcatggcatacctccaataaatgtttctttgtccccttcccacttaatattattgagattgtttatctagatgtgatggatcacatctggcataagtatatcatgggagaatttcttttccaagaagattaaatccttagtatatttgaatgaaactttattaaatagttattataaaatctaatctctattgaacactttctatgtacattagatattctgcatgaaatattacatttaattctgactgcaattttatgttatttctatcattctgttttgtagatttggtcattcatataaagaataaatggttatgcagaaatgaaaactaagtttgtcttattctaaagcctgtgatctcaaccatgaaattatactgtttaattgatattcatcaatgatgctaacatttagagatttaacatatatttgttttccagagagagagagagaggatcgggtgggggagggagagagagagagctagagagagaaagagagagacagagtggaagagaaaatagagaatatcaaaagagtatgacatggctataattgatttttattctgtacctaactttttgaacttgcccaagcagcagtatctctcagtcttactttttgtaatgtaaaactggataaatatgcttatctccaatgttatcttcaggattaaatgaaattatacgtttgtgtgttgtgtctaagcacatgtttatgtgtagtgtatagcattgccctattcttggcagagtaataaaatgagctgtccgtttttatagattgaaaatatttgaatcataatgccttataatggttgaaataaaaagtgaaccacttcattccaattccagcaatagcaacagagttggagctgaaaattataaaccctggggaaaatatagaacagctatgtgaaatcacagaaaaatggccaaaagaaagtagaaactggaagggatttgatccctgaagaaaagaactatactgggtgagatttgtgttcatgtggctttttgtcagaggatgctccggactcacgtgataccagttggctggaactgaagccaaaagccacagacttactggcttgaggagtcagatgatgaggtttgagtctacaagacagtcatgaaaatgaaagaggaatttaataaaggagggaacaacaaagggaagaagcctcaactctgcatatctgaactgttcccaaatctttggcttactcctcaacagtacttacatgagggaagctccaaacattctgaaacaacataacaactggcaggctaaaagaacccagtagtaagtctagctgctgtccaccaccagtgagacagatcgtgaagttagtctggacaagttaactaaaaataacattcttcagaggaagataacagagtccagagtttaatacatgtccacaaacttcagttgaaaataataaaaaatatgcatgcaaggaaatatgagaaacaggaccaaaagtaaaattaaaaggcagttaatattaaataaatgatgagatgtctacatgttgcatttagcagataaagactttaaagcagtcatattaaatacgttcaagcacttaaaggtaaatatgttttcattggaagaacagatgtggaatatcagcatctgtctctatctacctaatatatattggtctatcatctatcaagagtaccaaatggaaatttgaagtacagtttctattgaaagtatattgcttttataccatcataaaatcataagttgagaaatcataagtcagggagcatattaagaggtcaattctcccctaaattaatgtatattttcagtaaaataccaaagtctcaagaggctgttttatattaaattacaaaatatttaaaaatctatatggacatatggaagacagaataagcaaaacagtcttgaaaatgatgtctataattgaagtatttacactatttgacatcaaagtttaaattaaagtcagagtattcagtagtgtatggaactgacacgagaattgacaaatagatcactaaagcaaaagagtaagttcaattaacttttagcaaagttgccaaagcaattcaattggtaaaggaaagcattgttaataaatgatttaaaaacactgttcaattgaatgagtgtttgtgtgtgtatgtatgtgcatgtcacaccatacaaatcaattcatgatggatcatagacttaaacataaatacaaaatttaagagtggaaagatggttaccagaggcaggaaaggggagtggggagggggaaataaagaggagttgttgaatgggtagaaaaaacgtagttagacaaagtaagatctagtgtttggtagcataatagggtgaatttaagtaacaataagtctatatttaaaaataaaatagtggaattggaatgtttctaacacaaataaatgataaatgcttgtggtggaagatatcccaattaccctgatgtgatcattacatattgtgtgtttatatcaacatatcaggtgtattccatgaatatgtacaactattatgtatcaatagaaattatttaaaaatgtataaaacctataaagcttttaaaagaatacaaaaatatatcttcttgacttatagcacaataaagaataaccaaagcattaaaaataccatgtaaactgcatccaaatgataagtatcctcatgaaaagacacttataatatgcacacaggcacgaattggaataaatatgcataaaatctatattgggtaaaggctggcctagaatatataaagagctcctacaatttaattattaaaagacaaatgaatagaagaacaaaggacatgaacagacacttagatcataaaggaagatatatgaaatggcaattagcacatacagattgctcagttattagtcatcatggaaatgtaaatcaagaccctagctcagttattagttatcatagaaatgtaaatcaagactgcaatgaaatatcagactacacaaattaaatctgctgaaattaaagacttaaactgtttcttgctgagcgtatagaataactcctatactgattgaagtttagaatgatataatcactttggaatgtgttttttgacactttcttatagttatacacaccacttactccttaacttggcaatatgtcactggatatttacccaagagaaattaaaatatatccatataaagacttgtttatacgtactcacagcatcattattcaaaataacccaacattgtaaaatggaaatatccatcaacagcagaaaagataaccaaacttgtgtatttacacaatgaattctgaatataataaaaaggaacaaactagtgatagatgcaacaacatggctgaatagcaaaagcattatgctgagtaaaataagccaacatacgatttcatttacatgaagtacttaatattgaaatctaatgatgcacaaatcagaacattggtgctttgtgtagagtggaaagataactttctcagattactttaatgtttcttatctttatagattatgggagtgtgcattttcaaaaactcattgaatggtacatttaatatttgtgcatttcaccctatgtcactactcacactcacccctcatacacacacaataactgtatgtgaatgtccttccaatatagataggtagataggtaggtaggtaggtaggtaggtaggtaggtaggtaggaaggaagatagatagagacacacagatacacacacacaaatacttccttgttctactcgttaagagtacctcacagcaatgtcacgttgattgcaatgatcatgactatctcgcagatcctggttttcaaatatcattctccaataaaaataatgaggactccttggataaatggatggttccagggcctgggtagggaaactacaacatctgcctagaatatttttttccagaaagtaaatgctttctcaaagaatgttagatacaggtggaaagcacccaggggccaaactgaagaagctccaaatgtacacacctggcacaatttgagtatcagaaattagtaaatacagtagaagatcataatgtgcttaataaagtaggaatctatgaacctaaactgatataaggaaatgaatcaatgagagaaaagggaagctcttccttgcaataaacaaaaaaatgtacaaaaaagaagaggttggaaagtcactaaattgtaggtataataataataattgcttcagccaaaaatgatgaatatgtgctaccactaatgggtaatattttgatgaggggcatcataatgacataatgtcaaagtgttacccactaattatttattaattaccaaaagagaaagcatgaattttacagtggataaatgttgtgttcagcactttaatcaaattattaaagttattatcaatattgggttaaaatgacaccatgtgcctcctgacatgatgtactaagaaggctacacatgacctctatggcattcttgccaaaaggacataaactcctctaattatgagaaaacaatgggatactcaatatgaaggagagtccaaaaagaaatggcctttcctctttgaaaattttaaggggaagaatgacaaataaaagcagaaaaaagacacaattcatattagagactaaagcaatatgacagtatggcaactaaatgcaggaacatggaccggattcaagactggatcctgtactgggaaaaactatggaggacataatgaggacataatgagaatgatttatgttagtattaaattttttgattttggttttgataattattgtgtgattgaatatgaaaatttccttgttcttaggaaacaatgtatacactagagtgtatatgggtgagaaagaatgagtaaatagagcaaaatgtaaataattagtttatcttggtgtattagtcagggttctcttagaggtatcggggaacctgccctgatagtcatgtaggttcttttctattttccctaggcatcagccagcttgagaaataaagggacagagtacaaaagagagaaattttaaagctgggcatccgggggagacatcacatgtcggtaggttccgtgatgccccacaagccataaaaccagcaagtttttattagggactttcaaaaggggagggagtgtacgaatagggtgtgggtcacagacagcaagtacttcacaaggtcatagaatatcacaaggcaaatggaggcagtgtgagatcacaggaccacaggactgggatgaaattaaaattgctaatgaagtttcaggcaccattgtcattgataacatcttatcaggagacagggttttgagagcaaccggtctgaccaaaatttattaggtgggaatttcttcttcctaagaagcctgggagtgctatgggagatgggggtctatttcacccctacagtctacagaccataaaagacagccacgcccaggggggccgtgtatagacctacccccaggcacgtattctctttcccagggatgtttcttgctgagaaaaagaattcagcgatatttctcccatttgcttttgaaagaagagaaatatggctctgttctgcccagctcaccggcagtcagagtttaaggttatctcttgtttcccaaacattgctgttatcctgttcttttttcaaggtgcccagatttcatattgctcaaacacacatgctctacaatttgtgcagttaagacaattatcacagggtcgtgaggcaacatacatcctcctcagctgacaggattaggagattaaagtaaagacaggcctaggaaatcacaagggtattgattggggaagtgataagtgtccatgaaatctttacagttttatgttcagagattgcagtaaagacaggcataggaaattataaaagtattaatttggggaactaataaatgtccatgaaatcttcacaatccatgttcttctgccatggcttcagccggtccctccgtttggggtccctgacttcccacaacatagagggacagaactaataggatatatatatatgtgtatatatgtatataaatatacacatatatatatcctattatatataaaatatatatatactattatatatataatatatatcctattatatataatatatatcctattatatataatatatatatcctattatatataatatatatcctattatatataatatatatatcctattatatataatatatatcctattatatattatatatcctattatatatgatatatatcctattatatattatatatcctattatatatataatatatatatcctattatatatataacatatatatcctattatatatattatatatatcctatttatatatatcctattattatatataataatatatatcctattatatataatatgaatgtatatatatgagtttattaagtattaacttacacaatcataaagtcccacaatacactgcctgcaagctgaggagcaaggagagccagtccgagtgagtcccaaaacttggagtctgatgttggagggcaggaagcatccagcatgagagaaagatgcaggctgggaggctaggacaatctctcatttttacatttttctgtctgctttatattcccttgaagctgattagattgtgcccaccagattaagggtggatctgccttccccagcccactgattcaaatgttaatctcttttggcaacactcacacagaaacacccaggattaatactttgtatccctcaatccaataaagttgacactcagtattaaccatcacacttggcaaaagttatattagtgtctacagtctgtataatttttgcaaattttctataaatttgaaattatattgaaatacataggtaaaaatgcacacctaactttttccattgctaattatatagtgttggttctggagaatgatgactaatatatcattaatcctaaaactttgaaaaaaaaaggcagcttaccttcttagaaaactaaaaatatattaattaaagaaaattagcaggtttttcagtttccatgtagttgtgcagttttgagtgagtttcttaatcctgagttctaatttgattgcactgtggtctgagagaatgtttgttatgatttccattcttttgcatttgctgaggagtgctttacttccaatgatgtggtcaatcttagaataagggggatgaggtgctgagaattatgcatattctatcgatttggagtggagagttctgtagatgcctattaggtctgcttggtccagagctgggttcaagtcctgaatatccttgttaaccttctgtctcattgatctgtctaatagtgacagtggagtgttcaagtctcccactattattgtgtgggagtttaaatctctttgtaggtctctaagaacttgctttttgaatctgggtgctcctgtattgggtgcatatatatttaggatagttagctcttcttgttgcattgatccctttaccaatgcaacttcaatgtaatgctcttctttgtctcttttaatctttgttggtttaaagtcttatcagaggctaggattgcaaccatgcttttttctcttttttttttttttttttgctttccatttacttggtaaatattcctccgtccctttattttgagcctatgtgtgtttttgcatgtgagatgggcctcctgaatagagtacactgatgggtcttgactatccaatttgccagtctgtgtcttttaattggggcatttagcccatttacatttaagattaatattgttatgtgtgaatttgatcctgtcattatgatgctagctggttattttgcccattagttgatgcagtttctatcatagtgtcgatggtctttacaatttgatatgtttttgcagtggcagatactggttgttcctctcctgaacgactactgggtaaataatgaaactaaggcataaataaagatgttctttgaaaccaatgagaacaaagacacaacgtaccagaatctctgggacacatttggagcagtgtttagagggaaatttatagcactaaatgcccacaagagaaagcaggaaagatctaaaattgacaccctaacatcacaattaaaagaactagagaagcaagagcaaacacattcaaaagctagcaggaggcaagaaataaataagatcagagcagaactgaaggagatagagacacgaaaaacccttcaaaaaaatcaatgaatccaggacctggttttttgaaaagatcaacaaaatagatagaccaccagccagactaataaagaagaaaagagagaagaatcaaatagatgcaataaaaaatgataaaggggatatcactactgatcccacagaaatacaaactaccatcagcgaatactataaacacctctacacaaataaactagaaaatctagaagaaatggataaattcctggacacatacaccctcccaagactaaaccaggaagaagtcaaatccctgaatagaccaataacaagttctgaaattaaggcagcaattaatagcctaccaaccaaaaaaacctcaagactggatagattcacagccgaattctaccagaggtacaaagaagagctggtaccattatttctgaaactattgcaaacaatagaaagagggaatcctccctaagtcattttatgaggccagcatcatcctgataacaaaacctggcaaaggcacaacaacaacaacaaaagaaaatttcagggccactatccctgatgaacatcaatgcaaaaatcctcaataaaatactggcaaaccaaatccagcagcacatcaaaaagctcatccaccacgatcaagtcgccttgatccctgggatggttcaacatatgcaaatcgataaatgtaatccatcacataaacagaaccaatgacaaaaaccacatgattatctcaatagatgcagaaaaagtcttcgacaaaattcaataccccttcatgctaaaaactctctcaataaactaggtattgatggaacgtatcccaaaataataatagctatttatgacaaaaccacagccaatatcatactgaatgggcaaaaacgggaagcattccctttgaaaaccagcacaagataaggatgtcctctctcaccactcctattcaacattgtattggaagttctggccagggcaatcaagcaagagaaagaaataaagtgtattcaaataggaaaagagaaagtcagattgtctctgtttgcagatgtcatgagtgtatatttaaaaaaccccatcatctcagcccaaaatctccttaagctgataagcaacttcagcaaagtctcaggatacaaaatcaatgtgcaaaattcagaagcattcctatacaccaaataacaaacacacagagagccaaatcatgagtgaactcccattcacaattgctacaaagagaataaaatacctaggaattcaacttacaagggatgtgaaggaactcttcaaggagaattacaaaccactgctcaaggcaataagagaggacacaaataaatggaaatatattccatgctcatggatagaaagaatttatatcgtgaaaagggccatactgtccaaagtaatttatagattcaatgctatccccatcaagctaccattgactttcttcacagaattggaaaaaactactttaaatttcatatggaaccaaaaaagagcccacacagccaaggcaatcctaataaaaaagaacaaagctggaggcatcacactacctgacttcaaactatactacaaagctacagtaaccaaagcagcatggtactggtactaaaacagatatatagaccaatggaacagaacagagtcctcagaaataacaccacacatctacaaccatctgatctttgacaaaactaacaaaaacaagcaatggaaaaaggattccctatttaataaatggtgttaggaaaactggctagccatatgcagaaaactgaaactggatcccttccttacaccttatacaaaaattaactcaagatggattaaagacttaaaccaaggacctaaaaccataaaaaccttagaagaaaacgtaggcaatactattcaggaaataggtatgggcaaggacttcataactaaaacaccaaaagcaatggcaacaaaagccaaaattgacaaatgggatctaattaaactaaagagcttctgcacagcaaaagaaactttcatcagagtgaacaggcaacctacagaatggtagaaaatttttgcaatctatccatctgataaaaggctaatatccagaatctacaaagaacttaaacaaatttacaagaaaacaaccccatcaaaaagtgggtgaaggatatgaacagacacttctcagaagaagacatttatgtcaccaagaaacatatgaaatctcatcatcactggtcattagagaaatgcatatcaaaaccacaatgagaaaccatctcatgccagttggaatggcaatcattaaaaagtcaggaaacaacagatgctggaaagcatgtggagaaataggaacacttttacactgttggtgggagtgtaagtaagttcaaccattgtggaagacagtgtggtgatttctcaaggatctagaaccagaaataccatttaactcagcaatccaattactgggtatatacccaaaggattataaatcattctactgtaaagacacatgcacacatatgtttattgtggcactattcacaatagcaaaaacttggaaccaatccaaatgcccatcaatgatagactggataaagaaatgtggcacatatacaccatggaatactatgcagctattaaaaggataagttcatgtcctttgcagggacgtgcatgaagctggaaaccatcattctcagcaaactaacacaagaacagaaaaccaaacaccccgtgttctcactcataagtgggagttgaacaatgagaacacatggacacagggaggggaacatcatacatcagggcctgtcgggggttggggggtgaggggagggatagaattaggagaaatacctaatgtagatgaagggttgatgggtgcagcaaaccgtcatggcacgtgtatacctatgtaacaaaactgcacgttttgcacaggtaccctagaacttaaagtagaataataaaaaaaagaaaattagctaaatccattatgacagaggaaaactgagtcattatgaatcttttagatctagaactttacagttctttaagcacaccatttactaaagtctttacctgccatgggtacactgttttgtagtttatttaaagataaaaataaatgcatttaatgtgatggtgtgggggaatgatcacagaagagaatactaagcactaagaagaaatttaaatattgtatgttactatgtactcagaaaaattttgacaataaatactctaaatgttgtaattaaaaactattgaatattgatattatataggaggttgatataaatatcaatattaaaataattacttttcagaaaatcactacatttaatacttttgacctccattccttttcatttaaactttttggttttcatttgagattgttttatttaaatttatgaacactttcttcatctgcagtacagcaaattttcttgctgtatttcagggacagaagcatacatttagatttggtggcagagttggtttacctctggccatataagtaaaaaatatctgttctgcttaaaacatagcacttaatattactgttaatatttcaattatgaatatatactgagtgatttacagattagctctttttgataaaagtgtattgataaaatcatgagtgctcattaatcatgaatttatttcataatataaatgtgaattcaatcttaaggtaaattttaatgcacttttaaatatcatctgacatacattttgaggttcattttatgtttaaggaaataccttttctgttcatatttgccatcatatttacactcacatccttccaaatccttaatttttgctgactgggacaaattagtctgactcaaaatattttatttactactttaaatatatttaaatgtttttaaaaatatattttaaaaaccttaaaagtataattatgctcaaataagaaatctgttcccattctatatggcagttaaattgtttggtttcctataaaaatttggccaaattatttgctaaattgtttttgccaaattgaataatttggaggttttgaataatcagaggtttttgaaaatacttatatcagaaattaaaactaagagatgaaatttaatattttaatatatatttatatttatttattgatttgaatttatatttaaatatataagagaaatatacatatatctctcttactcccaaggcaaattaaaattttctaaattgtgtttgccagtaactttccaataaatcaaattaatatctaaattactattagaaatccctatttttaattttcttttattaaaaatttttgagatctctgttttcaaaggaccaaaaactttttgatctgattgcctttcatctgtgaaactcaattatggttctatcattgggaatcaggaaagttattccctgaatgacaatatgggtcaagatcacctttatgcttgttagagatgatgctcatccagagacctttagcttaatgacccagcttcttgtgcataagttacagtctgggactgctgcaggaacttaagaagcttcattattcttttaggccacaggggaaacattaaattaacaaaaaaggaaggaaaaaaccaaaatatcatgtcaataaccacaaagaggctctagcctgttgcatttctagtaccttagctatgaaataccacatggagttgtgttttggtaaattttgtgtaacttctgctgtcatttaacttttcaacatgtctaaatctattacatagtatttcatagtaataacttttttgaagttagaaaattattatgtcatactcatattctgagctccagttgccttcactgcaaagtagaagctggctctaatatggctgaggatgaatcccaggattgaaagtctgaatctcaagagagaaatgagaggtaaagccatgaatttggatgtcatggtgattggtaaaaaatgacatgggtgggggtcatccaaggagtgtttttagaatcagaaatccagaaagctgaagatgaggcctttgaatcactgaagcagagcagcagatgtcgtagatgaaaatggagagaacagcattctgaatagatagaatgcattcaacagtcaagtgacaaatggagcagagagcccaatcatcaggcatatttaagagttgattgttgtttccgcaattagaagatcagtggatacttcaaaagaaaaacatttcagtgataaactgtggatgaaactgaaagtttgggtattaattgcaatagaaaacatggtagacagccactgtcccaagttttcccagtgtcccctgccatccccgctgccctctatgctccacagaactcagtgacatccccaggatccagtaactaaaaggacactcttagctcaataggtgcttcaggcccttactcaggctcttgtacccatggtgccatactgattattcaataattttcataacacccctacagaagaacacaaggttaaaggaagtaatgtgttttgtttcgttttgtttcttgatcttgtttttaagaggagaaatattatgcatgtttacagagtgaagggaagagttgagtagagatgtaaatgttaaaatcaaggagaaaagggatgagagaagaacccagggtgcacagaagtagacaataactttgagtggggagaagacagcctggaatagatgaaaagattggaaatgaatatggacaactttgtaccttggtgggtaggaaggtgacaaattccctacgctggggcttttatattttccctgagttaggaggcactgtcgtcgctatgcaagggacagcagcaggtcagaagctcagggagaatggtaaacatcttccataaggaatgtgagacaattgttctttctacttctattacagagtagagtttaagctaggaataaaatactagtgtatgtttcattttcctagtttttaaaaatgtatctcaagagcactcaaaataacatcatgaaatagagccctgaaccatgtttcccatgctcctacatacgtatatactcaaggtttttgttaaggatagtatttataaaaatatgattactctgtatactgcacacattaaactctattttcttcctcaacagcatgtagtagtcattccagtgagctaatgtgtaaatatctaactcacattttttggtaatttcataatattcaataatatgcttttgccaaattgattctgtcatttccatcttaatgaacacttgtttatttatttagtcccacattacaatgcatagtaaataacagcatctatctttataaacatattgggatttcattaaggattgctcagattttaaaatttatattcatatttcttggaatttcagtatgataacagacattttccaaagggttctagtaatttacaccctcactggcaatccatgaaaacccatttctctgcctccatatcagcactgaacaatattattttgcaaccgctttggagtagagggtagaatagtagggctagtactctctttttatgtacataacattgaaagttaatcacctgtagttaacaggtggttaatgttatatattttaaaaatgtaatattttatatgtaatattaaaaaaaattatcaagcaaattgttcagaaagagtttcctgactatagagaaaataagctggttcaaacagtccttcatcctgcaatgctttgggaggacaatccagtttttctgtttaggaacctttgcatacccattatcctactgtgttggcctggggctgaaataagagctttagaaatgtgagaagatgtaatcatttcaattaatatgaattataagtcatgaaaagaaggatgactaataattttttttcaaattgtatcattcagtatcatcaacaaggtctcagaatttactaataccaagttcatacacaattccatggcaatgctgttagacatcatggcaacgaaggcatctatcatggtctggaacttgctttttataattactcttctagattcttctttccttatgcactagcaatgaggaattagtcacaattcctaagatctacatatacattcctttttgtaataattcaaactatgtgaatgaattagacttcgtttcccccatccctggctgtgaaagctctatttaactgacagggtccagcttaatggcaactctttactgaagtgcttcaacattaaaaaaaaattttctacttttttcaatgaaatattatattttttattatcaccatacttacacatttttgtctctcctactagatttagaagttttgagatccggcactttgacttattcatctttctctttagcaaccatctgtattatctgacacttagctcagtgcctgatacataggagatactcaataacagttgaattaatgaaagtatatgtggatgatgtagtaggctagctaaatcaggttagggaaggtgcagctgtcaatgtccatctctggttataaatcctgggaaaactgtattaacggtttgaggatataatgaagcttgcagtcagtcagaatgccctttcttaaaaccttctgagaataaaacaggccgattgattacacaaacaaaatatgagactacaagggaaactggccctgtttgttcccctcccctgcaagttaatcacatttgaccatgtaatttcatacttacaatgcattttctatttacgccataccagatatgctactggaggcactttacttaatttttaaaatttctaatgctagcacacaatgacataagttcctatttttatttttttttttttaaaaaacatgtttagatctttaaatatttacaaacattcaggtatccattttaaacacttgggacatattcctgaattacggttaactattatattgattagaaaaatgctactggtaacagtacaatgtgagtctagaaaaatgtgtctcatttttaatgctttgttagtatactgtctttcatctcataactgtggatatatccctgagaaccagaaaaaatgaaataataatactttgaattgattgttagctactatttctggaattgtaaaatatatgattttttttttatttttcaaagagcgtgaaagctagtttcactgcagatgctaatacatagagagcaatttatatatgaattccgaaggggcctggagggaagagctttttcacacagacagatgaattaggatacttagctgacagggtcatcactacatttcttatcggaaattctactgcagggctagaaaatattttttaaaaatcctcaagtaggctgtagcattcaatgaatcatgtcataaattgaatggaaagagaatctgagcatgtcttgcagaatatggagtgagaaagagacctgcaacatcaggcatgctagataaagaaaaatatcttaggccagcaaagaggtcttttgggttcgaggtagaaaattgaatcgttacgtttaagagagtgcttcagtagcattttacataaaaaattcatctgtttttcaaagtaatatacgtgctaaatgctgtttatgtcttcttcgttctgttgccccacttaatgattatagatagaaattcaatcattgtagaagtagtcagctttaacaaggtggccaatgaataacattaatggtatttgctctttgcaaataaataagaaggcattggatttatattggtaatttagactagcttagaaaaccaactgaaaaaaaaggaagaaaggaaaaatgagggaaataagaacagaagaaaggatgggaggaaggaagaaaagaaagcaagtgggctatctcaagtagaacaaacacaagtacaactgacaaactatttcagtgagtcttggagcatatgggcagtttgaggttctatttaatgtgtcaagatgtactgtgtttttgagatattttagtcaactggacttagtagtgattcacactctccacagcatcataaaagtttcagtttgtgccagggaagataaactattttgaagtaagtttgaatttcaattctaccttttccccatatctgcatagacacggctttattgtagtacaggaattttgacactttctttggtttttgtccatgccatgcaactcttaagtcttacagaattaaaccatgttctaccattcaagaagggtttcttttctagttcataaatatttgggtttagagcaaaggaatgagaacatatacttagaaacaaggcaattcatttgacatttatctgattgatggcataaaagaaataaaggagaggtaaagagtgaaagaatgaaacattttatttcaaaagcttatcattaaatatatgttgtccttaaatgcttaaaaattctataatttgaattgtgcttctctaatattgaacactgatatttttaaggaaactcacagggcaaactagatgcttaagaatgttatttagccgggcgcggtggctcacgcctgtaatcctagcactttgggaggccgagacgggcggatcacgaggtcaggagatcgagaccatcttggctaacacggtgaaaccccgtttctactaaaaatacaaaaaattagccgggcgtgttggcgggcgcctgtagtcccagctacttgggaggctgaggcaggagaatggcatgaacctgggaggcggagcttgcagtgagccgagatcgcgccactgcaccactccaacctgggagacacagcgagactccgtctcaaaaaaaaaaaaaaaaaaaaaaaaaagaatgttatttaatttctattctcagtaacagcctacattttagttttatgcatgttgtttgagatttctaaaacatctgatctgaggcaaatattgaaaatgagacgtgctctttaaagttgaattatctttcaggatacattttattttattattcagataaatggaatccttttaataccctaaaatgaaaatagtttaacaatatgaattgtcttttttgttacgagtcatgtgattttaattggcaatatttcaatgactgttttacttttagcatctaagtgtctcctttttttctatttttaacggttatttgaataatctgccatagccatgaatgttaactgactgtgtaacaagtcacaattttagaattgtattctaaacttttgctgagcaacgattttgtctgtgctacacaccagaagaaacataaaacttgattaatgatcctcatgtttctaagtatttatagtcaccgctctaagaaagacaaatatacacacaaaattacaaataagccaaaatattaaactttcataatggagatataaacatgtattacagattcatgagggagggagaatatgttggatgaaatatcacattaaaagtgagtcactggaatctagccacaaaagtagtcaagttggtcagtatgtgaaggatcagggacactacaggaagagggacaaacatgaacacagctgctgaaatgtacaaaggtgtgatatatgtacgtaatggcaaataaactagtattgtctggggtcttgggaagcttggcaaaaacagaggaaaaataagatttccctcaccttgtaatagtcttcagatactgttttaaaacaactgagaaattacttatagaaaatgtgtataccagcaaagctcttaaataggggggtcatagagccagaagacatcttttggaaaacaactgtagtggctgtatgaagagtaggtggctggcccagcagattggaggaagggagatacctttggatgcatctggaatgtttctagggaagcataagctttccagatgcaatgttaaagaaaagggggaaacagctgccaaagtaaaatgtagctcctgttgcggtgacttgatcactaactggtataagaagtaagagagcatatgaaggattaaagatgaatgtgaacaccaagccttcaaggttcagtggcttcagggatagttatgcctttaatagataaagaacacaggatgaggattgggtctgtgaacaaaactattttaggtatgggaaaataatgtatatttgagagttttgcgtttatctgatgtgaagtctcatggtagatgagattttaccaggacaggaggtaaaggataagagaatggaacagatgctccagcaaagtgcagtgagaaagaatgaaagggatgtatggaaaatgatatgaaaatcttattttagagattttgtaagaacagagtttaaggaaaaggagtggtaatcaacaaatttggaaattacataaagtcgaagaaggatgaagattgaaaagaggttgatggatttgaaaagcagatcatcatgagtttgtttttagctttgattccctgaaagctgagattggaattcttgtgcatgtgtgctctctgcggaaacttctaaccttactagggaatcaagacaaggaggggaacaagatcagatggagatgaggttcagcctgattccagggagacctctagagtgtgaattgcacccgagtcttctcttgagccaaaggcctgggctgtagaaccgtacagcaactaggcaatggctatgaacaaactctgcagtggccactgagtgggaatctagacctcagggaggcagttctctgcattcaagggtaaccatccactgaagggtgcacatgtgaattaaaaagtcctggaaatttaaccatcacctctatattggaataacctttgatccttgtgtgttttttattttgttctgtttttgtttttgtttttttttagacagagtctcactcactctgtcaccctggctggagtgcagtggtgctatctcggcttgctgcaacctccacctcccaggttcaagcgattctcctttctctgcctcctgagtagctgggattacaggtgcccgccaccatgcccagctaattttgctgtgtgtatttttaagttaatttgtgttagaaaaatatcaagtgtaattttctggaaacccatgtcttttaatattgaagagttgtaataaaacatttctggggagaagatctgaaaaacacgggacttattcatataacctagcaaaatatggaattgtcattttagggtagctctaataattactatacagtgattctccaccacaaaagaatgctagtaataagctcatggattccttttttatactgtaataattaatgcctttaatttttgaacactgagattctttatgtttctatttttgttttaagtatagtgcaactttttaattcattggcttcttagtgtcacatcttgacacacaactgttagatttgcctttaacctaaaaatcagtaaggtttttttttaatcgtttagtcttttttcagctttattaaaatataattgacaaaactgtacatatttaaagtgtactgcttaatggcttgatacacatatgcatttccattgtgaaatgactaccacaatcaagttaactaacagatctaccacctcacatagttacctttttgttgttgttaagaacacttaagatctgctctcttagcaaatttgaggtatacagtacagtattattaactataatccacagttatttagtcatttaactttcatgagtaaatatagtttgctataaccaggaaggcacagacaagggcttttggctcttcttctgcaactctgttccaactgcaagagtttgtggagaaaagaaccattccctcaacagtaccaagcagtaataaaaatattaaatagtattaccgtgtctgagtgcctttcctgtatttcgtaacttaacctaataataacccttttaagtgttgttatcgttcctgaagagataaaacttggttaaaatgtaagatttgtcacttactagctgcatgatttgaaaagagttgtttaaattacctaagcttttgttttctcatcagtaaaatggagataatagtaggtgcctcatgggggattattagatcacacttaaaattggatcatagttaatactttaactggggctttaaccatcatcatttacatcatccctattccattttctttccttttggcagaaaggcatatagtgaaatctatgcaaattaaatgaacatatgggacactttctttgcagaaagagttgtggggctccctccacatgacctgaaaagtacctatatggcggtaagacactttacatatcccctagtttatataccctggcatgcccatatgacctgctaaatcagacaaacacaccagattctaatatacagtcatattgattttacaacttctcaattaacatataatcctaaactgcatgctttatgttgaagaaaaaaaaacagcaactaatacactatcatagtaccgccttaaatgctagtttaacctgattctgccagcgtaacaattttgagttgtacataagggttttattgaactttttattcttttattggttatggtttagtaacttagaatttccttagaattgatataagcatgtaaactgaagttgatggtcaagtatacctttataataagctaagcagctttagggctcctagatcctttgtgaagtgcaagttcaccgagagaagtaagtactagtatgactaggcttgtctatcattggcttttgaatggcttttttactgaagacaaaaaggaaggaggaactaagtgtaatttctaaatacttggatacctctgcaagtattgtcaatggttatttctccttcaagcactctcccattttctttcatcagattggccagtctcatctcaaatcctctgcagaaaatgttgaaggtactctagggtgagataatagttttcaatgtttatgggaattgaagaggttttgggaaaatggataatattattggaaaaaattagattgttggagtgaagattaagttcaaagagagaatgtattataattttgtgcaactgaaatgggtgcgggctgggcacggtggctcactcctgtaatcccagcactttgggaggctgaggtgcgcggatcactaggtcaggagatcgagaccatcctggctaacacagtgaaaccccgtctctactaaaaatacaaaaaattagccgggtgcggtggcgggcacctgtagtcccagctactcgggaggctgaggcaggagaatggtgtgaacccaggcggcggagcttgcagtgagccgagatggcgccactgcactccaagcctgggcgacagagcaagactccatctcaaaaaaaaaaaaaaaaaaagaaatgggtgtgaaaatatcgttgatgattagtaataattactagatgtagtgacttttaaaagactcctttaaggatggctgttaaataggtttctatatgtatctttattataattgtgtgtgtgtgtgtgtgtatgtacacatacacatagataagaaaaattatgggctttactgtaagtacatcatagagttcaactgaaaaaaatgctgtcaaagagcaaccatgtagaattaggcatggtttgctccctctcagctgctgagtgttacatttctggtttagaggggagaagtgttccttttccacaagacttgatgtaatctttctactttggttccaaatttctaacctaagaataagaagtaattaagatcaaaagaataatgagaaacctcatccgtggttaaaatatgtatttagtaaatattacaggaagagacaccagattatttagaaatagaataatgaaacaaaactttccttattcttcttggttgtataatcagaaattacatctcctggttacttgatctctgagattagtttctaaagttagacatattttgacaggaaattttaactcattttattttcaaaatacataccttttagtgaccataaatctaatttttgaagaatattatttatggtcttatagtagaaaatacagcctcaatttctgtactctccatcactttggaaaagatcattgtagttgagcaaaatgcttttaatagcgaggtattgatgtggctcttggctgttattatgtaataatgtcatgtaattttctgttctttctaaagtgataaaaatcagttcacagtgatggaatgggctgctgcctttcaggcctaaacttttcacataaaaatcataattattaattggaactaatttcggaccatgcatttacatgccagttttcatttgaatgtcaattttgtcccttactctcaccttgaaaacataacttgctctattttattaggaaggaagcacaagcctgtagtgtattctcagttcctgtgttggataaacctggcctacagttggtttatttaattattgtttgaagtaatatttattggatgttctcgcataccgaaaactagtagtggaaactaggaatttaaaatgtaagtcggcttaatcctgtccacagaaacctatgctagtgagggaagagttacagtaaatgcagtgggatagacatacctatgggaatatgactggacctgggaggggctccagcctaaaggatggttttctgaagggaggtgggcctataagagttagaagaacagaaactggaaatagaggagaaagagaaagtagaagggaacaatgaagagggtagaaaagaggatgttctaaagtgattctgcttctttcataagtgaggtatatctgttgttaactatatttgggaaatacgatatttgaattaatctctcaaaccatagtagtaaagctttccaatagattctgaatagtatcatcttgcttctgagccagagacattctgatgattgattcatgaggagttctatgtacttgaaagtcaattgttacgcaaataatttacaagatagtacaattttagctttgtataatgagtaactttaaaaaatcagatattcctgaaagtatattttatgcagtatggttatttctgaaacttaatataatatagattgctcgtattttatttattatcttgaatcccagaatgcttaaatgtgaactattttttagaggtgagagggcagatcgacaactgccgtggaaaaattagttttggcttattgaaaggaggtggtcagcccctttagcttaccctagtatctctgcaactctttccttctacctgtgtgctgcaaacacattgctctttttctgatctaataaagaatgcatttgcttctgctgggtttccacatacatgcctgtttcaaaaccatgcaattttcagcccactactacctgcccttttagtatgatgacatgacatgcatttctacacccagaattaccaaggctttgtgtctgactttccaggcttgtttatcccagacactgctatatagaggcactgccctccctcaccaggctgccttggaaagaaggatgagtgaatttccatccattgccaataaaccacacgtggtttaatagctctatgaacatttaaaaatatattttataccttccagtattttttcatatctagccaaattctatattcagagatttttttttggccaaacctcaataaataacattattaaagtttgtgtattctgtttgaattactggaggtttagagtcttaccggcttactgaactttaatgtatactcttgagtatccacagaacacagtttgaaaagagttgctttaactcaaagaaatatgagtttctgatagaatttcaggtaccttcaaatggctattgagcttttgatcgagggaaacctccaaaaattacataatctataaaaatctttttatgcttaatatcatctgtggtacattatgatgcatgtatcagaaaagagtggtcatttttattttactaactctgatatacacaaaatgatgtcatgtgaccatggaatattagagctattatgggactaagaaataattcataccttcagtgtaaagatgagaaaagtgagggacaaaattgtaaaggttattgctcactgtctcacagactagaggcaaagatgaggcaggtattgagatttctttcttctcccagtatatcaaactggcacttaattataatcttttaaatgctgattacttgtatctttcaacggaggtttttcagatcaataattgtttgaaagttacaacactagtatttggttgagataccatgactctcaccttgaaaggttagcaatgcttaacctttgataaccaacatcaattaatataattagctgatgataattagtatcattaaattaacaataaaaccatcactatatctctgacatccatgctttttgccaaatctgcctgaaatttataaaacaacctgggactattttacccctcaggtgacatttgctaatgtctggagccattcctggttgtcacaacaaagagttttctggttcaaactgtcaataatatcaaggttggtaaacccactaaagggatttaatgctgccctctgcccttaataaacccactaaagggatttaatgttgccctctgcaacacctatatgtaataaaagacatgtttcctatactagttgaaaagaagtctgatcttccctattctattgtatttcaaacttttagggatgtctctagattacagtatgtcatattttcatgaagaacttcaaatattctcatctatattttatagaattaggtcctcttccttttttttcaaagatctattttttaaaagtctaacctcacacaaatgccagtgcttttcctttgtgacttttcaagcttcatttgttagatatgtctctacatatgtagaaaaaaagatgattgttgtattttagattccaccattgatctacacaagaaaaaggttgttttgtgttatttgcatttcctggtatttatttttgtttggggctctatccttattaactgttaacaatttcatggaatatgaatagtcattttttatacattgaagaaagaaatattgagtccaggaaatacaagctagacacatacctgcctctttggagttgagccttctgcaggatataagtgagtatgtaaacaagatgcaatatgatgataaagaatatggaaggcactacaaatgcacataaaagggcctataatcgaggcttgagcaatcagagaggtgaggtctgagctgatacctggcaagtaacatggagataagtattgtttctgacagaaaaaagactttaaacacatctcattagagatgagatacagccagtgccccagaggtactgaatactgtaggcaattgtagcacaatggtaggtatttgtgtaagtaaacagatctaaacatggaaaaatacagtaaaaataaaatctaaaaggtaaataaaaaatacactcatatagggaactccaccatgagtggagctttcaggactggaagttgctctaggcgagtcagtaagtagtgagtgaatgtgaagaccaaagacattactgtacactactgtagactttataaacaccgtacacttaggctacaataaatttagaatacgttttcttttttttttattattatacttcaagttttagggtacatgtgcacattgtgcaggttagttacatatgtatacatgtgccatgctggtgcgctgcacccactaactcgtcatctagcattaggtatatctcccagtgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaagtcatccttttttatgtctgcatagtattccatggtgtatatgtgccacattttcttaatccagtctatcattgttggacatttgggttggttccaagtctttgctattgtgaataatgccgcaataaacatacgcgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagttaaaaaattaaccttagctcactgtgacatttttactttacaagcattagttgttttaatttttttctttatattcttactttaaaagcttttttctaattaaaaaattattttttaattatatttttatgttattttgttaaaaactaagactcaaacacacacattagcctaggcctacacacggtcaggatcatcaatatcaccgtctttcacttccacatcttattccattgaaaggtcgtcagggcaaatgacatgtatagagctttcatttcctatgataatagtaccttctttaaaaatacttctggaagatcctaggtgtcacttttttagaaatatgtccatggtggtttacttgttttttttttctcttcttatagatttgcttgtaagcaaataatgcatcatgaacatttctctctattaaggaaaatcttttggtgttggagtccatgttttaaaactttttaaggagcttgttgagacctgcaaaagctgcacacatcactgcattttcttgggagtatgtcttctctttttaggtttatttacaccagcctcaccataaacatgtgaataatgtttgaactgtaatgatactgcagctaggacctcaacaagtaataggaatttttcagctccattataactttaagggacccactgtggtatatgtgatccattgttagccaaacattgttatgtggagcatgcctatactttaatgagatattgcagaactgggagagcttcatttcagatattttcgttatgaaatatttgctgagtgcctactctaggacaggcaccattctaggcttcagaacaacagcactgaaccaaacaactgaagtctgcccttgtgtagtttacattctagtgtggtagtttattagtattattcatctctatatgctacttttcattaacagttttcatccttgtatacagtctgaatggtaagtacaagtgtttacatagactgaccaatgtattgaatggtaaattatggaatttttaaaaaattatagaaatagtaagttgatattaaattgaaagatgttaaaaatttattcaagaaactttgatattcagtctctaacttttcaagttttttggggggtttctctttctcatctgggggtataatgcttgatgtggatgagactttttcttggaagaattttattccttttttcatttaaaatatcatagttgatatggcaaatacattgatcagcagcacttacagaagggtaatttttttaaagaagcatgagaaattaaggtacatcttagaaaagtgattactctgcccttataccaagacacaataagactttatgatgggattacagcatggagagatttacaacagcttccactggtttagatacagctaaagaattaacagaggattggttggcagtctaaagaatggaaaatttaaccaacttctagaaaggtagtcagattattgtctgtattattcttcacacttctgaatgatgagtgtgctttccaacaacaacattcatgaagttgactttgaaatattttaacttaaaaggatcttacagttctttgaatccttatttaaagtgtcctgatatcagcttagtcatgttacaataaaaaataaagtcattcaagaaatttatactagagataaccatttctaggtcataacattttattggatacaatcagaaaatgtggtgtagttggcaaaccctacattgggttttgaaattactgtgctaccagtatgttccaatcagtgagaacctttcagccatgaacttttattgatttgtattcctcagagtaacataatagctttccttaagtcttccaatttcactatggttattttttttcctgaaatctctgctgttagaaggtttatttatgcacttactctgtcgctttccaaccccttcatggtttgagtcaagaataggtaccagtgttctatgagcaagtaggaaaaaaaaagaggtgctataaccaattaaattattctataaacagttatagtatgaatagttctgtaatcagaacaatacattttagcatttgcagaacaaataaagatattgaaaatttcttccttttttattttcagtttttgtgggtacataataggtatacatatttatggggtataggagatattttggtataaacatgaaatatgtaataatcacatcatggaaaattgggtctgcatcccctcaagcatttatcgtttgtgttacaaacaatccaattaaactcttagttattttaaaatatacaattaaatgattgactctagtccccctgctgtgctatcaaatactgtaataggtcttactcattctttctagctttttggacccattaaacattcccacttcctcccctcttccccctccccaaactacccttcctggcctctagtaactatccttctattctctatctccatgggttcaatagttttgatttttaaaagattctgaaaatttcaaccaggaaaagcaaaaacaagcaagtactctctcatccaatcacactagaaattaaattcatttttaataaataacttaatatttcaatgcttattttcacttttaaaacacttatttttataaaacatttttgtaaaatgtttatattttaaatgaggcttatttttgtaaaatttaagcctcaaatttatactgttaatagacatgttttcaacatttgcttaaaaaataggagtttagtttctagacttaacatatggtggttaaaatgagaattcagcactttcaagtcacacgattttttttctattctctaagatgttcactattttatgttgcctggaaatgtgaatacatgtattaaatagcaatctcgttgcatataccaattgatggtaattaaattgaagcatctctgttactattttaaaaagatactcatttgaattttttaatcctgttttcagtctttatagtctaaatttcagaaaatgcaactgtaaaattcgataaagacaatagctaatagatgttgaccgactttaccttctgtacaggtgagttttaacatgcttttctaactagctcctagtaaccatggaatgaaaccaaagaacaggcacagcttcaaacttcattggcttttcagctcttgagagaatagtcatatctaagcaacgaaattttgtttaatctaccttaaagtatctgtaaaatgtatactttcccccagccattacaaccatggcaatccacattcaaacatgcatataaaattagtcatcttttcctgatattatggagttatggaaaattagtcctaatgcctattttaaatgaagcattgtactttcctactgtgaaaaaaatagtgagattctaaatggatatgtgaatgagaagcaaaattggcgatattctctaataatataaaattaacatgtagaatcaaatccttgattcatgcaaccaaacaggttactgccagggcataagaaatagaaagcatgatggtttttcatgatatatgtctcaagtttcatggtatttcaaaatgccttaattctgaagacatcaattctgcagatctctgatgcctgcatgacctataccttaaatattatgcttttcttgatgattcagtctagtactgagtttttaattttagttttttattattatatattgagggaaattgtgtataaatgcatagattgtagatatataattcaatgacacacataaatatataaattcatgtagccaaaacctaaatcaagatacagaatatttctaccccctagaaagttccctttgtcccctttcagtcatttcccagctccaagaggcaacatgctttctggtctatatccatgtaatagttttgtctgttcttggacttcatatattttgtgtgtcactatttttgttttatatatattcttgagattcattcatgttgtgtgtattgatatttcattgttttcattgctaagtagtattccattgtgtggttcattgttttcattgctaagtagtattccattgtgtagatatacacatttaaaaaaacatatttttctttggatgaatatttgatgtttttcaaagtttctgctactttcagtaatactgctataaacatgtatgtaaaagcctttttgtgggcattcaactgatcttgtgtaaaggcctaggagtgaaactgataaatgatgaaatatttttatgtttaattttgtaagaaactggattagttttcacaagtgtgtatttattttagtctaccatcagcaaattgtgagaggttgagttgttcatcgtatgttcatcaatatttagtgttgtcattttttcaattctgcaagtagtaactctttgtggttttaatttgtatttacacaaaattaaagatgttaggtgtagtttcatgtgcatcttggccattcgtatatcttttttttttgaagtatctgtccaagttagaaattaggataactttttctgattgatgtgtaggatttctttacatactcaagctctttttcaggtatatgtatcttgaatatcttatcctagtctgcagcttgctgttttattttcttaatagagacatatcattatttctttttcatttttaaagaaatcctgttactataaatttattattctctatgtcctaagaaatatttcttgaagatggggcagattttctcctacgctttatatcagaatctttatagctttagactatacacctaaatttattgtatacctgaaattcatttgtgtgttatgatatagggcttaagctttttcttttttttttgacttatgaagtgattctatcatttattggaaagatttttctttccaatttgaattgcttagtgcctttgtttaaaattaaatgaccaaatatgtatttgtatatttctattcttttctattagtctatttatcttcccttacaccaatatcattttgtcttgttcaggatagtttttgaccagtattcagcccagagtaataatttctcccaattcatgcttcatcatgatttttatctttctattataagtcctgtgcatttctatataaatttttaaaacaacttatcagtttcttcaaaatagaagatgggattttgcttgaaattaatctaataaccaaattgaaaactggcgtcttaacatgattgagtcttctaatttatgaacatggatttagatcttatgtaatttttctcagaaatgtttagtagttttcaggatagtattactgtatatattttattatgttttgatgatagcaaatataattttaaaagaaatataatttattttcacatattggtcttatgtcttgttttatatatttcttatgattttatacacaaatgattttgttgtctgtacataaagatttctatggctgttttttttttccaaattttgtgtttcattcttttttcttgctttttaatactggctcaaacctcagtacattaaatataagttacaaggacatacatacttgccttgttcccaactatatattgaatggaacacattcaatatatagtcattaagtatgacatttgatgtatgattatgtagatgcttttctctaatatattaaaaaagttcacctctactcttagtctactctgaagttttatcaagaatacttacataattttgtcaatagaattttctacatctattcagatcactatatggatttgtcttttgaatgctattaattcaaattgttggttaatttggggatgttaaaataactttttattaccacagcaaaccccagttaattattatatatatatcttatgtgttactagaatttatttgcaatatatatttttaaattttgcatctgttttcataggttggttgtttattattgtttttagtaatatatttgctaatttttgcaaacaaggataatttgactactttatttccaatttgcatgtccctttatttctttcttttgactgattgctccaactaggatttgcttaggacttctagtactatgttgaatagcaatgatgaaagtgggcatccttttctagttccaggtcttagaggaaaggctttcagtttcccccatttagtatgatactaactgagggtctgttctatatggcttttattatgttgaggtatgttctttctatacagttttttgaagattatgatcatgtatgaatgttgaattttatcaaatgcttttttagcaccaattgaaatgatcatgcggtttttgtccttcattctattgatatgatgcatcgcattaattgatttgcatatgtttaactatccttgcatccttgggataaatcccacttggtcatgatgaatgatctttctaatgtgttgttgaatgcagtttgctagtatgttgctgagcatttttgcgtcaatgttcaccagggatatttccctgtagttttattcatgtgtctttggttttggtatcagagtaataatggccttgtagaacgagtttggaaatactccctcctcctctatttttcacagtagtttgagtaggattggtattagttctttttaaaatatttggtaaaattcaggagtaaaaccattaggtcctggatttttctttcctgggaaactttttattatgtttccatctcattacttcttggtctttacaggttttggatttcttcatcgttcattcttgctaggttgtatgtgtctaggaatgtatccatttactctagattttctaatttattggcctatagttgctcctaatagcctgtaatgatccttagaatttctaaaatatcaactataatgtcacctttttcatctctgattttatttatttaggtctttttttttttttttagtgtggctaaaggttagtaggtttggtttatctttttaaaaaacaaacttttcattttgttgatattttgtattttttcatttcaatttcattaatttctgctcttatcttcattctttcctttcttctatacttattttgcatctggtttactcatgcttttctagttctttaaggtgtatcatcaggttatttatttgaggtttttcacttctttgatcttggaaattataggtataaatttgcttcttctgctttttgctgtatcccataggttttggtatgttgtgtttccattttcatttgtttcagtgaatttttcaagtcatttttaatttctttgtggaacttctaaggatcattagaggctactatgagcaaccataggccaatagattagaaaacctagagtatattgatacatatagacattgaaaaatccacattatcaatttgttcttaaataagctttggtaatttgtctcttttaagaactttaagctgccaaattcgtgagtatagaattgttcataataattattatcatttaaatatataggttctgtaatgatatttcttcttttaatcagtccttctttcttagtcttactagtatgtaacaactttcttgatgttttcaaaggaacttttcactttgtgaatttactatttatttcaatttcatttatttctttcattacctctgttattttacttttttcaaattatgttttattttatttgtttcttattttttcattgacttttaaacatatgtatttttccaatataagaatttaaagtaataaattaccctctcaatttaactctataccacaaatatgtaactgtgttattgccattttattttattttttaattgacacataataattgtgcatatttgtgggtacatagtgatgtttcaatacacatagtgtatatatgtaattaccctgatgagatgatggtaattagcatatccatcattgcaaatgtttatcatttctttgttttgggaacattcaatatcctttgctaactatttgaaactatataatatattattgttaaccattgtcataccatagtagtatagagcattagaacttattcctccgatccagctttaattttgaatcttttaaaaaatctcttcccatccctcccttcctcttacgcttcccagcctctagcatcctctgttttacttttaacttctataagatcaaaatattttagcttccacatatgagtgagaagctgtaatgtttaactttcttttcttggctcatttcgctcacataatatcctccatttctatgcatattgctgtgaaggacaggatttccttctcttttatggccgaatagtacttcatcatgtatatatatatatctatccttccttccttccttcctgccttccttccttccttcctctttctttctttctttcttctttttctttatttcttttttttttttttgagatggagtcttgctctggagtgcattggcgtgaccttggctcaccataacctctgcctcccagattcaagtgattcttccacctcagcctcccgagtagctggggatgcaccagcatgtccagccaatttttatatttttagtagaggcggggtttcaccgtgttgaccaggttagtcttgaactcctgacctccagtgatccgcctacctcggccttccaaagtgctgggattacaggcatgagccgccgtgcccggcctgtataccatattttctttatccactcatctgttgttggacccttaggttgattccatatcttgggtattgtgaatagtgctgcaataaacatcgaggtgcagatgtttattcaatatactgttttccttgattattttatattttttctaaattatcttttgatttcttttatgaactatgagttagtgtttcatgtgatttacaactatttgggggtttcctagatatgtcttatgtcattgatttcgaattaaattttattgtgatcagaggatatattttataaaatctaaaacttaaaatccgtttaaacttactctttaactcagcatttggcctatgttggtgatgctttcaatacacaagaaaacaatgtaaatttagcattttaagtgtagtttttataaatgtcaataagatcaaagtgatttgtaatgaagttgaaatgttctatagccatactaatgttttgtcttcctgttctatcagtgatgaacaaagggatgttaaaatctttaattattactgtcatttatctatttctcccttcagttctgcttactttccttcatgaattatgaggctttattattaagtcagtgccccctttggcatattattgtcctctcatgaattggttatttcataattatgagatgcccccattttctctgataatgcatccccttttccagtttacattgtattttgctgatacagccacacaagcttcctaatgcttgttgtgtatatggtttatctttttgtataggtttacttttcacctatctgtgtctttatattgaatatatgtttctggtagacaacattagttgggtcttcttttcttgtctaatatgacaatctctaccttacaattggataatttagttcataaatatgttaaataaaacatgttgctactttttaaaactgtacaatctgtttcttgtttctcttctcttatttttgtttaattgtgttttaagtactcattttaaattgcatagatgagttagttgcagagcttttttactgagttatttgtcttacagtaattatcaatttatagttaactaatctaaattttacttggaggtttttttttacaacttcatatacaatgtaaaaaactgatgacagtaacatttcctttattccctctatgtcctttgtgattgttttagtataaatttttctatgtacatcataaaccccacaataaaatgatatctttttaaattttaatagtttcccttcaacgaaattgaacgataaaaaaagtattttctgttactcatatacttatcatttctatgcttttcattttctctaatttggcgttttgatttgatgttatttcccttcagactaaaaaatttctgttagcatgttttgtagtgaagatttgctggtgacaaattaacccatttaatttttctgaaaacgtcttaattttaccttcaactttgaaagatattttaacaatatatagaaatgaacctgatgctctgtcatctccaaatactttagtagagtgattctcaaccaggggcagttttgccctccaggaaacatctgatagtagctcaagatatttttagttgttagcctggggaatagggtggggaaggtgctactgtcattcagttattaaagggaaggcatgttgctaaacatcctgcaattcacaagaaatgcccacaacgaagaattatatggcccaaatgtcaaaagcggtagtgccaaggttgaaacacactgcttttgtgtatattttctacaaacaaaattgtgtgtctgtatatgtatatacacacatatagatgattctatatattacaaacctattacagtaatatatgtgtgacatacacacacacacaatacatgcacagtacaacaaacaaaaccagaaaattaatgttaatatattgctaccatctaattttcaagcccccattaaaatttcaccaatagtcccaataatgtttcatagcaaaaggatcaatttcagaatcatacattgactttgatcgtcaggtctttttaatgcccatttattaagaagagatctttagacctaacttgaccaagatttctggcccatcttttcttctttctttttttcctttgctttgcttctccttcctttcctcctttcctttctccttctctttccccttcctttttctcctccctctccctttcccttcccccaccccttctttctccttccctctcccctccccttccttctcctttcctctttcccttactttttccctttcctttccttctgttttgaatgcctccatttaggttttctgagatttccttgtgactatagtcagggaatgcactttgacaagaatatcacagaatgggtgctgcatgattttttcattgcatcctatcaggtggtacataatttcaatgtgtctcattactgatgatgcttattttgacaggttgatcatggttgtaaatacttggcttctatcctgttattctctatttctagattctgttattttactttatgttgcttctcctaaaggggaataggaattttatctgtttctttattcttttttgtttattccctcaaatagatagttttattccttactatacttttagcacatagtacctagtgcaaaacactaatacatgttgaacactaacatttgttgaacaaatgtctgaaactgaatctgtcctgctaccacaaaattgtctctctctcactctctttctctctctatatatattttttcctatagggataccatcaactacatagttgtctaagccaaggtttcctgctagaactgattaaagtccatgcatcctcattatccagaggcggtgtttctcatctacagctatagtctgaggctaaccattccttatggttaatatctgagaggaagaatcatgcagcgtggagataactgtgaaggaataaaaatagaaacccttttggacacaaacccagcctggacttctctctccccttttaatgattaatgaatgaaaaagatttcatcattagatgtagttagtttccattacataaaaaggaagctgatgaaatacataattgagttatatacacacatcctgttggttctatttctctgcagaactctattaaagaagttattgagtattatttacatgtgcactgataaatatgtctaaagactatgtctgaacacataaatttatatcaatgattatatttggttcattcttattacacttgattctaattcttatgaagttgatggttggtagaatgaatgataaaaggagattctgtccccttcagaagtgtttgtgtagttatatgccagagttttgaagattgagggaaaggttgagcttaagtaatttgatgggcaaactcaatgcttgaatgtaagatagtagttttctttgaaagatttggagaatttcataatgacttttacttttgctaattattgataaattcacatgtaaataaggtttacttaggtaagctcaaggaaatcatgctttgtttcaggcttattttaaatctgattttgttttactgtctttgcttttacaggaaaataatcattattgtttttaaacgatggaatctattgtgtgctttagatgcaatagaactttgtgaaatattacatgtaaatagtatatattgtatagaactggacccatgtagcaacttttgccatattatttataagtgatagtaatacagttatctttagaaaaataaacttagggactatgagctgtgactaaaaatgagcaaaagttgtttaagttttacttttaagtaatattaattaccactacaacattaaaagaaagtgcttttcaaattaaggacttgcaaaactttgaataaaaataaaacagtctattttaaaaggagatagaatatccaaagttttcaagttaagtaattctaagcatattcagaaaaggatattccaaaccaaaattttgaatgttcaattttgggatcctgaaactgaagctatgcacacattatagcaaacacatttctacaatttgtttttgtcttaattttctttcttttttttttttttttaatttgagacagagtcttgctctatcacccaggctggagtgcagtggtgagatcttggctcactgcaacctctgcctcccaggttcaagcgattctcctgcctcagcctccagcctcctgagtagctgggactacaggcatgtgacaccacacccggctaattttgtatttttagtagagacggggtttcacgatattggccaggctggtcttgaactcctgacctcgtggtctgcctgccttggccttccaaaatgctgggattagaggtgtgagccaccgcacctggcctgtttttgtcttaattttcaaagtaaaatgttaattgattttgtgggattactttggcaaacatgggagatccccaaacaaattttgaagagtttttttcttttctgttttccactttctcttaaaaaaaatgtatctcgtgtacaaataaatactatgaattaaaaataataataataaattatgattttccttggtgaggatcagttgtcaaagacattggtctagctaatgccaactatttgatataaaattctgtagcagtggagaggtgaagaagagctaaaggaagaataagaaagacaacagcatctttaagaaggtcctcttaaaaggaatcacttcttgttttcttacaagttaaaacctcactacactaacgtcacattttttttaaacttctgaattttctggcacttcaaatatcccatgaccccatggcagaaacgtcagataatatttgctactcatttaaacaattttgcttttcctcttccttctttgtttttcttattctctctcctcatttctctcttgttctctcttcccatttttctttttctctgcttctccctacctcctcttgtgactttctgtctcctcatcccatccctctactacttagatgtcacatcaatttgactgccctcatatttacaatgaatactttttttttgagattgagtttcactcttgtggcccaggcttgagtgcaatagcacgatctctgctcgccgcaacatctgcctcctgggttaaagtgcttctcttgcctcagcctcccaagtagctgggattataggcatgtgccaccatgtccagctaattttgtatttttagtagagatgggggtttctccatgttggtcaggctggtctcgaactcccgacctcagctgatcgacccacctcagcctcccaaagtgctgggattacaggcatgagctactgtgctcggccatgaatactttttaaattcatgcttctgaaagtttcaaagaatgaaaaggtataaatgtctcaaataataatttgcttgatggttgaaatgaatggcatttctcaaaaaggccaagggattgaatacagaaatttaaacagtaaatttctgttagtgatatggtttggatattttgtcccctccaaatctcatgttgaaatgtgacttccagtgttggaggtgggcttagtaaaaggtgtttttttcccaaaggtggatccccatgaatggttttgtgctgtcctcctggtaatgggtgagttctcgctctatgaattcacaagagatcttgttgtttaaaagagcctggcatctcccttgccccttctctcctcatgtaatacttcggctccccctttgccttaagccatgattgacagcttcctgggcctcaggagaagctgagcagatactagtgccatatttgtacagcctgcaaaaccatcagccaaatactcctcttttctttataaattacccggtcccaggtattcctttatagcaatgagatggactaatatagtcagttttgacattatgaacctttcatattaaaattaaatttctaaattcacccacttattgcggttgccttctatcttttctataataatgaattttgcatgtgactttaaatgtgctttaataattgattcactgtttagctctatttttggaaactaccagcttccactattgaagtaaaagtatcatcattggctggatgtggggacgtggtggctcaggcctgtaatcacagcactttgggaggccaaggcgggcagatcacctgaggttgggagtttgagaccagcctgaccaacatggagaaaccctgtctctactaaaaatacaaagttagctgggcatggtggcacatgcctgtaatcccagctagtcgggaggctgaggcaggagaatcacttgaactggggaggcagaggttgtggcaagccgaggtcacgccattgtgctccagcctgggaaacaagagtgaaactctgtctcaaaaaaagaaaaaagtatcatcattgagtctctactgctgaggtaactgttgtctaatttcccttcagttctactgctgtcccagtggaaacagggaatcttcaccacttacatgacatgtttgcctgaactctaatcttctacaccttttgcagaaaagagagtaatgtggcagtccagggcagtttaccaatttagaaatggtgtctgctcagtgttttcctctgtgtcacttactaaaacatagaaaagaaatcatggacattaaaaggaacagagagatttaatgtgatattttaattctaagaaagatttatggacacatgaatcctcaaatgttatctaaagtgtaaagtgtggttttcagtgtgtttgtccctatcacaaaaagacaatgctttcagtttccttgtgatttaatcaaatgttaaatctactaaaaagttgtttcttagaattaagccagagtgctttgttattgatttaataatgtaaattcacgagggatggatggtttagaagtttaagtaagttatctaaataaggaaaattaattcaaaaatttagatatttctgatcaaatattaacttttattataaatgaacgaacaattgtatagcatttcaaataaaagggattttcccactggaaatgctgtctgataaatattgttcatgttgctataatatctgtggaaaattcagaattttcaaaaggggacatggctaaatttctgagtgtgattatcagtaaattgtaagctcttaaatgagctgattaaagccctatgagaaatatagttttatagatacaggaaaatggtgtgtttaaactgttaaattgaaatcatattattcaagaaattgtcttttttcaaggtcatattgaagagtaggatacaagagatattgagaaaaagcagccactaaggaaggagtaaaccaaatataagctatataagctgtgtcattcactggggcaaaagaattacaaaggaattagcctttagtgaagaatttaggaactggtcaaccatgtcagaaacagtaagattagatgacaagtaagatgaagccagaaaatgaccatatggttggacaacataaagattattggagactttggaaagtgtcaattttagagtaatcatgtgatagaaacctaatcaggggaactgaaagtaatatgaggtaaagtataggagacaaggctgggcatggtgcctcatgcctataatcccaacactgggaagtcaagataggaggattacttgagcctgggagttgaagaccagactgggtaatatagcaaaaaaccctgtccacaaactattaaaaaattagctgggtctggtggcacatgactgtaatcccagctactcaggaggctgacaagggaggatctcctgagcctgggagattgaagctgcaatgaactgtgactgtgccactgcactccagcctgggtgacagaatgagaccttgtctcaaaaaagaattagagacaagaagtttagctgaaaaagaacacaaaaaatgaggtagaggttagaggggaagtggggtatttatgtatttatgattgtttattttatgtgggagatattaatgttctggtttgtatggtcaggaacagaggaatgggtgacatagtacagagacactatatgcagtggaatggtttccttagttatgcaagacggatgggcctaggagaagaggaacatttcactttttgaaaaaggaggaaagaaataaaggatcaatttgactatacatatatggggtgaaattgtccagcaatggtgttgttttttgttttgtttcgtttgttttgttttgtttttagatggagtcttgccctgttgcccagtctggagtgcattggcgtgggagtgccttggtgcaatcttggcttattacaagctctgccccctgggttcaagtgattctcctgcctcagcctcccaagtagctgggattacaggaacctgccaccacgactggctaattttttgtatctttactagagatgggatttcaccatgttggccaggctggtctccaactcctgacctcatgatccacccgcctcagcctcccaaagtgctgggattataggcgtgaaccacctcgccagcaatggtgtttctgactcctctatagagattattaattgtattcttggacaaagccagagtcctaaaggaaaaatatatgtaccacactactgcaatatcttctgaaaattacttttataaattgggtataactttatttgctattgaatatatttttctctcttcttattgctgctattctttgagtaacttatacgttttctcctacattattgctgagattttaattttggtacttctatggcctctttatctaaacaatgaaatccaagtgcttatttgatttcataatgtattagaccgttctcacattgctataaagagctacctgggactggtagcacttataaagaaaagaggtttaattgattcacaattctgcaggctgtacaggagggatggctggggaggcctcaggaaacttataattgtagcggaaggtgaggggaagcaagcacatcttcacatggtgacagcagagggagagagagcaaagggggaagtgctacacacttaaacaaccagatttcctgagaactcactgtcatgagaacagcaaggggaaaatctacccccatgatacaatcacctcccaccaggtccttccgctaacactggggattacagttcaacataaggcttgggtggagacacagagcaaaaccatatcacataatattagtataacatgactttgtgagaatgatttctcactttcttggagacccttaattggtaaagactatccattaagagttatttggcctaacacgctccatcagattcttacattcaccaaggtgaattgaaaatctgttttctctttttgatactgttactattcctgcctctctaaagatgaagaactcccttatgcaccgtagagtatgaaatgcttcaagaacaagagaatggtttgttagaaaaggagtagataaaattgcctgaacaaatgacagcaattcttgtcctgagccttgatttatcactcctgagggttgtctgcaagagtgaagcatggtaagttaatatttaaaatattagaatgtaaggaaactcagtctccctaagctcttatgaaatgatcggaatacttcactttaagggctagcctttatccttatgaatataattttgattaattatatgcatgactaataagcagacgccatgacacttacagtgcagttcatttcacctgtattaacagggcacttaccatgagtaaagcaccttcagggagacaatgagtaacatccctcatcaactggagtcttcacgctatagacgcatattctggagaactatgtaataaaaatgtgattaatgtgctcaggaagaattaaaaatttatgtattaagcagaaaatgcagaatgaattaatatagctctcagtatatttgagttatttttttctggtttcttgcttaaacattgacatgttagaagaatacggtcttgataaatttattcaagttgatccgtgttgcatttggaaggaaatacaggttgaatattccttatctgaaatgcttggtaccagaagtgattaggattttggatattttcagaatttggaatatttgcacataggtaatgagatatgttggggatgggacccaagtcttaacatcaaatgtatttatgtttcacatacacctgatatacacagcataaaggtaattttattttagccttgtggatactgaatagactatgtgttatgtgcctgcatttttcctgtaaatcataagaggttgggtgtggaattttcaacttttgacagcatgtcagtactcaaaagtttcagattttggaacattttcaattttagatattctgattaaagatattcaacctgtatacatttacctatccctagcaaactcgtacaagaacagaaaaccaaataccacatgttctcacttataagtgggagctaaaggataagaacctatgaactcaaagaaggaaacagacaccggggtctacttgagagaggggtgggaggagggagaggagcagaaaagataaccactgggtactgggcttaatgcctcggtgatgaaatgatatatacaacaaatccctgtgatgtatgtttatttatgtaacaacccttcacatgtacccccaaaatctaaaaaaaaggttaaaaaaagaggaatatatagcaatagtgcatagtactacctttaaaattaaaaaatacagtaaatatataacttctaacttatttgttgactcagattcacaaattacattggatcccaatgttctaaaattttagtatattaattacattggtattagtacagtcttacatcttcaaattaagtttttttttttcagccactttggattagatttttcatctctggaatgatttgcttttggaaataacttcgttttcctttacacagtaatggagtgagggagagaaaatgcattgccatgacgctagattagtgcagagcctacaactgcttttttcatgacagtaacataaggctgcttcaggtgtgtgactgaaagaaagaaagagttaaagaagaaacgcaaaattctagaaaataaaatacataggtcaccgaaggcaaaattgcggtggaaagatgaaaagaaatgacagttggtgatggtgaacctctgtctgtgaagggaaaacactctgaaaataccaaagcagagagactgccaaggtgtggatggagtccctcatctctctgggaaaatgtccttcttcttagaaacagaagaggtaaactagaagacagtgacagtgcctcttttccagctgtaaatggctgttctcatattaatacctcaattgtggttccagagtgtaggctaaggagtacagtagcaaagcatatatgagataccccgtgacaggctgacagggagaaaagagcccaaataaacatctcactaaagtaagagtactaagaatttccacaatcagggttatcactcaagttcaaaaaaataaaatataacttataagagccttggaaacatttaggaagaaagacatcaaacaataaatgagaagtaagcattctttttctttctttttaaaaattagcacaaaaaggaaacatattcatatgttgttaattttgtttgtcagaaagatggttatagaacctgaaaaatttcattcaaaatattataatcaagaaaattaaggtgttaatatgtgcatccatatgtatataggcacattatatgcatatatgttatttatatgacatataggatgaatatatcaatatgaaatatagtattgaagttgacttatttctcacaataagcatataacatatatagtataacttacctaatgtctatgcacattgaaagtgatagagaagaaaacttgatacatttgcatattttatatacatcgtgctttatccatattattagcatatatgcagtacagaaaatgaagtcaatattaaatctggcaaatgatatttggtactgcagtggtgttttaaaaaacactcatggaagaaagaacaaagaaggaaacttaatgatggttttacttaaaaaaccagcaaataattaagaaaataaaatggcaagtcatttcaaaatattttattaatccaccatctctgtatttttgtagtttatctttcttacaccaaaagtgaatgcatagatgcagtatttttctatcagtaaattattgattcatttaaaatgtttattttatagaaaatgatatgcaattgccatagaaaatgatatgcaattgccatagaaaatctagaaaatattgaactgttttataagcataaacatgtcttccaatctaatctgcagtcttagtattttggtatgtttcttttaagtgtttctgggaagtattttgcatagtgattaagagaatggactctagtcagattgtctggacttaaaatttcaactcaccaaactggggcaggttttttgtttttgtttttatttttgatagggtgtcactgatatggtttggctgtgtccccgcccaaatctcatcttgaattgtaaccccccacaattcccacctgttgagggagtaacctggtggaagtgattgaatcatgggggcgggcctttcccgtgctgttcttatgatagtgaataagtctcacaagatccagtggttttaaaaacgagagtccccctgcacaagctctcttgtcggccgccatgtgagacatggctttcaccttcccccatgagtgtgaggcctccccagccatgtggaactgtgagacctttaaacctctttttctgtataaattacccagtcttgggtgtacctttaacagcagcatcaaaatggattaatacagtcactttgtcacccaggctggagtgcaatggcccattctcagctcactgcaacccctgcctcccaggctcaaggactcctcctgttagcctcctgagtagctgggaccacagaggcacactacaatacccagctaaatgtttgttttttgatggagatgaggtttcaacatgttgcccaggctggtctcaaactcctgaactcaaactatcctcctgcctcagcttcccaacctgctggggtcacaggcatgatccacatgcccagcctggggcaagttattgaatgtctctgggcctcagtttcctgatctccgaaatgtgaatccatatctccatgttcttgtatgagttaaatgagaccaaaaatacatagtatttaaagtcatgcctggaacatagtaagcacagaataggtaaagtgactcatgttctgtgcctgtgaaagaatctcagtttaggcctcctgtcctagactattaatatgaagccctctttcactctcagtagtgcccttgtgtggacgattaattttatagtcaccctgtatgtgaaaaattgctattatttttttcaaggcatatgcatggccttgattttacacggttgaggtactattatattaacagttttaatcttgtttttatcacctttataggatgtagtcagaattttcctatttcaatccattttttattaataatttttaacatttgtatatgatcccctggaatgaatattccataattcatgtatatgtctatgtatatgtctattgtttttaatttggcctaccaaaatagtgctgtgatgaacatctatgcccatatattttgactacccttctgttgaatttcttacgatggtaaatttaaattattgagacaaaagcaatgcacatttgttaggattttgataatggtgtgtatcttaagccatggagaattctgaaatacagcttaggcaagaaataaggcaaccaaactacctctgcccagggttttgctgaaagtgcatttcagagttaaaattacatagaaacttaggttgattctttcatttgacctttatttgctgaatggcctttttatcttatgttggtaatgatattcaagtttcttttctgcttggtatccctacaccatatcctagctgtcattttgtgctaattttccataaattatctagcaaaaacaaaccactcaataacaaaggatgaattgagtgtatgcccctttgacttatgatttctggagctggagatctcctgtgactaaaggaaaatattcagcacatcagtgtgtgtcaaacatcagttctgaaattatcaggtaatctcaaatctccaaggctgttgctgtgggtttcaatagatttgcagagttgttttaaaggaaataggaaatgtcagacttgtgtctctaaggtttggtctcctgagtaatggcttgtatatgtcctttattggatgcccttttgtctacacaaagcagaaatattaggtttgcttggaatctgtgctctcatatttgattctgatgaggcttgacaatttcatatctttcctttgtttgcatcttccccgtgtagtaacttctgcttttgtagttacctttaaaacacgttaggtacttttaaacaggaattaatactttatgggaacactagattgaggtacgcttaagatgatatatttttgttttaatcaagagaataaaaaataagaactgagattttagaaaagttcagattgtattggatttataatttcaaagagagatactacttaataggatgttttgtggtaataaatgtgtttatatttcatttcttcatgttattgaacatttttttcctccaataacatttctgtttgttctccatttctgttttataggattgaaactgccatttctgaaatatttccttctttattgtttcttgcaactttttctcttcttgaatcatattatttagaatttaaatttggaatatttatttttaacttcttattttgaaataattacagactcaaaaaataaatttcaagcaaaatacagaggaactccatgtatttgtcacccagcttcccccaacaatattttacatagctacagtgcattgtcaaaaccaggaaattcatattggcataacacaattaactagtgatgtggtttggctttgtctccacccaagtctcaacttgaattgtatctcccagaattcccacatgttgtgggagggacccagggggaggtaattgaatcattgaggggagtctttcctgtgctattctcatgacagtgaataagtctcaggagatctgatgggtttatcaggggtttccacttttgcttcttttctcatttttctctttcccctgtcatgtaagaagtgcctttcaccttctgctgtgattctgaggcctccccagtcttgtggaactgtaagtccacttaaacttcctttacttcccagtctttatcagcagcgtgaaaacagactaatacagtaaattggtaccaatagagtggggcattgctgaagatacccaaaaatgtgttagcaactttggaactgggtagcaggcagagattagaacagtttgaagggctcagaagaagacaggaaaatgtgggaaagtttggaacttcctagaggcttgttgaatggctttgcccaaaatgctggtagcaatacagacagtaaaatccaggctgaggtggtctcagatgagatgaggaagtagttgggaattggaacaaaggtgactcttgttatgttatagtgaagaaactggcagcattttgcctctgcctagagatttgtggaactttgaacttgaaagaaatgatttagggtatctggtggaaaaaatttctaagcagcaaagcattcaagatgtgactcggatgctgtcaaaggcattcagttttgtaagggaagcagaacataaatgtttggaaaatttgcagcctgattatgctatagaaaagaaaaacccattttcgggggagaaattcaagctggctggagaaatttgcataagtagcaaggagcctaatgttaatccccaagaccatggggaatatgtctccaggccatgtcagagaccttcacagcagcccctcccatcacaggcccagaaggccccagaggaaaaagtagtttcatgggccaggcccagggtgcctgtgctatatgcagcctaaggacttggtgccctgtgtctcagccactccagccatggttgaaaggagccgatgtacagtttgaaatgtgacttcagagggtgcaagccccaagccttggcagcttccagatgttgagcctgtgggtacacaaaagtcaagaattgaggtttggggacctctgcctagatttcagaagatgtttggaaactcctggatgcccaggcaaaagtttgctgcaggggtggggccctcatggagaacctctgccagggcagtgtggaagggaaatgtgggatcagagccccacacagagtccctactggggcactgcctagtgaagctgtgagaagagggctgctgtcctccagaagaatggtagatccaccgacagtttgcacagtgcacctggaaaagccgcagatattcaatgccagtctgtgaaagcagccgggagggaggctgtaccctgtaaagccacaggggcagagctgcccaagagcatgggaacctgccttttgaatcagtgtgaccaggatgtgagaccaggagtcaaaggagatcattctggagctttaaaatttgactgccctgctggatttcagacttgcatgggccctgtaacgtctttgttttggccaatttctcccatttggaatggctgtattcacccaataactgtacctccactgtatctaggaagtaactagtttgcttttgattacaggcttataggtggaaggaacttgccttgtctcagatgagactttggactgtgaatttttgggttaatgctgcaatgagttaagactttgtggaacagtttgtaaaggcatacttggttttgaaatgtgaggacataagatttggaggggccagaggtggaatgatatggtttggctgtgtccctacccaaatctcattttgaattgtatctcccagaatttccacatgttgtgggagggacccagggaaaggtaattgaatcatgggggccggtctttcctgtgcttttctcatgtcagtgaattagtctcatgagatttgatgggtttatcaggagttttcgcttttgcttcttctcccatttttctcttgccattgccatgtgagaagtgccttttgcctccccctgtgattctgaggcctccctagctatgtggaaccgtaagtccaattaaacttcttttgcttcccagtcgcaggtatgtctttatcagcagcatgtaaacagactaatacaactagactagttaaatgtctgggattttggattattttgaagtagtttgtgtaataatatgagttttccacaggtaatgttcatataaggagtaattaaccctcatagttataacactattttcaatattttttatttgctctcctacatatctccttcatatttatgattgagaaaaatgaatcatcctaaaatgagtacttttgtattcattcttttgatcaaaatagtagtaagtagtatttgtcaaactgcctaaccattggtgatatgcaggtatgatttcacctagtacacgcagctacacggaaaattagaacatattacaattattttatacataagataattgagtgatatggtttggctgcgtctcccacccaaatctcatcttgaattgtagttcccataatctatgtggttgttcgagggacttggtgggaggtaattgaatcatgggggtggttgtccctatgctgctggtcttgtgatagtgaatgagttctcatgagaccagatggttttataaggagcttttctctctttgctcagcctgccatcatgtgaagagggacatgtttgcttcccctttccccatgattgtaagtttcctgagacctccccagccatgtggaactgtgagtcagttaagcctctttcctttataaattacccagtcttgggcagttctttatagcagcttgagaatggactaatacattgagaatcgagaagacataatgaatgaccaaatctacattgtaatttagaggctgaaataggactcagatcaatctctgtgataaacagcctaagatttctctctataatcatattgtctcctacagaagatttgtctctctctaattcttgcaactatgcacatacccccctaatgttttttatatggcacatatcacagagaacttataactgaagtattagtttttgaaaaaaaactattatcatgtactctctttttcatatataaataattatttttttaaatatgattttaagttctgggatacatgtgcggacgtgcaggtttgttatataggtatacagtaccatggtggtttcttatttgtgttttcatcttatggctttggctagaactaaatagtaaaagtgtgcatcagtttaagatagttatttttagtcattttagtaaggacatatctataactactttgctaaattttatcggtcatgcatgttaaatatcattaaataaatatctggaattgggctgctgtaccagaataccatagactttgtggcttataaacaacagaaaggaatatctcacaattccaggggctgggaaatctaagaccaaggcactagtcagtttggtgtctggtgaaaatctgtgttctggttcaaagaaggctgccctttctctgtaacctcagttggggaaggaacaagggagttctatggagctgctttataaggttgctaatcccattaatgagggctcctccttcatgacctaattacttcccaaaagcgccatctccaaaaaccctcacattggcggttagcatttcaacatatgaatttgagagggatataaacactatgtctgtagcagtaaatgtacaatataaagtaaataaacagctttattgttgtgttgaattatattaatatatatttcctggtattaaatctttctatgccaaatcattggggtggctgatttctcaggaagtgtagaattcagttcctttttcttttagttaagaatatttaaactatgtttataagagatactgtttagtaattttattatttttatattaacttcatcaagagttggtaatagttatatttgctttgtaaaatgaactgaaaggaagccccttcttataactttatacatatttcatagttttgggtccattttataagacttttcaaacaaatacttactaaaaacactggttatagggacttaaaattttttttaaataaggttttatgtttcttgcaaaaattgatacatgcaacctatttaacatttttaaaattaaattaagattcatttaaccagtacatgtttattttagtgaaacacgtatttaactttctaagatagtgttttttgtctttaaaacaattgctgtatttttatgtttttctctttaaattttatattttcttagtgtttgattttatcatatttgctatatttttccgtattatgggctatttgttaaagaatgaactcgtgtatgtttataaatttttactgtttttgtttataatttattgccttttaacttaatatgtaattagcattccttttaattttgcttgtatgttttgctgtaccattttgaagttcttgagttaaattcttaactattttttattttgatttgtaaagtttaaatattaaattaaatatgtcccatcaatttagtcattttaatattctcactcgtcagacattttttgggaacgccatatgccttttcatcaagtcagtttcaagaaagtgaaaattactttttatatatttatactcaaagcttggataattctccacttccttaagttggggaaaaagtgattcttccaggctatagtcaaaagagatataattatagtaacattttttgtttgtttggggttttttgtttgtttgtttgtttgtgatggagttttgatcttgtccaggctggagtgcagtggtgtgatctcagctcactgcaacctccgcctcccgggttcaagcaattctcctgtctcagtctctccagtggctggaattacaggcgtccgccaccacacagggctaatttttgtgtttttagtagagatggggttttgacatgttggcaaggctggtctggaactcctgaactcaggtgatctgcccgcttcggcctcccaaaatgcggggattacaggggtaagccactgcacccggcctatagtaacttttttttaataggttgtggtggacaaaagtccccagaaataataaacagaaaaatgcatttattaacactttatattttattctctaaacaaaaggtgtctcattttttaaatttaaatcatgatggcctgtaacagaagcacctaaaaattgaagtaaatatataaatttttaacataaaatattttaacatattttaacacaaaattctttaagattctaatttatatctttttatttccttccatatactctcttgatatattacccattacattaattattaatatacacccaagtcaagatcttttattatgtgaggtcatcagtcaatgataacagagacattgatgaattagtctcctcatcagaaattgagcagcattttcattcaagatgatacatgggtctttaaaacatattcaataatattgagtctcagacttctccttcttttttctgaatgtgcatttagacctttatacatctatctatctacccacccatttattaaattttcagcattaacttggaatattaaacatggttccaaggaccagaaccgtgtttgtctcgttcactgccatactcctattgcaggtagaatctcattaaactctgaggattcaacataagtgaatgtaggttgtagcaggaataattctaaggtagcccctatgaccttcatttcctcatgttactctgttgatacctcacatgaaaaaggagtctcgcagatgcaactaaggctaataatctgtcagccttaagacagggagagcatctggataaacctaatctaatccacaaaaacttaaaaatcagggagttttctacaactgagagtagaatgggaagtcagagagtttcaaagtacaagaagcatttaaatcacccttattgactttgaagatggtttgcgtcttcttctgagttcagtttgagattatctttctaataattgattggattttattcttttaaaaaagagataatttaaaggaatctatttttaaatactctgaggagggtgatatgggggtgcttgttgtcctgttttaactttctcttaatttctaatgtaattgaattttgaataggtaatgtaacctgtatggtttttattttaaaaaatatatattgaggttttatgtaatctatttttaaaattttcaatggaagcttgaaaaaatactgcttcacatattcttgtatataagtattgaaaatcttatacattataatgctcaaattttatactttaataagccataacagagagacatgctagtgatttcacaattaaatgtgacattcatttagtgttttgttttgtaacattaaatattttattgttttccatgcgattatttttcctttgaattctactttatgtgaaatcaatgatgttataaatagtctttgatttttactttattaacctttatacattttaatattgttaaacttataggaacagtttgtacacttcctggaaatagaatagggtaatagagtttgattttttttttcttttcagctgaggttttttgtttgtttgttttttgggtttttttttttttttttttcgtaatttcagtcttagagtctttcttttaagtagttagtggtatagttcatctttgtttatcaaagctgatttttttttgttttaacttttgtgaacttgcttatagtttctttataaatattaggctggtgcaaaagttattgcagtttttgctaattatgtgttttttaaaaggtggtacatacaaataaataaatcaggaaaggaagctagagattggtggcagtagaggtgagtcagtgttacagttactattgctgcttaagaaactacccaaatttaataaggtaaaacagcaaccacttcattatatctcatggattctataggtaagaaattccagcaggattcatctgagtgattctccttctctcacatcattaactagggtgactcagtgctagtcagctggcaaacaagccagtctggaaggtgcaaggtgcttctttctgtcttataaattggtggggttgtctggaaggcaaggctcagatgggagggactcttagttatagtcctgcacacagtaaacttcttatatggttgctgactttccacagatcaaacattccaagggaaccaggtggaaaatgcctgctctcttattatctaaccttaaaggtcagatagaattacttgtcatactctattgattgtagcagtcacaagcatgtccagattcaggggaaggagacctagacctattttttgacgagaagaatatcaacctgtttttggactatgcttaaaactgtcacacatgacaattacacatcaggtagaaggcatttgaggagagacttgaaggaaatgtggaagaatcatgctctgctgaaaaaagagcattccaaagagagaacacagcttgggcaaaagccctgagtcagaaacatgtggacttattcttagaacagcatcggggaagccattatagctgaagcagagtgaggaaggggaagagtattaatagatgatggcagagaaataagcatgaaaagacagattatggaacgagggccttgtatgccattttaaggactttgactgttcctcaaactggcatgggaccattgaaagattttttttatttttattttttaaatttaacttttaagttcagtggtacgtgtgcaggtttgttatgtaggtaaactcgtgtcatgggggtttgttgtacggattattccattacccacatagtaaacctgttacccactagttgtttttcctgatcctctccctcctcccagctttcaccccccttttcaaaagtagacatacatgtaaccaacaaacatatgaaaaaaatgctcaatatcagtgatcattaaagaaacgcaaatcaaaactacagtgagttaccatctcacaccattcagaatggttattactaaaaagtcaaaaaataacagatgctggtaatgtggagaaaaaggaacacttctacactgttggtgggagtgtaaattagttcgaccactgtggaagacagtgtggtggttcatcaaagacctaaaaagagaactaccattccaaccagcaatctcattactgggtatatatactcaaaggaatagaaattgttctgtcataaagaaacatgcatgcctatgtttattgcagcactattcacagtagcaaaggcatggaatcaacataaatgcccatcaatggtatactggataaagaaaatgtggtacatatacaccatggcatattatgcagccataaaaagtgagatcatgccctttgtaggaacatggatggagctggaagccattatccttagcaaactaatgcaggaacagaaaatcaaatactgcatgttctcacttataagtgggagtcaaagatgagaatacatgaacacagacgggaacaacattgaaagattttaagcagagaagtgatatgatctgaattgtatttctgagatctctctggcacttgtgtaataaatagctgaaaggaatcaatggcagaagctgggagaccagttaagaggcctttgcaataatcacaagaggaaataagtgcggcttacactaggaaccgtcaagttagaagtgctcatattcaaatgtggtcagaatctggacattttgagtaagcctacaaaaatttttaatactatctcaaaataaaggatatggaaagtttttcctttctcttgccctgaaaccttctgtatcctttattttgagatagtattaaaatcctttctatcttactgacaagtcttactatcttgttttataacccaggacatgattataattatagtattgttaaatatttatttttattttgtaattatactttaacaatactattgtggtaaataatcataaaatatgaaaaataaatcttccaattaactgaatcgattgtccccttgcaggattttggcttcacagtttcctaatgcttgaaacattaatgttgattatttttctaatatgtacccatatgcctttgtgtacatttttattggaaggacaaatcagtaatggatataccgtctctttgtatttgggtaaaggcaacctgatactgatgattttcttgattatattcttattctcttaaaatctttatgtcttctaataatgttaacagagaagaagaaaagtcttatctaagcctaacattttagttttaaggaagttttttttctttatttgtaaaattcaggagtttggctagttgctatttaaatatggagtacctttccttgtttcttccccctccccgactagaatctggttggtgcttttgctgttcatcattcagtgatagctttgatcattgtttcagatctcattgcccttgcatcttttcccaatacacaaaccattctcgaggtgaaaactgtggtctctggcatacccatctgcctgcttctctgtcattagttcatctctttctttgccctccagagccctgattcaattactgcttgaacttttcagtgtgtcagtttccttctccatggatttccctgtggatggcaaatctgcccttacactttagttttcatagaagcctcatctcagctatctcccattttgtgatttgagcctcttttgtcattgtagccttcatctcctatttcctaaatgccatgtgtttctacatactgttcatagacaaatagtttaaagcaatgttctatagtttcttatggtttgaaagtcatatatttttaaatatgttttcacccctgagacttcagcatggaggttcctttttcttgtatacaggatcattttttaggatttttttctgttatattttccccattctgtttacctagaaggtagtgatatttaccccaaaccagggtttgagattgcgttagtctattttcatactgctataaagaaatacctgggactgggtaatttataaagaaaaaaaggtttaatggactcctagttccacatggctggggaggcctcaaagtcatggcagaaggcaaagtaggagcaaagaaatgtcttacatggtggcgggcaagagagacagcatgtgcaggggaactcccctttatgaaaccatcagatcttgtgagacttattcactatcatgagaacagcatagggaaaaacccatccccatgattcaattaccctcccactgggcctctcccatgacatgtggggattatgggaactataattcaagatgagatttgggtaggaacatagccaaaccatatcattcttcccatggcacctcctgaatctcatgttttcacatttcaaaatcaatcatgtcttcccaacgtcccccaaagtcttaactcatttcagcattaattgaaaagtctacagtccaaagtctcatctgagacaagtcccttccacctataagcctgtaaaactgaaagcaagttagtttatttctacatacaatggggttacaggcattgggtactcccaaggtatttacgcctgttccaaatgggagaaattggtcgaaacgaaggggctacaggctccatgcaagtctgaaatccaatagagcagtcattaaatgttagagttcaaaaatgatctcctttggctttatgtcttacatgcaagtcacagtgatccaagtggtgatcttccacagccttggtcagctctccccctgtgggtttgcagggtacagcctccctcctggctgcttttactggctggcattgtttgtggcttttccaggtaaacagtgtaagctgttggtggatctactgttctagggtctggaggatggtggccctcttctcacagcttcactaggcagcgccccagtaaggattctgtgtgggggacagagcccacatttcccttctttactaccctagcagaggttcctcatgagcccctgtgccccccaacagcaaacttctgcctggacatccaggtgtttccatacattctctgaaatctaggtggaggtccccaaacctcaattcttgacttctgtgcacctgcaggctcaacatcatgtggaaactgccaaggcttgaggctttcaacctccaaagacatggtttgagctgtaccctggtgtctcccacccaagccatgggtggagcggctgcaatgcagggcaccaagtctctaggctgcacacagcaggggcacctgcacctggcccaggaaaacattttttcctcctaggcttttgagccggtgatggaaagagctgctgtgaaggtgtgaaggtctaacatgtcctggagacattttctcattgtcctggtgattaacatttggatccttggatccttgttatttatgcaaatttctgcagctggctttaatttctccccagaaagtggattttcttttctcttgcattgtgacgctgcaaattttccaaacctttatgctctgcttcctcttgaacactttgccacttagaaatttctttcaccagataccctaaatcatctctctcaagttcaaatttccatagatctctggggcaagagcaaaatgccaccagtctttttgctaaagcatagcaagagtcacctttggtctacttcccaacaagctcctcatctccatctccagcctggacatcagtgtttacatcactatcagcattttggtcaaagccattcaacatgtctctaggaagttccaaaattttctacatcttcttgtcttctgagctgtccaagtctctaggaagttccaaactttcccacatttttctgtcttcttctgaaccctccaaactgttacaacctctgcttgttacccagtttcaaagtcgctgccacatttttgggtatgttaatggcagtaccctactctaccagtaccaattactgtcttcgtgcatttttgtactgctatgaagaaatatgcgagaatgagtaatttacagagaaaaagaggtttaatggatacacagttccacatagctggggaggcctcacaatcatggcagaagatgtaggaggagcaagggcatgtctcatatggtggcaggcaagagtgtgcaggggaactgccctttttaaaaccatcagaccttgtgaaacttattcacgatcacaagaacagcacatggaaaaacccactcccatgattcaattacctcctactgggttcctcccaggacacgtggggattatgggagctacaattcaagacgaaatttgggtggggacacagccaaaccatgtcattaatatctaacaggaagtgatcatttttgtaaattagtttattattctacctttgaggaattgcctgaggccttttctctgatctgtggtggagataaggttgatacgcacagcttctctcagttgtgagcgagtatttattggaatagctctgctaaggtaaagtggagacttctagtatcttgtctggcttattgtacaagacatacacaatacctagcatgcacatataatgcagggtgctggcggtggcaagaatgagtgctggtttacagattattcatgttactgctttctgggtagagtttctaaaggaaggctgtattttactcagaaaataatcttaaatggcccgttggtatgatgcaagttgcttatcagtagtttcctgttttgctttataatccttctcaatagagaaggattcctcaatagagaaggaatattgagaacaatattcctcaaacttattaaaatcccattgtatgaaataacaatgtaacatagggagggaaggaaagaaaagaggctgagttcatgcttggagggaaacaagaagggagagaagaatgtcagaaaggtcatgtggctgagacctgggccgctggagttatgaattgctagactggcaatttgtaattggcaaattctactgcctcgcctcccagggcttttcttgagtgaactgtgtgcccaggccagacaggcacctgatacatctatttgtttgtttgtttttattgtatcttctatcttctaaggagcttagtatgtaagatactttgtacctggcccctcaaatagtaagaatggagctgtaaaggaataagtgcccattttctgggacactccaagagtctgactcaggggacaggctggggagaggtaactaccatcttacatgattttcatattgaggaaattatttcatttcataaaataaactatggatgggacagtttaacttaattgttcttatagttagtaaaatttcctactagattagtctgcatattgggtgtcagttttagtaattagtgttgttttaagtttacattgtttgctttgttttactgattttttttttcttttttaattggaacttggatgggactccattacaaagtatcatccagatgctgttcaaaattgggccaaatcagcattaaaatgaaattacacattcatgggatttgttactagagttggtactgttttggaatgattcatataacatttataaggaccaattctgagaaagataaatcatcgctataaataattttttagattactttagtatcagtcatatattcacgcacataacaaatatgcattgagcttgtatagttcaaggaatttgccaagccctggaactagaggatgattaaaacagacatactacttgacctcaacaaaagtacagtcaagaaggaagttacaagcattaagcaaatgattgcacaattcatacttaattacaacaatgataagtgcatcctggaaaataaaatgttatcaatcaataggtgcaaggtgtcaacctaaataacaaacagagagaaattctctaatagaacactggattggggatagggtatttcagtaggaatatatgtgccatagtcaactatgtgtgcattcagggaggtaaaggaagacaaaggtattcaaagaaaaaatgtggaggattacacaattgttttgacatagttatccttgattacaaggatcaataacaggggtggtgccattccaaggttggacaggacatatgtccttgcagaagtgttcttttgcgtaaggttgcaatggtaagattgtggtttttgcagtctttcgtggtagttcttgttatcaggcatatatgcatgagaattcccccttcatggccttctccagctgcatttggcaggctctatttttatttctaaaataaatgactctattttaatcctgaaaaatttcacatttttctactttgatcaagatctttccctaaaagtgtcaccgctcagtcatcctgcagtaaggtttcagttgtctctcagtgctgggatgagtctgtcttgggttgttggtctgatctcacattgggggcagtaaatggttactaggggtcagtgttaaaactcttttagctatatttgagcaacaagggaagtttgtagtgagtggcactcaggcttcctggagtccattactaagttcaattttgtttgttttgtagtctttggctatcatttaaaattgctgggccagcattattctgttaggagttgtcctgcagtaattcaacaagtaacagatacaaagttttaaaaggtaaaatacaaagcaaaattaatggtaatattataatctcagtttgcataatagttttgagtcattagtcttaaactaattgataaatcaaatgatttttatcctgtcatgcaaaaaagaaggcattaagaggagtagaagtctcattgtgatttggagttttgtatcagcatcttgggaaaagctatctacagtgtgtacacatcaatttcttatcctagtttgcactttgaatgtctctggttatggcatcaagcagtttggtgcaattttgtgtggcccatataccaggtatgaaatttccttttaaaaattaatctaatttcaacttacagggtatcaagaacagagctgttcccatttttggtaattctgtggaagaaagctagattggaggaatctaaaataattcagtatctaatctggtctataggtagataacaagaacttgaatatacttacagagctacaatctaataacagatgtattaaagattttttttagaaacaactttttctgtctacattgatcacataagaatctcatatttaaaaacctcttgagcctaggaagcttcgccaaggcagattttatgtgctgtcttaatgttcctaggcttgccaggaagtgacagtttttacttactcactgtaaggctgggaacctttgaaggcagatgttctttgcatgttcttgtatattatgttctgtttaaagccttggtaatacaaccaatgttttcgattgtatccttctataaagagatagcaaatttttattgaatttatgcaaataaccatacggccacaaaaaatgacaaatgctcatgaatagtttctgcatttggggggatcaagtagggagaaaaaacaaatatttccacctttgttcataaaaagtatgttgtgccaaattgctatacactaccaaaagcttatgagagaaaatgtccataaatctggagaattaagtaagaatcaacaacgtttcaaataagtcataaaacattattttcatcagttactttatctcatgtggttaaattttgttcagcttgaccttgatttgcagtttcatgaattcatcagtttcttcattacagtttagtgttttatttagctcatttatcttaaagttattcgaaacttccatttaagactgcttattagagtattttccatgaatctgattgcagatgcctcaagagaattcaaaacaaaactgtgggtgacaaaaacttagaacaactatggataaaaatatagtaaaagtttataattgacaaggaaatttagctatttaacaacccaaatcatgactgatagcatcacatcaggactatcagacttttataaatttcacataatctttagaatactcacattgataatgtagccacaatatagctataaacaagagttaacacaacaaaaaatatgactggtgacatattacattcttattaatttatataatttttgaaacaataacatatctagtcattttacttcaggacaaacattgaccacatagtattttttctcataaaaatgtattctcttttcttttcaactcttcttaccaaaaatacattttcatacccataactttcttcacatttttctctcctacttacttgttcctttttaccatgtttttgtatttttccaaatttttatttagaaacaacctttaaataaactccaaattagaaaaaatattctttttctcaataaagaacacttttatgcttttcttacatttttcattaaaaacatttcatttttgatacactttatatacaaaattatgtatattaattgttattttactttttagtaacactaatttttagtgaaagcctactaagcaagcaatctttaactctgttacaaattagtattttgtagataaaaattattatataattttagaaacatgattccaaagaatgtaacttgttatgtcttaatagacccaaatatatttagactttctataaaatataggaagccagtaacaaaattatatttatgtttagcaatttatgtttcagttttgtatcttattcgaaagtgaccctgacatttagtgagtatctgtcacttaattcaacacaacaaaactttaagattttaaattaaacaaaaagtttattcacaaacatttatcttttttatatttacctgatttatttatctttaacaattataactagctacttatgaaaactaagatattagataaaatgagtcatcatttgaagttttttctctgttaaccatttttatagcctgtgaatgtcaagtgttttcctaaataagagacttgaagatatttgcgtggacattttgttgataactcataagatgtagctgtttttattaaacaagcaatattaaattactctcacatatcaaagatttacacaaacaaagatcattctgtttctaggcagatttgatagttttataaactttgcgtcaaatcctaacaccttgaaacatctagcagagacaaatataatcctgtctgaccagtaaaccatagaaaaaaatgtatgccaatgactttgtatttttgtatttttatttgtatttttatttcttcaccaaatgtaaaaccaacttatttattaaagatttacttaagccatgtgaactaaaaggcatttaggtttatcactatatattttatatgagcaggcatctgtctaaatcaatctgaagagaatttttaaagggatttctggccctctactccagattttatcatgtagacacaacatataccataaaacatgtgcatgtgtatgaacatacctaagccacatacatacacaactaaagatcttatagctttcattctagaattttggtcataagatagtaatactaatttataaaagacagttggttccaaattatgtatctgacaaaataggacctgtttacatgactaaattctatgacccctatagatagtcttacaatgtctgtggaccaacattttagatacaacttatttttgaatctcatttaccctttctcccctacctccttttttttcattttcaagtgagtttagggttatatattccattgtttacattttagctaggaatagcgtaattgtgtaagaaaaacaaaatccccgtgtggccttgaaatctatcattctttgctggtctattttacttaactagtctatgagggcaagaaagcattttaccaggttttttttttttccagtttttttctggcccctgcatggcatacaaagcaatttttatgttggatataaatatattattgctctgagatcaagattttgtcctttttgatttaagtgcctaacttttataaacacttatttagatatttttcttttagaaatctattattcaattatctgttccatcaccctaagcaattgtcagacaaatgtaaatgtacatttccagaaggtgtctaacttgctggttgtcatggagctatgataatttgtaaaaccatccatttggtagcccttcaggactttgtttgtttgtttgtttgtttgttttttaatcttggcttgcatgccataaccagtgaattttatttcaacacttgcagtaaagtcagtagattcaaagtaggtaggaaaaaattagagaactttgaaggttctacatgttaagtgtatggttgcagtctcttaattttgtactaagcaaaaacaagcttggagatttccccatgatgaccattgatccaacaacatacgaggaaaagccatgtatctggctggagtcccagaaagcttggcatgccttactatttaagaatcccattccattttttataaatctctcgagagcaaagacaatcctataaatcttgtcaaggaaggtcataagtttggattggcattttagatggttgtgacttccttagtgatttttaattagtcattctgcacccaccatttagaatgttttgttttgttctcagaagatttacagaaacaagcagggggaaagaaccaatcatttgcagacatccatcactaataaaatgaaacccaaatcagagtgtgtacaaaaattttaacccaggtgtgcagatcaaacaaaatattaaattaggcatgcaaaaataacaagggtaaattcaccagcaagacatgtctcagagacggaatgttaattttgcagaaactagagtactgaagccagaaggacagttgtctttaaaccagaaagcaattgccaggaaagataaaaagtcttttatcatcctaggagggatgttaagatgttttatcgaagctggccttctaaccaaaccaaatccctaacttaaaaaaaaaaaaaaaggcctctacaaaaaagagagaaggtccgcctgagtgaagactcagcagggcaggaaaggcgagcatggaagcagagctctcaaggggctcaggtggttcccacatgctggttcctagaactgccaattccttctggaagtgatctggcttcagatcccacttctggacaccatttatgacaagctttagagagagggtctctaatataaaataatgtttatttggggatagggcattgccttgggaatacatgtgccacagtgaactgtgtgtgtatatacaggaattaaaggaagacaatggcttataaagaaaaaatgaggaagactatgtaattgttttgagataattacccttgactacaaggtgctgaggttggacaagcagtctctgggcagatattctcacagaaatgtttttttgtgtaaggctacaaagacctttttgcaagcttgtagtttttgtagtcatttctgatggttcttattaccaggcatacttgcatgagaaccatcccttttggccttcccggctctgttgtcaggttttatctttttctctctttctttctttttttttttttctttaacatgactttaaagctgctccatttcaattctgacaaactgcacaaatgagagcaagtaacctagaaaggatgctccagtttgggggtggtattagttttctgtggctgctaggacaaacgatcatgaacggagtgatttcaatctacaggaatttgttctcttactgttgtggagatcagaaatctgaaatcagtgtaattgggccgaaattaaagtgtctgtaaaaccaagctccctctaatggttctaggagataatctatttctcacctctttgagctctggcattcctgggcttgtggcagcatcactccaatctctgcctccgtggtcccattgtcttctccatttctgtctgtaaaaaatgacctctgcctcagccttacaggaacacatgtgattgtatttagggcctgcccagataatcttggataatccccccatttaaaattttttctaattttttttttttttttttttgaggcagagtctcgctctatcatccaggctggagtgcagtggcacaatctcagctcactgcaacctccacctcccgggttcaagcaattctcctgcctcaggctcctgagtagttgggactacaggcacgtgccaccaaggcctgctaactttttgtatttttagtagaaatggagtttcaccgtgttagccaggatggtctgaatctcctgacctcgttatccagccacctccgcctcccaaagtgttgggattacaggcatgagccaccgcactggccccctattttaagacccttaatttaatcacatctgtaaaccccctttgtaagcttagtacagatgactgaggaaaggttccgaagggatagaactttccagacatgggggacagagtatgtaaacactgacggacctggcagaaatcatgaaaggactgagaaaggagaacgggggaagtatgaaggatgaaggggagattggccaaatgtctctgtaggtgtggaatctctaggtcatctagaccggaaacttccattctatttagactccagaggtcttctgaaatcctgtatatgcacatttttcctatactgagtcagccaaatatgtttgttagtaattaccactattaggaatctaaaagtccctaggcacatgtagttttatggaaccaagtcctgctgttttctgtgtaactgagtttgccaagacatagctggaggagcaattttctcatatatacaagcgaacacaaattaatttctgttacatacgtagattgttgtctgaggactgcttgatagtaggaatttggctgtagtgtagttaaagtgaggcaagaacaggaatcccagttattttcccaactcctcctcttcctcttcttcttcctcctcctcttcttcctccccctcctcctcctttttcatcaaatactttaaaatatataaatttttattttatgattccacagaccataaaatggaactgttggacaggactttaagttggaatagagacaagattgaaactgtgttatgctcaaattccaatatttttttaaaatagtaattactacagggttgttttcattaagaaaaagttatttacaaatcttttcaaacttcatattttttccacaggcccaggaacacagcttttttgctattcaaagtagaagtaaatatagagaatgctgtgtgtgtgtgtgtgtgtgtgtgtgtgtgtgtgcgcctgtgcatgtgtatgcatttctttttaaaatttatttagtccttatgttaataatatgcctggcacttaagaatcctaagtaatttgtttggtaaagtcagaaagaagagcagtcagagaggtgttcataatgaaagctacaaaaatcagcttttgacttgttggataggctcccatccctgattcaaaaatacctggaccacatatcaaggccatccaattcatagagcgttggtgatgggcctgacttaaagtctgaaaattacatctgtaaaactgtgttctctataaaaatatgcacatttgccaaagtgaagaaaggaaaaaaattccattaaatgtaggttcaataaatgtattagaaaacatttaattaactatctctctgttaaaacacatctcgtgactgctgttcccactctcattggtgtttatctgctggtaaagtgctcccccatatttctatttgctgtgtggtgcagtgcgaccacacagttcagacacaacctctgctttgtgatttacctcaacactttaactgtgagcttctttttttactgtacttcagtgtatttcccagaaaatatattctctatgagggataaaataaaatatcaattagaaacaaacaaaaacaattcagagagatattaaccattcagtcttctaagttatcaaagattatattcttcaccaagtcatataaccaggtcccagtaaaataccatcatgcaggcaatttaacatcatgtaatttaaaataccatcatgcaggcagctttcaacaaagcatcctataagaaaagattatttgtacttacatctttaaaagttttgaaattgctgttgaagattgttttattatattgtccattgtctgttgcttaaagacttataaattttgcttaagagtttagagttaccaaaaaatagctgctgacaatatgcagatactattttattaactaatgacacatatttgcattctggttttccttttggccttcagtaacaagaggcttaggactaaatattaggctgaagggtagtgtttccttccctaggtcttcgcgtataattgtcacctcctccttttcattattctgtcattttgcccttgttttatagtgcttgtgccttttattctaagcggtctcaaaggcttttctggaaatacacagtgtataagtacaaaatgatgaaataaacatacttctttattttgttttaaaagatgcttgggtgggactagatgacctctaagatcctttccagctctaaatttatgttactgtcaccaaagacagacaaaaaaaaaatctattaggttataggcctaaagatgaatgccaagtactatattcctgctctaggtgtatttcttgttgaaggcagtgctagattctgtgacctgttacggccccttacattcttatggtgataaaataagagaactgattgctaagaaaaaaaaattcagttaaaatatctttttactcttaagcatcaacaaaaaataagaaatagaaaacagaagagctgaattatttcttctgagctatttataataaatttggacaactaagctaagcctgagtgtagctaatttaatgaaattggtcatatttgaatattgtcacaaccttactatcacattagcattaagtgtgattaaaatttattctttgtttctgtgtgagtctccacagaatcagctatcaacaccttcataataaactagcccttcattgcttttgggaaacttttagattcagagcaggtggttgggcttctgctttagaagagaacaaatcatttttgaagtgcctttcctgtttgtgtgtgtgaacttagaacacagaaattgtccattgcatcatttttgctaggaggtagaagttattaaaaatataggaaatactagatatcatgtactgataatttccaaagctaattatttttcttgtggccaactgaattagagtaaaaacataaaagttaaaaaccaagctacaatttaagaggtgtacttgtgaaatataaatattgttttacagtaataaaatgtttctcatgggaaaatagaatatgatttttgttgaagttcaagggaatatctgttttcattcaggtagtttccagatttttgtctttacaatgttctgtgtaatgatttaaatactgtacctccaaaatttatgtccactagatactttagaatgcgacttatttggaagtagggtctttgcagatataattaactcaaggattgagatgaggtcatcctggatgaaggtgggccctaaatccaatgtaaatgtccttataagacacaggaaaagacacacacggagaaggtcatgtgaagatggagacagaaattggagttatgcagtcgcaaatcaaagaaggccaaggattgccaggagcaagggaggattcctcctgagggtcttcagagggagtatggccctgccaacatcttgatttcagaggtccaggcttcagaactgtgagagaatatatttctgtcctcttaacccaccaagtttgtgataattaggtatgatggccctaggcgactactacattctaattcagaagttcttcttggttttattatatcatgtgttggtaggaagtatctaggtgtttcatttgcatgatatgttggtaatcttagaattatcgtatcttgcaagtaattttaaagtatattttaatgtagccagaagctttttaaatatgaaatttaattcgtgcttgtgtcaattacatttgaaaaaaatacaaaaaagctatataagattctaggatctttcagaattttataatgcttctaatgaaaagttggttaaataaaatttgtactctaaatcattttgttgttggcttaaaatagcatttaatttattagtactcagataacagttttcccctaaatagcatatttactttcatatgttggtatcaaacagtgaagtgagacagcaaatcagtacaaagtggtgattatctatcatcataaatccatgaaggatagccttgatcttactgagaggagtttaattttaaaatgcattcctggaaaaggcaagttagtataacatttcaaactcgtatagcattattggtaattgattatagttataattgatcatttcatatttggacagtcactttgaatcaaattaggataattataaattaaagatttattatcatttgctttgaatttttgattaaaaaatttaaaaccataaaaacagagctttgactataaaaaacgtatttatcctttcttggtaagattggggaggggtttaagaaaaggctaagcaatgttctatttttttacgtaggcaaaagttcatttgtgctactttttaattaggtaggtaattttttttgaaatgacagcttccaaaacactactgattttacgtgtgcagtcattagtttttcatgtgaaaatattatctttcaaattcacacagatgcttattttatgaaatgcaatgggactacttacctgccacctgactaaactggcatgcgtagattcacgccttgccaaatcaggagttagggtgaacagtgattaatatccattctttaatgagtttctaagtctttctgaacatgtttttattatatttgttgcagtgggatggtaaaattttcaggttggttgctgtacaaagcatgataatatctttattaatgttaatgacatccatatcataaaatattatattcttaataggaaatttgttatatataaataacaataaagatcataataagctctccttaattccatttattttgacttcattattaagtttaaaaacataggtgtcaaatttagacattatttatatgtaattataaagccaaattaatgttagagattaacttaaaagtagttttgtggctcaacaattgaagtgagatagtgggatcacaaaaggcttaatcattttgaattgattccacagatgtctcctttctctaaatcccctgtaagcctcctatcttccatgaaaggtagtcccataaacctggcacataaaatcaatcatataactcttttccattctgagatttcaaagattaggactttcaacatagagaaaaagtgctgtgtacaagttgagtgtacaaaagtcaacacttggcaatggaatccagtatttcccaagtatttgaggaaacttacaaaaaccaaatctctagtccttgctttcacatttgctgtcagaaccaggaagggaggcctagaaatggtttgtatggaaaatttgttcttgtagaagcagttcaccttcactgatgaatagatacaacatatttcccagacctccttttaagccaagatagcaacatttttaccagagccaaagataaaaccagtgtttaatctcctagaaattaggagatttatgactctggaaatggaaagaattttaatatccagccacataaccaggtcatacaagaacataataaacaaaccaatcaaacaacaacaagaataacaaccacaacatggcccccattctctttttaacccccgatagaaatagcaataaaggtaaaacaagaaagctctcatcaagtgttttcctcatctactattaatgatttattcttacattctgtcccagtccagttatcaaaaaattccaagacagacccctgtaactgatttgtaatgaattccagggtcagattccagatattgtttcccctgaaactgtgtaagtgcacatcagaatactatacttttggtgtgaatctgagccaaattctattgtattctaaataaagtgaaattactatcagccaatagggcatggtatcagtttcaaataggacaagctggtaaagtcaggagaaatgacttcctcctgaagtgctgtatataaatttattacaatgccttttaaaattttatatgttcaacagagagggaactaagatcttgttatcatcatttaaaaacaattttgtagaatgtaaatatatcagggcttgccttttttccttgttaatgaaaaacaagtagtgcttggggagcaagtattcctgttcaactgctgtcactcattcccagctctgcttagaagaaagaagcacagatggtgggtctattacttccccaacaaaaaatctgcctgtctatattttttggttttattccatccttttcattgtaatgtgaacaatatttcaagtcaagagacttctgtagggatctttgaaatgttttatccattacttgtaccttaaaaagaaaaagaaggaattaatgatttattaaaatgtcacgaggggaactcaaataaaaattattggttacaaaaaaatttaatctagaaaccatgtttttttgcatgcaaattaaagccttcagggaagtgaggttttatatcagacttagatcctaaagtactcacttaatgacgacagaccacttagtctatgttaaacatacctgtgtgggtcttttttatttatactgtggctcaatgaaaatttgtctattgtaaacatattaagaaaaagagcatagaggctttttaacataattttataaggctgaaaatacatacaaacagtaaaacacccaaatcttaactgtacagctcagtacttttttttttttaacaaacttagcacttctgtgtatccaatactaaaatcaggaaacttgatattatttcttctagacactatctcatagggtagctcttgtggtgatttggaacataactgattcgttttaaaatttttagtaaattagatcatagaatatgttctgtatcttgcttctttcattcaatatttagtttataagatttgtcaatctttttgcatatagttgtaattcattagttctcattgctatatactatatcattatacaaatataataaatgtccagtttgtggttattttgaaaggtgcttctctgagcattcatgtatctgtcttttggtaaatattgttgggtatatgcccaaggtcatagaatatggttagatttagcatacgtgggaaatggtggtttccgtcagtttacatttccatccacagtgggagagagttccagttgctccacatctttgccaacacttggtatcatttctcttttttatttgaactgttctgatgtgtatgtatcactatttcaattgtggttattttgaacattacaaaactggaagagaataactgattttattaaatcacatttcatttgaagtaatgtgtgtctactttgcagtatttttccttatttatatgactcataagaagagtgactctgaaatattcaataatataacagcttggaatgagatttttatcagctataattataatacattttatctaaatattattttactgtattagtagctgtgataattaagaacaaaaccaaaaggtaagcaggtaagcaattccttagattaacatgaaacaacattcctgcctttttaaagaaacttttctggcctgtaagtaaatgatgtaaatcaattaatagcttaattaaaattaagaaaagagtctcagttttcattgcctatattatgtctgtattttctggagaaacagaaacactgtacggcaaacctacagtctgctagtttcttctcaccctgccaacaacagttatattactgtttagctggttacatgcaaccatttgttgaggaggattgttttgttttgcttagttttactttcttttctttctttttttttttttttttttttaaggcaggtcttgctctgttgcccaggcttgaggtctgtgagttttatactcatggtcacatggtcagtgtggtgtgatcacagctcactgcagcattaatctcctgggctcccatgatccccctgcctctgtttcctgagtagctgggactaaaggctcatgccatcacacctggcttgttgaggaggattttgaagaaaatcacacatgccttcttaattagaaacaatgaaaccttagaaaatgtaattagagaaaaaaataacattttgcaccaagctaattatatctttaccttttcttagtcggtttcaggattgatacttattggtggttgtattttggagtgtgtgttccttgcagcacactttatgtatatagtgtggccttatttgagtaactcaagttacttaacctttccagatcccagattctccagctgtagaatgggagtaattataatacaaatattacatggtgggttagtccaggtcctccaagaggtagatgttaaaaaggggttaaacacaagaggattttattaagggaaattcctatgagagaaaatggagaggaagctgagtaagcctggaagagctctcagctgtgaggaaagtctgacctagagtgaagaaaagaggaaacgaaggttgagtggaagcactggagcatgaagtacagtctaaggaagggtaagaaaagtcttcagggaatcctgagccaagcctggtcctcagagaagccctgtgtctcctaatgagggatctgcattagcaatcttgctgccctcagtcattgactgaggggcaaatgcagaaacagattttagagtgaagcagcaaatggccttaaatcagtcagacttcccgtactttgaggtctatgagtttcttattcatggtcaccaaaagatgtttatcatgaattgacaaactccagatagagtaaagcaatgcctaaatcataattatgcacttatcaatttatttattcatattattcactatcattacaaatattcaacacattaataaaacagccacatgtgcaatctacttaggatattgggagcataaggaataacacagcagtgctacagataatttaagagatggttactctctttctctctctatctctctctatatatttatttatatatatgagtataaaattttatttttctaaaataaagaataattggtttccttgtactatttgttattgatgtatactgccaaatccctaatgaatactggaatacttaactctaaactccctgcatgcctacaaaaagaagtgggtccaaggttatattttaaatcaaaagatgtgttaatattatcatttttatcatgtccaatggatagtatcattatcaaaaagtttaatcactgattattacttgaaggacctagttaggaaatgtttgatccacttcttaaaactggtcactggaagtatattatctcaggaagaactggatatttattgaaacccctttaatatagccataatctcaaacatagaaccttcttttattttcttcaaagatttttcaatttctgtaaaaattcagagggtgtttatggatagtgcaatactctgctcaaatatagggaaggaaagttacattaaaatgagaatatttttgctgaaaagtattatgatatttaatgtaagcaaacaaattactcagatgatagtatttgttttcattttaaaatgtctctttaatttcaatagtttttggagcacaagtagttttggcaacatggatgacttgtatagtggtgaagtctgagattttattgcacgtgtcacctgagtagtgtacattgtaccaaacatgtagtttctttatccctcaccccccctgccaacgtccctgttctgagtctccagagttcattgtatcactcaatggagagtcttaaacattcagggtagaatcttcggggtgtgacctcctatccattgctttccaccatttgtactctctgctttgtgaatggaggcccgttctccctgtctgctttgttcacatacctttgccattttccttgctgggatgacatcctttgccctgaagttctcgttaaccataccacagctgtcctcttcttacctcaatacatcaaaggctacttcaagttacaatttctccctcagtttttccctagtctaagtccacgtggatttctccatatccagaatgtctactacttgtcttatctttcctcacacttggcatgtgcatttccttccagctactttcataatgttgtattttaactgttcagttgtgtttatattacactattctgccaggcaaataagagtatttatattgctgaaatctatggttttttaaaaatgtaataaaatgtaatgaataaacatacaaatgaatgagttaattactatattcctggttaagtaatgagcattatgaggacaaaaattgtgtcttacaccttcttataatcctaatcacctagtataggacttggaatatagcatgcatttaagacatctttgtgactaatgagtttaaatatttttattaattctaagttgacattatatgattgtaatttggggaaggtagtgaaatttcaaatggctttcaccaccggtgaaatgacccttttacatacgacatgatttaccagatctttgtttaggtgaacctaggtgaaagtggattgtttcctctacttagaaaatattttgcagattttagttgcttaaaaatttgattatttaaatttgtacagttatggtttatgatattgccttgtacagttatatattttttatatattttatatatatatatatgccacatgtgtgatctgcttggaatactggaagagtaaagaataacataacagtgccacagaggatttaagtgatgtgccatatatatatgtataattttatttttcaaaaataaagaatattattacacattaataacataggtataattgttttccttctactgtttgttattgatgtatactgccaaatccctaatggatactagaattcttaactctaagtccctctatgcctacaaaaagaaatgtgttcaagcttattttaaaaatcaaaagatttattaataaaactatttttatcatgtccaattgatattatcattattaaaaagtttaatcacttattacttggaggaactaattaggaaatatatatataatatatattaggctaagatatatgtacatgtatatatataatatatattatatatacaagtatatactactatataatatagatatattaggctactctctctctctctctctctttatatatatatatatatatatagtatatatgtagtagcctaatacttaaaaaataagataaggactgcataaaataagctgactcagacaatatgagtgtggacatatgtataattcagcaagacctggtaacaaagtgagatatatattaactctttgtagcatattgttaagtagtatcaaaaaacaagtaatttctggttgggtccattgagtgaataacattatttttagattgatctaatggcacgataagcattttagcatttttcctggaaaaacattacagctgtgccagtttctgttccaagagaaaaatacattggtgtattctctaaaggaggaaattccgacctcaaatatgttcagatagctgtgacagataataccctgatcaggtactaagtcatatctttcacatttcccttgctagttatactcagcgtgtggttggaaatggaatcaaagcccagtctggaaatcctgaagtcaaagtcaaaggaattgatcctgtgataaatcagattattgataaactgaagcatgttgttcaggtaagtcctgatcctatatttattagtatactcagtcataaataataagtggttactttctgttatatttgataaatttgttaatcctgtcagataatcctacctaaaatattgtaacacactttttgtatcaggacatttggaaatatttagtttcatgatttttggatgcagtcaatatgcagtgatattttaatactggacaatctgtatctgtgaaaagcaagcctcagcctcagcatttcataatgagaatctcaggatatgctttgtcttcagtgaataagtttgaacatgggaatcactgtgaccattaaagaaaacacatataagaccatagaagttgccagagttatctttcaggtaattctctgaatgttactgtgaaggttttgcagcatttcaatataagttaggtcatagatgaataatatgtatttataatatttatttcctataacaccttttatatgttatcttataatctagctaatggttgtttatgaaatatttctgttttatcttcaataatgtttttcatcaagtagtgtgtattgctgtttttaatacatggcaaatgaagcatgagcatatttatcaaagtaatatttcactgaaatagtctattaattagaaccaaacattatgttgcatgttgtaaatattaccctccattctgcatctattgatgtttggggtaagaaaggctattttttttttagttattagtcatttttcaaaaatttatatttgaacatactttcatttttcctaagcaaaactttgtatgggtagttgatatttatttctagtatcatgagtcagaaacaatacctgaatagtacagagtttttattgcatacaacatattcaagagtcagtagtagacttctcataattgttctgcaaagacaaagcttaagtttatgcagagccagttcttaggttcccattttcacaagagtccctatatctcaaggaaaggatatgtaagaaggacatgggggttggtgtccaataccatagatttctcccttctgcgaggcaacaatgcttattctaccattgatacctgtagaaaacagatctctcgccctggctggcaaaacccaaaataaattctattggaaaagtctaagagaaaagtggtatcatgactaccgatgagttaaacctcccagcctctgctgagctggtccagttggtacctcacagtatcgtccactatagtataatatgtacatctagattatttgaaaatttgagtgcataattgataataaaaccaaaagagctttaatattaatcagctcctctcattgaggagtgagtacaatctcactgtgaggacacggtgaaatcttagtggtttcttaagtgggataagcatttcacagagggtgcaggaagaaaaaacagaccttaagtgtatatttattcagtctcattcttttatattactttggttgtagtaaggtatataaaatatgtaatatattagtgcaatagcacatacatataatttataaatacataaatatacatattaactgggcatttattcagattgtttttataagatatgcacaggatgaaagcagaacggaaaccctattacagataataaagatggtgctgttccataagaagtgcacagttataaaaaaaacacatttacagagaagaacacatagatacccaatataaaaaggattatagaaacccttaggaggagggttcacatatttattgcccattcagcaaaacaccacccccctcctctgccagttctggttttgtaggtttcaaagccatagccttttcaagggggcagagggaagtcatcctacctttcttttttagcttctgtgtgaactcgagtcccattctttaatctttctaggaatgtgaagatggccaattattcatgcttaagtttcattctggggttgcaagagaatatcaaatacaatgctacctttgaggtctatccttttaaggtctactagaattatatgatcaaaatttagatttttatagaggagagcagaaagttatgtcttgcacaggtgtcactgaaacattcacctttaatgcctaagaatatgctctttcataaactgctctcctggagatgaagagaaatgttttactttgccaaacttttgactactgataatgtacacgtgccctggcagggatggctattgtactgtcaatatcaagggatggctaacagcacctccacaatgtcagctatgaaaggattcagaaaatagccttccgtaagtgagaatttattaatttaggagtagggccatggaagacgtcgacataggaataggtttcagatcctagtctatagatttagatgatcacttcttagtgtttgtataaaatttactttattttttattatagtagatattaaatttactttccacctttgtgctatgaaaaatgccatctctcaccatagggacgtacctatattaaagaatatggaagtaagtcagccataatagcaaaaattgcctgcatacactcacccaaaaaggcctttctcggcctgccattgatctgaaccttatttctaccctgaattgtctgcaattagagtcactaaggaaatagataaagatttttacttggaaaatgtcactttttaatgttttaataattcattcaaaatactcaaacatgctcattgagtttctagtatgatcctggttctgtacaggcactgaggttaaagttgtgaataaagcagacacaaccctgctctcatgggctttatgttataagaaaaaagtaaataaacaaataaaaccagtattgtagctgacacatgttataaacaaaccaaacaggatgaggtagggaaagatatttaagaagaatgtgctggtggaggccactcagggggagatgtttgggttgattctgaataaggagaagaaaggagtcacaggaaaacctgtgagaactgtgtctggggcagaaggaaaagtaggcgcaaaggtcttgtggcaggaataagtttattttattcagagaacagaaggccatgcagctaaaacagggtgagttaaagggaggagataaacatacctcatgttttggggagtccagtaggctctggtaaagagtttatattttctcctaagtggctaagaagtcatttaaaaactgtaagcagaagctagctgggtgcagtggctcatgcctgtaatctcagcactttgggaggccgaggagggtggatcacctgaagtcaggagtttgagaccagcctggccaatatggtgaaaccctatccctactaaaaatacaaaaattagccgggcatggtggctcacacctgtaatcccagctactcaggagactgaggcaggagaatcgcttgaacccagggtcagagctttcagtgagccaagatggcaccactgcactcctgcctgggtgacagagcttgagtccatctcaaaataaataaataaataatcacaactttaataaatcaataaataaaaactgcaagcagaaagctgataaaatttatgttttatgaggacttcactatgaaaaatggaccctgcatgcaagaatgaaaaaaggaagtggtacagacagaagaccacataactggaactagaataataagagtggatacgctgagaagtgcatagatttagacaaatgttggaagcggggttattgggatttgttaatggattggaactctgggagatagaagaaggatgatagcaaggtttggtgggatgatagtgtcactaagtgttaaaaggaattctaagagaagagtaggtctggcggagggttcctgggattgattaaaaatcagtggttttgttaaatgtgagatgcttattagatacccaagaggaatgtgcagaactcagggagaccacacaactggaagtgtatgtttgtaagcacagagtgtggatagtacctaagccctgagattgtataaagttgtcacctttcctttagagtataaattcacaccagaactattaatggagactgtaagacaatggaatcatacaaaaaattgtattgcaaaaacctatgaatggataaaacattttattaaatgtattgggcaccttgtatatacttagacagttgatctaggacagagaagatactttgtaacattaatttttttcttactgtaagaataatgactcaggagacggaggctgcagtgagctgagatcaggccactgcattctagctccaggagacagagtgagactctgtctcccaacaacaacaacaacaaagaataatgaatgctcatcagaaggaattgaattttattattctaggaaatctgatggaaaaagtgaaaaataaatattgataccatttataaaacaatgaaaaagacaagagaaggcatctaggcttttttctatacttaattatacatataaatacatcagcacttcacttaaaaaaataagatcatagggtacatttgattttgtgacatgaactgctcacctgaccacacaaaacaaatacttttccgtggcattaaatattctgctatctggttgttggtgctggcatattatcctatcatatggaaagattacagttttacttcactcagtcacctaaagttggatatttaggttgtgaccagttttttatgataataaagactaataggaatatcagtagacgtaaaatatttttggcatcttttttttccttgtaatacattctacatgttgaaactaacaatatgttccttaacaattgtattttgatacatattgccacgtttttctcaaggaaaattaaagctaacaagaagtgtcagctttctcttcatgttaaatgtgtgggtggaagcttggcagtgatcctgagacatactggtataaaacatcattgggctctctagagaccaaggtaactgtcctgtacaaatgttagcctgagctgggtgtcacctgggagtactccaaggacggccaaaagaaatattttagttagaagacaatttataagaaaagttttggctgggcctggtggctcacacctgtaatcccagcattttgagaggccgaggtgggcggatcacgaggtcaggagtttgagaccagcctggccaatatagtgaaaccccatgcctactaaaaatacaaaaattagctgggcattgtggcgtgcacctgtattcccagctactagggaggctgaggcagaagaatcgcttgaacccgggagatggaggttgcagtgagccaagattgtgccactacactccagtctgggtgacagagcaagactctgtcaaaaaaaaaaaaaagggaaaagaaaaggagttttgagacttcctagagagaggtcatagcatacacaatcttaattttatttcatcatttaggacaagccctatatttatattctgcacacattccctcttctccacaccccctcaaaaaaaagctgggatctgatgtaaatagagacctgtgggctatagcttggtccttaaggaatatctcagaaacttcagtgttccttcattccctctgcaaatccttctgaattgagaatgggaaccttggcgacagaggggagtcatgcacctcccttttccatctgtgactctgacatctttctccaggtcagccattgtgcaaattctcagagttgctttctggcactttcctgcattccaaagcctgtttctgaaacaggcaatatttgtccttttgaaaatcatccatgttaaatgtggtatatccaatggccagtgaagattttcctaaagggagaacacttattcctaagagttaacattaactttttcagatgtttgcgtcagactcaattgccctttaatattatagattgaaaacaacacttggttgatcttagtatatctgattgaggaaatgcgagagcctttttaatttagatttgctcacctagcaaacttactttgaaacttcttggtcatattatgtttgtttatggcaaagttgtcagcaaaaaagtcacagttctgcagcaatttatctttaaacactaaatgacatctatcatttttcaaagaaaataatgtcagcagttaaaatcctaactgctgagcactgttagttgagaattataatgccccattgcttagaaattaatttacctactttcaatatgaaacagaaaaagtaatatcacagcaattttctggatttattttattgcaaagccaataaatgttacagtgttgttaaaagtagtagatttaagaaacattttatttccttaaacctaacaattcaaataacataagagtattaagtttctattaaatattcatttttatagagacccaaacttcttttcaaaatgtcttcatgtgtaatataaatttcatttttagatgtgaggaaagcaataatcataaccattgcttaaatccacaaaagaagtagattttctataatatgtatcccaataataacaatggagagtattcaggcagagatgagagacactctgattttagtagaaaaaggctgtgctaaattatctcttagtctttttttcactctgttcttaggataccgatataataaatataactttagaactgtgataccctgagaaaaggttctaatttaaatctcaatagatggttacacaggtagtgtttacacacacacacacacacaacacaatcacaggagttttaaaaaatgttagtatctctgaattttttaattctgaaaactgtccaagcttttatcattaaatcacttgctataaaacaaattttataaacatcctttcctattgttaatagcctatgatagacataccgaatgagttaatcataattgattggtcagttgctaattgcaaattctttgacggtagcatgtcagctgattctgtgaacttatttcacttgtatagactctttcccttctttggagaattgccacaacactctgactcctttccccacaactccattacatgacattgtcacatccccaggcttatgatactaatattccagagaaacgaacagttcttgattttgaattagcaatgcagtagtgatcaaaacagatttagttagttatcttttggttcaggagaaagtgttggatgcacgctcaataactttcaatggtcatctaatttagcaattagtttgtctgagtaaattcaatggaaggctgctttctggaatgggtggtataatgcactgacttcactattagacatttcatttaaaaaaatcaattgtccgcataaaacaaccatttcaatcagtgtacaatcaactggaaaggaaagtttgagaacttttttttttaaagtaatgggattgggattggccattggtaatttctgtttgattaaagtatgtaattgttttgtgttggataaaaatttgacttttcatttatgtggatgctgctgattttacatgttatcatttccattaagacttgagctgtttttctgccgggtttactgttcttaaaatgttgaaagaccattaaaatgtaaaacttttatattttttatttaggtgactaggacaaattctggtaatttataggctaaaacttttatatatttctgcttgaaatattttgaaatatggtttttttcacaaaagaggttccaaattacaaccagctcccactaattcatatttctttttaataattgaagtcactgaaatttaacttgtcaagaattataaaatctaaaaggtaagtgttcagcattttaatttaaacaactaggataagtgaggaaaataatatttttgacaattactagacataagtgttcatccagtaatttcaaagaattaaaaaaccaaacaaaataactttccttcagtctcaataaaacatgcttgctaccatatagtaatgtgctaaggaacatgacttctgagttagcacaaggcatgtggctaaattccagcttttataggcactaactgtatatccatagttagtttacttaatatcttaagcgtcaatttaattttagtgtataataaaaatgacaggtaataagtgttgtagagatgcagagaaagtggaactctcaaacattgctgatgggaatgtaaaagtgtgcaaccactatggaaaaaaaaatgacagttcctcaaaatgttaaccattatgacccagcaattccgtatctaggtatatactcaagagaaaggaaatacgtgtctacacaaaaacttgtacatgattgttcatagcaatgttgttcatattatccaaaaaaagaaacaactcaaatgttcctcaattgatgactatataaataaaatgagatatgtccatataatgcaatattatttgccaataaagaagatcaaaacagtggatatgctacaatgtggacaaaccttaaatatgttatactagctgaaagaagccactcccaaaagatagcatattatatgactgcatttattgatatactacaatattgataaatatgttgtattaggtttgttctcaggctgctgtgaagaaataattgagactgggtaatttataaagaaaagaggtttaattgactcacagttgtgcattgctggggggtcctcaggaaccttacaatcatgagagaagccacctcttcacagagctgcaggagagagaatgagtgcaagcagaggaaatgccagacacttataaaaccatcaaatctgtgagactcactcactaccatgaaaacagcatcagaaaccacccccttgattcaattacttccacctggtcccacccttgacataagggggttatgggaattataattcaagatgagattttgggtggagacacagccaaaccatatgattctgcccctggcttcttccaaatctcaagtcctcacatttcaaaacacaatcatgcctttccaatagttccccaaaattttaactaattctagcattaacccaaaagtccaagtccaaagtctcatttaagacaaggcaagtcccttccacgtatgagcctgtaaaatcaaaagcaagtagttacttcctagatacaatgggggtacaggcattgggtaaacacacccattccaaatgggataaattggccaaaactaagaagctacaggtcccatgcaagtctgaaatccaatagggcagttattaaaccttaaagttcccaatgatctcctttggcactatgtctcacatccaggtcacactgatgcaagaggtgggctcccatggccttggacaagtccacccctgtggctttgcaaggtgcaggccccccacccccttcccagctgctttcgtgggctggcattgagtgccttcaccttcttcagcagtagggtccaagctgttggtggatctaccattctggaggctggaggacaatggctgtcttctcacagctccactagtcagtgccccagaggagattctgtttgggggttcaaccccacatttcccttctgcacttttctgctctgcttcctcttgaatgctttgccaattagcaatttattctgcccaataccctaaatcatctctctcaagttcaatgttccacagatctctagggcaggggcaaaattctttctttgataaagcatagaaagaatcacctttactccagttcccaacaagttcctcatctccacatgagaccacctcaggttggacttcattgtccatatcactatcagtattttggtcaaaaccattcaacaagtctctaggaagttccaaaattcccacatcatctgtcttcttctgagccctccaaactgtgtcaacctctgtttcccagttccaaagtcacttccacattttcgggtatatctttacagcagcgcctcactaccttggtaccaattttactgtattagtctgttctcatgctgctatgaagaaattcctgagactgggtaatttataaagaaaagatgtttaattgactcacagttttgcattgctggggaggcctcaggaaacttacaattatgacagaaggcacctcttcacaggatggcaggagagagaatgagtgtaaacaggggaaatgtcagacacttttaatgccatcagacccatgagactcactcactatcacaagaacagcataagggaaaccacccccatgattcaattacttcttcctggtccttcccttgacatgtgggtattatagagattataattcaagatgagattttgggtgaggacacagccaagccatatcatatattttactattttatgagaacatcagttttcatttgtatatggaacatctccttaatactgacataaactattaatcagtaaactaataatggtttatgtcaatgtaacacaactctgattctgagggttttgcaaatatttattgtgctagataattatctttttttgatatcccaatgtctgcaagtttatcagttttgctctttttaattcctcacccactagtaatttcccaacacacttctgtctgattgctgcctccgtcattcccctgaaatacttttgctaagctcactgattttcttttttcttttcagaaaccaatagcctttttttcagttcttatctcactggcttgtttaacagcacttatccatgttgcttacctctttctctttgctctcactttcttgatttctcaccaatatctttgatttctttcattccaggatcttcatgtatctctttatttcctttaaatgctatgttttttctgggttcccacgcagtcccttttatcttctcatcttccctccttctctgcatttccctctctcatggcttcacggtagctgcctaattatcttcttccaagatgtttcttctgagtctcagatacttcagtctaccattgtattgggttagcaaactgaaatgtcaaaatcaacatggccagaacagaattccatcctaattacttctcccttcccctaatttgctcctccttctgttctttccacatgcttaagcctatttcttgggtgtcatctttaattcttcttttttacttactactaatccattactacagtctcaattttgtctcctgtttatcctgtccacttccttttctctattgccactgtgctatttgagactactaccaattcctatctggattagaacaatagtttccaaaccaattttacaatcactcatccagaaaatgccccaagaaagttttctttatgtgccttctccatttcctctcttacagttgttgaaccacacattgctgtcaaatactattgccaaagtaaagtcactagttatcatttgcagcagaatccaatagaaaattagcagactgttgatggactgatcatgtcaatacccatttaaaaccatttagttaatcactatgctgctgtgataaaatatagtcttttgggcttttggttaaatgtgaaaatttggccacatgttacaattcaattatattcacagaagtttacttataataagtgagacaattcatctggcaacacctaggatacatggaaatatgcgaaagacaggcgtgtattgcttaacttctcgggccaacattgcatcccagataactctcctccactttctcccttgcagtctttctggggaaaaaaaaaatgtaccaggaaggctcctcattcaaaattccagccagaatagagggcagaatgagtcctagagaaggaaatagataaactaaatgacagttcacataccggcctgcctattttcggaatgctggcatgccagtacacacagtccatgcagaaaattaaatgactcttctttgaagcaactgatcaattctagacacaataattccatgtactgactggatctctacccagtgggaaggtaactccccatctatggtgaaatcctttactataccctatctacatacaacaatttccagatagcctctaatgcacagtatcaatggacaatcaatgatcactgcacattaaaggacaatatgaaaaatgtaaatgcaaagggaaaaaagaaagaaatgagcaaatacagaaaacagacagtacagaaggaaataccccaaacctatatgaatatcctccaaaaaatgagaaaacagattgcattcttaagaaaataaattgcttccaaagaatcaataagaaaataaaaaagaacttcagaaaataaatatattaaaaattaaaaattcaatagaagcattggaaggtaaaatcaaagacatattaaacaatcgcaacacacaaaaagagaaagtaataggaagtaaaatgatgagacatttgaatttcattttaggggatccaaataataagaatgttggagaacagaactaaactaataaagagaatgaatttatcaagtaagtaatgtcaatcattttcagaaatgaagagtcatgactccctactgaatccacagtgaccatcacaatgaatgaaaacacacgtgcctacacacacacagacatgcataaacatacacacacaaagtaatcattgtgaaatttctgaatattggtgatgaacaaaagttactaaaatcttccagagaaataaaccaagaaacccaaaattgattgcataaaaaaacaggcatcagatttgtagctgtatctcagcaggaatactagaagacaatgcataaaaaatgccttcaaattatgagacaactgatttctgatctgaaagcatgtactcagttaaattatcagcaatcaagtgttagggtagattcaatagatttcaggggaggatatgcaacttgtaccactttatcctttttttaaatctctctctctctctctctctttttttttttttttttttttttttttttgagatagagtttctctctgtcgcccaggctggagtccactggtgggatcctgactctctgcaactctgtctcctgcgttcaagtgattcttaagcctcagcctccccagtagctgtgattacagaagtgcaccatcatgcctggctaatttttgtatttttagtagagatggggtttcactgtgttggccaggctggtctccaactcttgacctcaggtgattcatctgcctcggcctcccagagtgttgggattataggcatgagccgtcactcccggaccaattttattttctgtaaaccttttgtatagagctgctgacaaaaggagtaactaagaaataagaagatatggggtccaggaaacataacattgaatacataagaatgggaaaaaggatgactgtgagaggaagttttctaagtcaaaaaaaattaataacttaaagtgatgggtttgaacatatggaaaagatactgctaagcatttgacagatctgctagagcacttgagaaaaaatgaaataaatacttagaaagatgtgacagatacaagaaaaactatgcaaatggatagatactatgacaattataaattacaggatatcaaaaagatttccataaaaaaatcagtatagtattaccctaaaaatgaatactgtttttgtaggagcaactattactttaataaagaactttgccaaaactacggcagatggggtggctcatgtctataatcccagcatgttaggagcctaacgtggtagggtcacttaaggccaagagtttgagactagcctgggcaacatagcaagactgcctttaaaaaaaaaaaagaaagaaagaaagaaagaaagaaacacaagccaggcatggtgatgtgtgcctgtagtcctatcctagctactccagaggctgaggtgggaggatcttttgagcctaggagttcaaggctgcagtgagctgtgatcacagcactgcactctagcctgggggacagattaaggaccctgtctcaaaaccaaacagaaaccaaaacaaaactttgccaaaactataatatgggtgaggaaaaggaaagtagggagttggtggtaaaacagaaaatcaataagcattgccaagagttgataaaccaaaaacagaaaaacttccaactaaaggcaaatgatttagacaggtaaagttaattccagagcaattaatcaggttgattatgattgtctccaggagcaggaaacatagtgtataaagagcttgtgcataggaatgttgtctttaaaaatataagtattttggtacttttattattaactaggtatatttagtactctgataaatataaactttttttaaaaaaaactaaaggcgaactttgcatcatgatttctatggacctatataacctggtcttccatctttacagcctcatcttctaattgctccccttgtctgcaccaacctggtatatactctttctgccacacatactcctcactcaattatttcaatattccagactctttcttaatttctgggtgttccactttgtctttttaaaagaaaattattacgttgacttgaaaaacaccaattatatctttttctctgtaactcttagtcattcgttatgtctcagtttctctcaacatagaacacatgtattcttatgttccttggcactctgtaactaacttacaagagcacttctctagagataaaaaaaacaaaaatcaaagcattgaaaaattggattattgagtgagatctacagtcaactttctttgtttgcacccattttctgtacccaggtatctaggttcttccactgttcttgattatttctgaccctaaactgtcttttctatctgaatgttgagccatatctcacaaacttgtgtaatttttcagtctgaatttggcagatcttactcctaaatgctctggagaaacctctctagctttttctgggtgttaacttaaattcatagttctaccaccctccattgaattctgggatcgtaaggtcatagtagttcataaggctttccggtaaaccagattttctattcttgttatctattatttttaaaaccaggtgcagtcctctctgggaatctctcgcaacttaactctagttaccctaaggttgagtatgcacaatcaatcaatcaatcaatctctctatctctctaatcatcttttagagcactcctttgccatacatagcttttgactggctcatgcatattctcacctttctgcaggtacatatgagtccataatgttttgcggactcaataaatgtactctgtaatcacttgaatgtaattttatgaatgtgctttgacgacgtagtttgtcagagcagagcaattcctggatatatttcttgcagttcagcagcacttaaccagatggccccctatagttttgaagcagttaatgcaccttgaaagcaggctgacttatgagaggaatatgcttgtagggaatcagtaggaaagtttctatggcatagaatattgaagaagtgaaataaatactatatagttccattaaaaaccaaattaagtaaattaaaatgtgcattataataaacttatgaaatatgatacaccttatgaatgtaagttttgcattatatgtttcacattgatgtgattgaaacttaagcagtttcattagcaataaaacaaatcatgagttttatagtaatgagtctgaataggcatttatatacctatctactatcatgtcaattactagttctgaaaaagatcatttttaaattatatatctgggaatatattatcaaaccaggcctgaaacttattaaacagatggtaaaatctaattcaacttcatttaatactccttttctcttagccttataaaagcaaatgagcttgtcggcttttaattatgaaaatacaattttaattcataagacatatataacaaagcaagatagttgctaaattcactctctcctagtaacttcccattgtatacattcatttttaatttaataagaaaatcctttcaaaatttttaaaagaatcacattacccaagaagaggctcaatatttctagaaaataaatatattcttaagacacttaataattgttgaaatgaagacctaattcttcagcgtttcaaaaatatttgatgtgcactctttacatatatagagtttaaattcaataatttcccttcttaaaaataagtgaaacataccacaaacatatcaaagcaagttattcatacttaattctgatttaagttactgtattgtcattattattaatgagaattgagtagcaaaattattttatatcatccaaaagcacaaaagtcttattagaatactaatttcaatgcctgtttcacagattcgctcataatagatttttcatgcttctgcactaattcattaaaggacaatgttttacctgttcttgaaaaagtatcattatctggcctagagtggtggctcctgcctgtaatggaatcctaacactttgggaggccgaggctggcagattgcttgagcccaggagtttgagaccagcctgggcaacatggtgaaaacccatctctacaaaaataaaaataaaaaaaaaagtaaagcattagctgggcgtggtggtgggcacctgtagtcctagctactcaggaggctgaagtaggagaatcacctgggcctgggaggttgaggttgtggtgagccgtgattatgccactgcattccagcctgggtgacatagtgagatcttgtatcaaaaataataatcataaaataaaatagaaaataaaaatatcattatctgacattttaaaatgtatatttcccaacctataaatatacttcatgaatttttttttttttttgaggcagtgtcttgctgtctccaaggctggagtgcagtggctcactgcaagctccgcctcccgggttcaccccattctcctgcctcagcctccctagtagctgggagtacaggtgcctgccaacacgcccagctaattttttgtacttttagtaaagacgaggtttcaccgtgttaaccaggatggtctcgatctcctgatctcgtgatccgcccgcctcggcctcccaaagtgccgggattacaggcgtgagctactgtgcccggccacttcgtggatttttaacaagagaaaaatttcaagatattgtaaatttaaaacaaaattttatgtgtaataccattgaaatgtctttaaccagtatcaatcacgtgatatgaaaaatattaaatatatatttattgaataaatgaatgaaaatcataattaccttgatcactatatttaaaatttaaatgaagcaggaaagtaaatcttcctaattatcatatacttaactgtttaaaatcactctaatgacaagtaatacgctttcaatcttgcattataattttaaaattcctgtattgtttcattcactcatccttccattaattcagtgaacaaacattgattccttacccactaggtgctaggtattatgatagattcagggagtacaaaaacgattaaatgaggggatcagctggagtgaatgttttctagaaacaatgcctatttcagttatgaactagtctgttttgaagaaagtggtgaaggaaagctgaaaataatattttcactttattcaacaaatcttattgaggtcttattatgaatcaggggctctcctaggtatgggcatacgaaattgattaagaccatactcgcttgcaaaaacaaacgaaaaagcatctctataataaaaaggaaaaagaggaatcccctttgtaggtttcatagtttatagtgatatttctgatttagtctcagagaattagtcacaattataggaactcagaagacattccgatttgagatggaatggagaataaactggttgagattacttagtgaaatattgtgatgccatttacttcaattagaatataattataattcattttagaagatattatggcttacacatagtagatgtgatgactgaataacaggaatattgaacgatggcaccttggtagccatcagccattgccacaatgattctgcattaaaaaatctatgcaaaatagccgggtgcagtggctcacacctgtaatcccagcactctgggaggcgaggcaggcggatcacgaggtcaggagatcaagaccatcttaactaacacggtgaaaccccatctctactaaaaatacaaaaaattagccaggcatggtggcatgcacctgtagtcccagctactcgggaggctgaggcaggagaatcacttgaacctgggaggcagaggttgcagtgagccaagatcgcaccactgtactccaggctgggtgacagagtgagactccacctaaaaaaaaaaaaaaaaaaaaaatctatgcaaagctttggagtatattaataagcattttttgttgttcatgcacctctggtcagacccagttcagctgatctaggctaggcttgactagcattggcttgaagctgaagctgatatccagacctgttccatgtatttgttatcctcctcagtgcccccaggtacttgaagcatgttattgttatggcaaaattcaggagtgcaacctgcctgtgcaaaaacatgccggcttctgttgccttaaatcctctaagctacccctttggcttaagcaaagccacacagcaaggatcgaagtcaaggagtggggaattatatctgtcccttagagatggagattggggagagtgtgaacaaatgcaggaaaataatctcatctaccagagtgtccttaaagattttaacaaaataaattcagtattgtttttgtttgtttgaatgaggctttgcatggacacagtacagtacaaaagtactatttgaactctttctccacattcataaaattgctacatagtttctaccatgattatattttttatgatccatctttgtgtacagatctgaaaactttatgttagaatttattagatgaggaaaggaacatctactgaaatcatcgtatacaaatatttctcaatattttaatgcttgcggtattgttaatgtttctgtggaaaaatacttaaaatcatagaagtgatttctcagtcagttattgatttattctaatgaattatgaaaatcaaactaaattactaatagagaaattacatttgaaatactagtctgagctacaaatgagatggatttttgtgctcaccatttgtattctaattatttttgttaagattgggttattaagacgtaattataacattatcagcagaaaaccctgtcgtgctataattaaatcatctaaacaatcattttttgcggtcttaatatcctggatttctcaatttattgtagtagataagatttctctttaaatactatttattatcaatagtttgcttttctgtgaatgctagaaaatttagaattctgcattaacatttaataacaatatatactattctaatattgatgcattatatttatctacacaacatgcaacaagagagaactattgtataaattagaatatttgcagtctatggcaattatctgtagcaactttttttttgtcttcagaaaaatatagatgattttggaaatgggttagttctagtttcaatctaggaagaacaacttatggaagttttgcttacaggatactggtgttttcaaatataatgcattattattttagtttggtttcttttaccacatacttagaaattgttcaagtgaacaggctattaaaactaatggtgtagctacatggtatagataggcattgcagacatcccactcttcccaagccatgaattttatcactgggataaggagatgaaaatggagtcattgggaaaatggattctttgcttataattatttttcttcctttaaaaagattcttcaaagggcaagaatatggaagtatttcaggagacattcttgaggtatctaaaatacatactcttcctatcaaaatcaataaatagattgatgttagtaagataaagtcagggcaactgattttgcatgtgggtgtacacacagacacatatccacatattctccatctgttctcagttactgagctattagactcaactgaatgatcacttgactgtgtttaacctgataaacagactcttaacaagaagaacaatatttctacttctctgcatgcatcagccactctccttccccatcctaatctgccagattgtcctctaaatatcagttccacttggagacactagttgaagttgttgtaaatgacattaatgagtattctctctacctgctctcacatagattcaattttcataggaaggtctccatgggatgaagccaaaggacttagtggaataactctatatgactccataaagtaaagagagaatgttgtgagtttaacagagtgccccttcctttactaaatgtgagcgatgtttcagtataggaggccagaatgaaaagtcctaaagtttgtgtgtttgggcagccaacaattggtcacactgcacatttcatgttccaaagagcctcatggtagcataaatgagggacaggaaaagatgcttaactgtgcccagggctttaaaatggagcaagagcaagaattctagaagttgacaatatcaggaaggaaacctctgtaagcaggcacgtaggggactccagaaatcccttctttgcccctacaactctggactttcagaaatacacaccccattctcctgtattaagacagaattcatgcacacaacaacatcaaaaatcaattttaaaatagtaaacctaaggtagacgtaaagacattataacctcagcatgcctgagatctgaggagcaaagcagaaagatgtgaaggtgaagagaaagggacattgtgctaaccaatcatttaaaatttttactccagagaaacggcaatatttcacagattgtttctcatcatcaatctcacaagtataagtaggtttcaaaaattttcctctcaattcttttccttgacagtgaagtccagagtaggtttgtttagatctaactctttctcagcctcaatactccacaatcaccttggctttttggattatgactgggtggcatgtactattattttaatattaaagatttagtaaataattttaaatattattcttaaataactacaggctttattcatttactgtacatatttctaaaacattcataagaatgtaaggattttaattcaaatggtccctaaagtagaagatgcactcacagattatgcatatgtcttttaagaaacagaaatgtgccatttgttattaaattgagtagactttgtatcctttagaattttggcagggttttcttagggaatctatcaaccatatcttaattttcttctttttgaggttttcaaaattaacattggcattgatccactaattcgttgttttctatttttggatgaaattgcatagattacctccatcttaattttcaacgtaaacttttagcagactctttcatgtttcattgccatgtaagcagatgtgatttttattctttttccttttcattgaacagttacttcatttgaaatttttcacttgatttaatttcagtttatttggtggtagatacatctgttgctacctgtgtttggttgtcattttaatgggttgcctagaagctgtaaccacaatagtggtacattttcctgctgttcctttattctttgtttcatgtatatctattttcaagaaattgcattggtatattatcatagatttcctttttgtctctcagattttctattttttttttatttacgactttggaaacatttcatgattgttacatagaacatcagagcacttttagaaatttttcacggttttccaaatgcacattgatatagattatttagtagttattacaaaatgatctttggagcaataaatgctgttatgtaagaacaattcccaaatgtaatttgaaagttataagctagcctttgatggcctagaattaatatacctttataattgggtgcataattttcagggcccagtaagaagtgaaaatgtagatccctttgttcaaaaattacaaagaatttcaagatgcccatcataggtcatgcacgaggcctttctaaatggatagaacgaccatgaagccatgggcattgttttgttttgtttaatcttactgtttggttgtaaagcagatctttaaatcaagagaaaaaagaacaccaaagaacatctctatcagaatgtttaaaaaattatagaaggttagatccataaaaatgaaaggaataaagaaaaaacacatatccaacctcaaatataaagcatggaattcttatatgaactctattatagtgcttgatatttcagctatattttcatttttgaacaactctagatatatctattttattttagtctaaaatttaatttttataaattctaagtactgtcccaaattctaccgtagataaacaattcagagataactctgttttcttttctattaggtggaaccatatgaaattgtcagtattcagccttttttgtcctacaaaaaaaaatgacagttttatgtttccacctaacacatggcagcccaataaatatgtgaaggtcgggaccatacagctaccaccctaaacagtactaaatgcaaacacataccctttccaaaaccccagcaggtcttcttttccccaaactaatcattctttgactcttcacccattattcatgtgagaaattttccaggcacttcaacatgtcagctgagtgactgtaacaattggatttattaattctcctctcacaattttacattctttattgaaaagcgtgatctaagtgttgactaatagtctacatagtgacacatgcttactagttcctgtgacctaaaacagtataaaccatgattcagaaatttcttttcttaaaaacttctaaacattatgtctgctagcataaaatggtgcaatttctatgtgaaacctgaagaatttcaattacacattttcatccttattgccatcaaacaatccctttaatcatgccccatcttccttactccttcatatgattttctatcttattgttttccatcattctttctgttaaaactgtaatagtttctttggagaaattacagatttttccacttctgaggcattcctgcattgagctctcataaacctctctgacatggtgggcaatagactcaataatatttgtgtatgaattcacttgtgaattatgtaaggcttacgtataacatcaaaaagcaactcggtaaaaataattctattgaagatagtatgatctaaatgtataattttaggatggtttcagctgagacaaaaatagcattgatacagtgtggagcaatgaatttctaaaatttttatctgcttaacatttttcatcagcacaatttacacagaagcccaacgtcagacatccttgttcacatggaatttctgtgcctacttgagccctgtagaaatcccactgtgttagtaaacagcaacagcaacaagaagattctaagcttgaattctcagtggctcaaccaaaccaaagtttgttggctgctcacataaagttgaatgtcagtcagaataaactcctctatccttaacctatgacacgcattgcacataaccttcaaagtactggaagcggaaaaagggagaacttgggaatgaggcaggggctttttattgcttcagccccaaattcacgaatgagttgattcgtggcacttcacctcagagtctcttagatctttccatgtgatcccacatgactggaagtctctgaaatacctgggagtgcatgaatacttgcttagcattcattacatctctgtttatagactccgttttgctttctaagatgctccctgactcttgtcagaagcttcacataacatgctataaacacttatctaaccaaaatatcaccctataccctataaatatgtacaatgatgtgtcaattaaaaattaaagcaaaaaagtccactgatctaaagggatgatttcctcatgcttcagataattctttatggaatattagtctccaataccaaacttttcttaagaatttggctgcaaagaatccaatgttgtattttcagaaagagactggaatgccaaaatattgtgcctcaacaaaagaatgtgtccctttttgacatttgggtctctccgtgacttctgacagaaaggacaggctcacaggatgcatgggcatgtccaaaatttcatttctaaatgatttctggatctgccctaaccagggcatgagtctagaaaatttctgacctccagagtgcagacagtgctttgttcttattttggtccttcacatttagctctgaatttagtacttgctggattttaaattaagtttctttgacatgaaatgaaatcttcagctgcctgttacttccaaagcaggccctcaagctcaacacatacaaaattagtcttttcctcagaatcttgttcttccttcagagtttccaattttcattacagataccacctgtcagacagtcatttgggcttaacattttaaagtctgttctgggtcttccatattcattattctctatagtcaatcacattccgaggattgttgcctccaatgcatgcctttttctcaattttattttctcgtatcagagtcatgcacagattagctctcaaatgagctattgtaatggcctcctagcatctaaactctcctttttccaattgatggttctgccagagttgtcttcttaaatcagaggttagactgcatttctctaagtatattccaacgacaccaaaatagtaattcttaataagtattacaagtagggaaatacagatgggagggtttgcttagtaaataagttcataaaatctaggttaaacaaatttaaatggggtttgctttttgctgttgctttgttaatatgcatttgaaatttttaaagtggcattacatatccataatttcccttatctgtcaaagggatctagtttgtttagaagcattttttcagaactgctataggtcaaactttcagaaattcctcattatcaacggtcaaatccagatggattttctttggctctcacaacaggcttagaggaatttctagtctgttctcctgacatttcattatgtgcttctttgctcaggcctgtttaacctactcaacatgtgtatcttctactccatgtctttattcctactgttgttttaacatgaaatccttgtaacccaattcatagtttttgttctttggaaaaacccaaatcatgtatcatgaatacatattttttctctactgagattttcctgtttttatgtatcatagccagaagtaatcactgcatagagtatttctatagaaagataaaagagttccattttaacacaatatttactatacaccctgcaaaggtctgggtatttatacatactattttatgtattcatctcatccatgcaatgaagaaatgttaataaacccattatatatgctaaaaggtaccgaaacatatatgccacacgtccaagttttctcaggtattagctagggaagctgtgttgtaacaatcttcaaaaccttcctttcattgtttgcacactataccaagtcattttgttttcatttcatttgtagtatctagtgtattctactgtgtatcatagtgatttgtagttagaagtcattcccattggaatgtaagttctctgaagactgacactgtgtatcatttgatgtataactaccatgataatttgcatgtcttgctgaatacatgttaatttaaacttgatcaattttgttatattagctgtcctggtagtgttttatttgcttgtatatgatgcatcatagtttgtcttcattaaatatctctggaaacaagaccatattgtgtcccttgtagtggatatgtcctctcaaatacctgagctatgcttccctgggaccctctttttgacactgctgctttaagataagtcttaggatttaaaagttattaaggaatttatttttaaaagtgacaaaagccacttttatgaagtggctataaaacttcatagcctatgtcagtatacaaaagaagaaaattttctaggtctgtaccaaaatgggaaaaatcagaagttaaaagagaggttggcaatgatttagaggcagaagttttaaaaataattaattgaaagcatttttacatctgccttgcttaggtatcagaagtgaagtattgtaaaaaatgagttaagtatcaagaaaagttcacaaacacttttttgggggtaggctcaggcatgaccctgggcagtgacacattgcagattgctctctaaattattattttgagagtaatacttgcttttaaatatgtattgtaacataattgctttctgtgaccgatgttagctgtctgacggtcactgaaaataggaatacttcatttttatcttaaaaaactggatgtcttccaagagcaaagttgggatttaagttttgttttgaaacagaatagatagcagctgaagaatttacactgactcctggacaaacactgcccctttttggctcataaacatgaacagcgtcccagaaatgacttcgattattgaatgatgtgtttgatactgttcctttactaggaataataaagatagatggttgagagttcccatattccttgcagaggcaacgggaccccagatgatatcacttccttcaagtttcaagggtcacccttcacttcaagctaacagagcagtattcacaaacataccaacattgaccacaagacattcagtcttctctcagtttcttatctccagatctactatggaaaataatagatacgcataatagataagtgatttgctctttatccaaaataaaaatttacacagggttttaagctgaggggtatgtgagctagatttgcatttggaaaaaataattgctctgactgcagtaggcagagtagattaaatgggagctaaatagatatgggaagatgacttactgaatcatggcagcaggtcgtaacagtactgtggattaggatagtgaaaaagaaaggcaagataggtgaatatgaaagccatggatatactcttatggataagaataatctcatctgaattgctaatcatttggctctgaggagagtgggacatatggtattatggtctaaatgtttgtgtcttccaaacttcataggctaaaatcctaacccccaaagcaatgttattaagaagtgggacatttgggagatgattaagccatgactgcagagccctcataattggaattagtgctcttatgaaagagaaaccagagagctactagttccttccaccatgtgaggacacagcagtaaagcattgtatatgaagcagaagggtggccctttccaaatattgaatctgctggtaccttgagtttggactgtcagcctctagaattgtaaagaaatgatattttttgtggtttatcaggcatctagattttgtggattttgttataggatcctgaacagactgagacacattgtatcaggaacagcctttaggtttttggcttaagtttgattgatgggtggtataatttcccaaaatagaagtcactggaacacagctaatgcatgggaggagcattcgtttacctttagatgttaaatttgaaatgtttttgagagttaatgtcaagtgcaaaattgactttgctggttttgaccttaaaggataagttagacctataaactgtatgacaaatcaccagaggaaatagatctcatagatatagatgaaattgcctagggaaatactataaagtgacaagggagttgggtctatgactgagcctggaggaagaaacccaagatgtaatgtacccaggtagagaagtatgagatccttacaaatattactcacttaattttgaaaaagcttcctccctgtttcccactcctatcttcactctgtatatcaacagattttaattaccaaggtatagatatttgtgacataacagtgattgtattaactaggataagcaaactgttataaaagatgatgctcaagtctctctgtcttgccgtgataagtttctgtctcaccaaaccaaccaataaacctaggtcacaagctttgcactgaagagtgactcaaggatgcaggcttcttccatcatgtggatcttgcctcctttgccttaatggagtcctcttcattcaggtagtgggtaaggaatgggtaagctgaatcacacagtaggttttagtaggatttgcttgggggtaacctataacgtttctgcttattttccactgacaaaagctcaacaacatggccgtctgagtgcaagagaggctgggaaaagtaacaaattaattttgatgaccacaaagcatcatttttgccacagaaatctagccagagttaaagaaacttgtaacgaaagtatacatatttggttttttataatttttctttcttaaatcatacagtcttgttattattcagtctaccacataaggggatgtatccaacatgttccattgtttagagagaataggaaacaaatagtcatgtcatcattctaggattttctttgctccaggatctcaaatagatatctcctctgaaattggctcaggtttctaagaaaatagatagaaaggaacaaatttaagcatgggagtcaatttgtttgagagtctgcatcctttcctgatggggccttgggagccatctactaagcagctggagatgaattccactgcagctttgacattttccaagccagtcatccattcttccctgcttaccactagggctctcaaaattatgcatatctaagtactatatgtgagctgttgctctactgctgacggcttatctcatatgcacagtggtggagagctgcaccacacagtcttccattaaacagatctgaatgcattctggcttatttgttgttcaagattttacccagatatatccacaacagacaaacacagtacatcttatcttccctaatttaaatgacaaatctttgatttctctatgcctatgacccttgacaaagaaggcagtttggtcaactatcatgtaacaaccactcatgtaaaggtgtcccattagcttgggagtccctctttctcttgagttattttcattcaaatatcttaactttgatgaacataaacacattatgtttgatgagagagaaaaaggatggcaattatttctttgaaaatgttaaaagtatattggacaatataggtctctttttacgtgatgtttctgattagatttagctgagcttttacagaagagcgagttggaggtgggaaattgggccagcaagttaccatctgtggcacaatgttgaaatcctcaccggtaaatgccttaatattgatcttttatatgggtttgaagaactgtcatgaagatctattgacttatatggctacagatgaagcttgcagatactgttttccagattgtatttttccacactaggtttttacaaaaatatagttgggcttgttttgaaagatacattaggagagagaaaatggatttccaagattggatagacagaaacaccaggttcaatttatgacttcattctgaattgtatataggtttatttagaccggataagacaagcaaatataagtggaagctagaaagataaaccttagggtgtaaaatagcaatggctcaaagatctaagacattttattatctagagaggcgcagaagtctaagcacccttcattttcctgtatgagaagtgagaaaatacctgtatgaacccaaaacctgacccccttatattggtaacacatctgatatgtaagtatgttgatattcccctatatgtatttgaataatattttatgaactgagaattcatgagaccattttcaagtacaatgggaaactttggagatttccggagcaagttcagctgagatttgtggcagcctagagctcagagatctatactaagtgtgttagtctgttttcattgctaaaaaggaatatctgagatggggtaatttataaagaaaagaggtttatggtctcatggttctgcaagctctacaggaagcatattgccatcatctcctccactgctggtaaagccttagggagattttactcatggtggaaggtgaagaaggagcaggcatgtcacatggcaagagacagagcaagagagaaagaggggaagtgcaacactcttttaaacaatcagaacttgtgtgaacacagagtgagaactcactcattaccacaaggcaggcaccatgctattcatgaagcatccaccctcatgacccaaacacttccgacccggccccaactccagcattggggattacatttcaacatgagatttggaggggaaagacatccaaaccatatcactaagattgattcctttgaactaagagctctagtgatgctctaccagtttacagaatagatgtcaaggccactgcctactggccaatgtttaaagagcatcctgtacccagaagattcagggatggaaagtaaaaatgtaagcatttgatttcttcctataagaaaggtacttaattcttccatggtatattttatctgtccttatgaaacttgcctcctacttacatcactgtttgctattaaaaaattgacaaatgtaggtatgttaaagtgtctatataaatattaaatacatattggtatacattgggcaaaagacagatgctttaaaattatgtgaaatatccttgaatgatagttttagttttctgttttcttagtgataatgaaaaagaatatctttatactgagttttcaatttttataaatatgcaaaaatgtagtgcctgtggcaattgaaccctttgtgatttttaaatgactactgtcattacttagatactgtaacattttaggagttaagtaaaaatattactactagaaaaatccctgttttttgtttttgcctttctcgtagtgctgatcaatatatatttatataattcttaagtgaatgatagaaaaaaattacaaatagaagttttagtaatgctatcatgtaaaaaaattatccatcttcctcttttatacaggctaacttgatatgggattttatctacatatgattggctactaatctgatagcaaattaagaaatcatagaatttatgaactaaaggctgcttaaaacaaattaattttaattctttacatatgaacaagcaagattcagagtagttttacttactctgagagtattagttaatatatgacgtagccaagggaggctagaactctaatctctaggttgaattctctttctaccatacataacatcagcaaggctgaatcttgttgggtgtgacagagaccactgtaagcatctcacaaatattaacacttggaattctctaagtagctcttgacttacatgtgtatagttttcccaagcatagagttcatgtaaattattttaacatggatttaagtagttaagtgacctcatcagatttacaccttaggaaacttgttccaagatgttaaaggatttattggtttgacagtaagtgaagttggagaagaaagcctctttagatgacttcagaagattagaccacatatgagaggatgaagtcatcaagcaagactaccacgagggctgaagaaggggttgaaggagatggaactgacatactgaattaatgatttatgggacacatgagacaaggaagccagcaatgctctacccctgtaatcatatagtccaaacttttctatcctccttacaactcttttaccccattggttccaccacatctcttttgggccctgtttagacctcccatcttttaatgcttacatggcctcacacatcgggtctatccaacctagattccactctccatcacttaacagttcttgataatattctcaactcccctattctattttgttttaactggaaaaaccttcatggatcaacccagttgtcttccttctttcttaaccctgtgctgctggaaaatcctaaggaaaatctctagtagtccatagtgtctattgtttccatctttatgtctgtgagtaccaatgtttagctcccacttacaagtgagaacatgtggtatttggttttctattcctgcattaatttgcttaggatcatagcctcaagctacacctcttttgctgcaaaggacatgatttcatccttttttatggctgcatagtattctacgttatatacatactacattttctttatacaatccattgttgatgggcatctaggttgatttaatgtctttgctattgtgaatagtgctgcaatgaatgtataagtgcatgtgtccttttagtagaataattaattttcttttggttgtatacctagtaatgggattgctgagttgaatgatagctccatttttagttctttgagaaaactccaaactgctttctacagtgactgaactaatttagattcccactagcagtgtataagcattcccttttctccacaactttgccagaatctgttgttatttgactttttgataatagccactctgactggaatgaaatggtatctcgctgtggttttgatttgcatttctctgataattagtgataatgagcattttttcatgtgtttattggccttttgtatgttttcatttgagaagcgtctgttcgtgtccttagcccattttttaatggggttatttgttttttgcttgtttatttaagttctttatagattctggatattatacttttgttggatgcatagtatgtgaatatttctcccattctgtaggttgtctgtttactctgttgatagtttcttttgctgtacaaaagctcttttgtttaattaggtcccacttattcatttttgtttttgttgcaattgcttttggcaacttagccaaaagcagttctttgccaaggctaatgttaagaagggtatcacgtacattttcttttatgatttttatggcttgtttttgtcagtgttatcaaagatcagatggttataggcatgtgactttatttcactgctctctattttattctattggtctatgtgtctgcttttgtactactaccatgctgttttggttaccgtagccttatagcatagtttgaagtcaggcagtgtggtgcatccggctttgttctttttgcttaggattgctttggctatgtaggctctgggcttttttatttttattttttgacatgattaagtattcaatccagtccttcaattatttatttcccttcaggtattaccctgtctctatctcccccttcctagccaagctgttgaatcatcatgcttattaaatgttcctggggattagttcctaggaactctctcttcaaagtctgtttcacttttctgggcaacattctcctccatgtggcctcttaggtggactgagaatcttacatgtctagatccctcaaaatcatgggtataaccacagctgaatgatcacattggttcagatatcaatttgtgcagagggatcatgttttagccaggtttatctctactgtctactacctagctcaaagtgggcacttcatgtatgtttcctcaatcacttctgcaaagtaaataaataaatttcagtggtaaagtgaaatagtagtatttatttgtaatttgattggtaataaatgtgatttgcatacatgtttccaagaacatctctttggtaaagcaagataaagttatatttccttccctcatgctttcttttgcaacatactcaacaatagaaattgtgcatattcaagttgtacttcttgatggtgtgatatatgtgtatattgtgaaatgatcaccacactcaagtgaattaatgtatccatcacctcaagtgaattaacatatccatcaactctataattaatttttttggtgataagaacatttaagatctaacttcctagcaaatttcaagtatacaataccatactgttaactatagccactgtgctgtccaatagatctctacaaagttatattgttggtcttatttatgtaagcttcaatttacccttttctttaaggatcccatatttacctgactaaaaaaggtaccatttttactcagaattatatgagtaaaaatctgccctctacctttaattccataatagacttaattcatatatagctttacttactacatttcttgttacagtcattttatcattcaagctggtgcatacagtccatcaagtctctaacaatagaacaatgacacaaaaaatggaaatctatactatgaacaggtcttatatcaaacctttctgattaattctccctttagtctcaacttctaactcatcctgactgaatcaatcaaaaagctattactttcatacttggaagtgttgctttcaaaatcaataaaaactcagctcatttttaatatgcaatatattacaaaaatgaaaatttccatttacttcaggtggaaatttatgaaaaaagtagagtagttgaaaactcttgtgaaaaaaatatagatatagatatactacttttatgacactgaaaactttcatcattattaatgttttgtatgtgtgtgtgtgttagatatataatttaaaagaagacaataagttggtgccttttgtcaaattgttgctcaagtcatgcatctgaaacataggcactgagggaatcagcatatttgataatcttttaactacaataattatacatgaaaaatacattaaccatccatatacatatttaagaaaattatatttaagctcttcatggagacattaaaaacaccatgctgcataaatgataaataattatatcattcattaataaggaataaatagctctgttttttatttgagaattattaattggattgtccatctgtatgcaggaacatctgttttctgacatgctttaatcaccatttgttttgtacttgtaccataattacacatgttgtaatattgaactcaagacaatgatgaaaatcaacttatgcataagattctgctatgctttttcatttcattagaaaatgtgtaattctggtatgacatttataagtatatataaaacaaagtatttgattaacaaaatgcctcaacagattatgtcagttaaatgagtgttatatcatgtagtgtatgttattattttggcaattttaagaaaagtttattgcttcactgaagctttttttttttaactgaccatctatgaattttctgtattctttatttcagtgtgatcacatggttatggaagagacgtttttagatcatcagaagttgacagttttcagtgtactgtatgtgctttgtataagatggaattgagtttggtgtatgagtgattgatgaatttttactgaatgatggataactgctgttcttttaatgacatttcatcaatcaactatttttgataaggttgatcacaaaatgttgctgactcaatttttgtggattaactgaggtgaaagtgatacctggtagaagtttcactaatacaagttttcctctcttaggagtaggacggattatattatttgtcgaaatacctttccatgtaagttcttaatgttagctttcttgtcctgtgaaccatatcttttctgtatttgctgaaatagagatgtaacattgttaaatcatggaaaatgaatgcctctaaatctgcattccttcttacaaattacaagtttgaaatgacttttttttttaagaaaaaaaagatggatttctggtattctatggcagaataatctcctgcagcctgtctttcatgttgattacaactcaaaatatgaaaactacctaatggttccccacaatgagtggcaattaaattagactctatgctatttttactttctcaacttctcctgaactatttgattttgatttttgtggcaggatatttctttttctttttctttatttctttcttttttttttaagactgagtctggctctgtcgcccaggctggagtgcagtggtgcggactcagctcactgcaagctccgcctcctgggttcacgtcaatctcccgcctcagcctcctgagtagctgggactacaggcacctgccaccacgcccagctaatttttttgtatttttagtagagccatggtttcaccgtgttagccaggatggtctcgatctcctgacctcgcgatccgcccgcttcagcctcccaaagttctgggattacaggcgtgagccaccgcgcccggcctgtggcaggatatttcttaatatttgcctttgtgccatttaatgtgttcatactattatgggcaaattttgagatttaaaattaacccattactctcagctattctagatgaggcaatcagggagctaattcctatttcccctttcttttactctctcctcctagttgttatagttgaattacttgtacattatcagaatcatcagtaaaatgtctatttacattttctataccatatattccttaaatctatataaatctatatatgatgcatttaatgcttacctcttgccttactggtagtatttcacctactccaaactaggttgactgaactttctcctgtggtaaatctcttaataagaactttctgtaaacagcgttccctgcaattatgggcgcttataactgtacactttatagctgatagatatgttgcaaagataaggataaccactggcttctcctttctcttctttctcaatatttccccccattttctggtgttaacttttgctatggaaaactctgaggccaaaatgattttctttttctgtaagttagttgactgtttttgattaaaccccaaacaataatttcttaatctttaaagtcttagtcccacacagagatatatcttggagttgaacattctaaaaacatatataagcatataatacaccgtaatataaatatatgtgcttatgatgatctatcttggcttaatataggcaataactttttcctaattctatcctatgttttacagtttttggattttaggacaggggaagggattcattgcatattcttttctcacttacaccctttacaacccttacattatttggggttcagtcccccttgttctctttacaatttagtttttttgttctacaatgattttgtttttaaatcccatttctttcatggattctgccagtttctattgcactttctggctatctcttccccatgctcttgtatttcacttcatggtctctttatcttttattacgctcttaaaatttatgttggaatgtataagtgttcattcctattttcatctgttttgtagcaacaggtttctggtgattaagagagttgatatattcctttttatctttattcttatagtatttttacatgaatgctgagaaaattcctttagtgtttctcatatgtgaaagttgaatttccttgactggttaatagcaggactttcctctaggacgaaggaaaggggttgtagaatgtgccctagcctggtagctcaagggcccactcatcatttgctactgtgacagactgttgcctcatttgggggacattatggagccactgctgttctgcttggtagtgcccaaaatggtttgggacaatttccatctcaagccttacgctttccctgtttgccaccaacctcccttcaagtgatacaacctgatacaacccttgcgttgcaaagtgattcatacacttttagaagttattattttgtagttatttttcggggaattcgcctctgagccccagtgagcattttttagagtattctttctccatctccctgaagactcctatcttgttggcacttaactctggtccagcatttctgactgtggtcgggggcgggggcttctacttctgggttcatgtatttgcttgtgagtctctaatgatctaaccccactaggactcctaccttctgttttttatgctatttatgtctgatttcccaaaatgtactccttgctcagcttagtactgttcgtgacagtctgttatataatttgaaatttggggtctttctttgtctcatggtttctctgaaaataaagcttactgttttgtggggattttttttccttctgttttctgggagaagtaagatgattcagaactaagcgctgccatggaaatgtatgaatctttgcatgtgtttaaaatataaaaaggcaatatttaaatttaccattactccatatgcttctccatctacctcttttcagaaaatttagtttgctatctgttttaggttttactctctaacataattatatataaaacgcaatttcaaaaaaaacgataagaataatctaggctctttttgaagggaagtagtgaggcccaacatctacagaagctttcttttttggtaatcaattctgtattttctgtaatataaatttacctacgtaggtgcaaattatccctaacacctcagattgcatgttacgtgacagccccggtaagtctagtgaatgaacagcagatgtcactgttggatgaaatgagctagtctgctcatcccaccttctctcatctgaaagtgcctttcggggtccaaatcctggggtttatagataacgagaaaaaaaaattaaaattaaactcaataccttgagtctgtttcatagcttggcctggtaccttaggccataggatataagccagctttgcaattaactcgacttgttcatttgaaattaaagcacattttttttttcagagtgtattctgcatagtggaaaatgacctgagatgtttgaattctgaattcttgtgtcttactttgtgctattgtttccagtttttcaacacatacctggaggtttaactccagcagcattccatctgttcacgcagggcttttaaggcacaagtgacattgttaaccattgcacacagaagaaccctttagtattaaaatgtagatttgagcaaggtcagattacttttagtgtattcatctccaaaaattcaccttctaatatattttactatacaatgttacgttttcaggtacccattttcaatccttattcatactgaggattcaaatttggatacttgtaattttcagatagcattcattttatgtaaaaaaaaatataaagaaaatgacagcatttcctaggtttagaatctcactacctctattctcctgctggctcctcctgctaacttttgagtaatttctccctttctgggtcaggaattcttctgggttacaacttatgtacaaccagtatattgttattaattaattaagtttaattttggtctccagttttcgacttcataatttattcctactcaagtattcttaattttgtttcaccaccccattgtagaagaaacaccaatcaaagaagcatgacattttaatcttaatttcatcagcctttgattgacaagctcatataattcttgctgcctaatgtgctagtagagcagttgagagcacgactgaggaaacagtggcatagaagacacattcagtcttttgaagaattaaagttaaaattatttagtagatttctgtcactatttattttgcttccaattctgcaattacattttgctagttggaagttgggacgggaaggagcagagtttcccgtccccccaacccctgcagcaacagcaacccagagcacagtacttggaccataataggcatgtagtagttgttgagttaatgaaagaatgattgagttgatagcactttgggaggccgaggcgggtggatcacgaggtcgggagattgagaccatcctgaccttgctcaagtctacattttaatactaaagggttcttctgtgtgcagtggttaccaatgtcacgtgaccatcctggctaacacggtgaaaccccgtctctactaaaaatacaaaaaaattgccaggtgtggtggcgggcgcctgtagtcccagctactcgggaggctgaggtgggagaatggcgtgaatctgggaggtggagcttgcagtgagccgcgatcgcaccactgcattccagcctgggcgacagagggagactctgtctcaaaaaaaaaaaaaaaataaataataataataataaataaataaatatacttataatgcttattcattacgttactaattttagtctaataatgtacaacaagcaaaagtgaaatttgaaaaagaaattgatattgaggacgagcatagatattcattcattcattcattcattcaattaatattcattgaatgtgtactactttctaggcactgttttgggctggggatacatcaatgaattctctcttatggaacctacggtctaatctgggaaagaatttgaggtgaatgttttagtcatgttgagcttttttttaaacagaaaaatcaatcaactaagttatttgttaaacataggtcactttttaaatgatgtttaaaaataccccatgagttcataaaatatgtgttgaggacaaaacaaatgcaattttaataatacaaccatttattcaactttataatttctctctgatggctagattttggcacatgtgataagtacttcaatccattttgtaacaaactgggttatattggatttctagcatatgttaaatacaaggcaaactgtaatgctgcagagtcaaagtaaattagccatgcaatggcacaaatgcaattttagtatgctttgttagtgtacatgtcagtcatgtttttgttttttcttttgtgcatttattaccatcaagagagacatatggtatgtcagtggtacagcttactaaggtgtctgagagggagatattaagaaagtgcaccagatggtacttagctccataagagcacagatgattaccaggtagtcgttactatcttctctccttgatactcatacataactcatggcacatatggaagcaaccttctaaatactgatgttttatctttgaaatgttctttgtgtgttgctgcccatttgttttgtgctaactcactgccctattgccttcagttgtaaccacctatttaaggtaaaaacgaaggacagtcatctccatgtgttttcagaattcaaatgaaaaaataaaaagaggctgatgtcacttcccagtttaacctaggggttttgcttatgtatgtacactcaatcaaactatgaatattacaaatggttttaccactacagtaaagatagttaattcataactctatagaaatgaacagtgaaagattaaaaaaggaaagcaacaattctaaactataaaatctacttcaaaaacctacatacagcaaaaagaaaataatgagataagttttatggttcaggagatacctttctatagcatccttaaaggatgctaaaggtatagcttgctagagtatgtggtaggagaagttaacatggataaaattaataacactcccattatttgatggtctatagccaaagaataatagaaagcaagtgaaatgcttagcatagccatttaatctactaaattaggtttgtgaaaatgggaatgccaaatgccttaaggcttactgcaggtacaaaagcaaaaaatcagaggtcaacctaaggatatttttaatataaaattaatgtacctgcattgtaagcattatattattttgcatggtagaaaggaaaaaaattcttgtattattctactataaatgtgtatttgctctactacatttgcatgtcattgtcagcctttcactttgtctttagctaacaggaacctcttggcttcaccctttggagaatttgatatcatggaaaatggactgaactaggagaagagcctttgtttagaccgcatgctgaggtctagtggcatcaattaaaaatatataaatgcttaattaagctttggagggaacagcctatctacagaaaaatttaaaacttggtcatggcaggtacagagttgggccccattaattttgttgacagcagggtcagcagattctgtaaattttcactatacctcttttatgatttgccaccacaccattcatgctctaaccttatttctcctcacaccaatagcagaatttttccctgaattttactaaaactgccaagtttttttttttttttttttcatgaattagcatctttagcattctcttccttcagcctgggatgaaattctctgctcccctccctcctcctccctcccagccccaccctccactaatgcacatttgtgttttggtttctacaccaaatgagctaccttcaataagcatcccacaaatccacagggaacttttattactctaccttctgtgctgtctaagcacttggctcagaatgagagatctgtctgaatttcagatctacaaattactcattgtgtgaccttggacatatccctaatatttttgaggttcagttttctcttccttaaagttagaataaaaataccaaattcctgtgtttcatgagagtaaaatgagatgatgtttgtaagagactcagcgcagtgtcagtatctaccatgtgctgtatactctgcgctttctactgttgatgctagtgaatgtttttagtatttgctatatgccaatagctcttctaagtaaactctatgtgtaataactcatttaatggtagctattatcatccctattgtaagaaattgacattggggcacaaagaggtttagaaactagctcaagatcgcataccagtaaatagcagagagagaatttgaacccagggactatggctacagagtcctcattccctctgctgcccaccacacctaatactatttctactgctattactactcctccaatggaaaaaactgctgacacactgttttagggtgtgtactgatcacattgttttataaaatttctgtgtatcactctacagctagtttaagagctccttgagagtgattgaattatctgttttgcccatttagcatgcctggcctgtactaaaagcttattaaatatttactgaagaatgaattaaccaagttcaataaacatgcaacaattttaataattataaattatctaaaagatcattttattcaaccctgtattgatctctgttttctatcagagatgttataaataaaccatgaatacataaaattcgagaattactaaaattgacaaacattgtgtgtgtatatatatgcatgtgtgtgtgaatatatgtattatgtatatacagaaagagagagagaaagcagaaagaactgttcgttaactctcttgattgtgaattctaaatggaaaatgcaaacaagtcttcagtgttaaagtacattcatacttttaattcgtttagctcagtcagtttacttaatttcagcattgctgaaagttgtgtcagaagagacacaccttctgaatacctaaatagaattttggtgacatttttaaagcatttattacagaaaacagaagatgctttcagatattagttttctgcctactggtcacatttttacaaatgttaggactgttttcatacagagaccatatggttgactacagtagaattaaggaataaaattagaggtgtgtctccaaggtagaagaaaggaaaacatcaaaattagttgtaatggtagaaaagtaattccgttttggtctaaaaaatgtatgttgctcagtgcactgagccatgtctcatcaaatcaacatttcgtttgtctaattagaagtctatacaacatatttactacttccaacaagaaagttttccacataaaatctttctcttatgaaattataagtgcttgaaaataagtaaatgggtaaagctgtttttcttgaagaagagagcctcattaaaatgatgactaactgaattatttgatttgaataattttaagtataatgtaggcaattaactgaaaacagtaacgacttttgaatgtctcttatttggtatatgttctgctaggtattatgaatacagaaatcagtcttgtcatgttaccattttgggtgatctctctttctctctctctctctctgtgtgtgtgtgtgtgtgtatgtatttgtgcatacttgtgctccaggcactgcagtggttactttagatagatttcttctattcttcacaacaaatattcattagatgttagcaccacttcaaagattaaaaagaaaaacaaatgcaggctcagtgatgttaagtaatgtacctgtttaccctgcaattaaacctcaaagccagagtgtgatcctgaatctgtctgcttccaaagcctgtgctttgcatatcaaatcaaaagttcttcagaacatggccctgctctcacaaatccatattggcagataaatacaaatatcaataatatagtgtaataagcagtatgtttgcagagatatataaacaaaccagaaaccttgagttaccaaaaagaatctctgggaatgaagcaataaggatcccccaatgagagtatatgcttgagaagtgtaggaataggttttaacaaatacagaagagaattttttccaggtctacaggttcaaaagcaaaggagaggcctattatttcaggcacattcaagaaaaaaaatacgtagtttgataatccctgaacaaaaagatacattagataaatatatggaaatagagaggttggctaaactgaaactgtgaatgccatgctggatgtattggactctttcctttgggaaatggagaaattttgatgatgtattactctgttttgtattttcaaattcatcctctaaatgtcagaatttagaggataaattggatcagtgggatttaaagcagataattagacaattattggcttaattcaacaaaaagataacttggtgtcctggagaggacaataaaaatgaatattagagacttttaaaagtaatataatcttaaaactttgccactaattgcaaatgggatgaggaaaattaaatgctcgaagttgatgtcaagatttatggcttacatggcatagttttatcaacagagaaaggaaacaagctagcaagcacacttggggtaaggtcattggctaattttgcagatatgttgagtttgatgtttttgagctggacctgatgaatatttagaaatctgggaatttgaagttaggagttatttttgaaattgcttcttggtaagcctgagaactatatttccaagaattccttgccaggagagtttagaaatttaaactgattcttgctgtgggttggactctatgtcacccctctgaggataaagctgaaattgtagtagctaccgagtatgtacaaaccaaattacaaaataaaattggtaaatctcttctaaaatcaatcaagggaaaaatgatagaagacaccaattaacttgtaaagaataaaaaaagggtacattgctaataatagaatgtaattataataggattgccctagttcattcgggctgctataataaaatacaatagattggttagcttataaacaaaataacttaatttctaatagttctggaggctagggaggtccaagatcaatgtgctgacagatactaaatctggaaatgttccatttcttggtttataaatgggcccttcttgctgtgccttctcatggccaaagggcctagctagtacactggacctctttcataagggcactaaccacaattataagagctctgccctcatggcctaatcacctcccaaataccacacctcttaatatcaaccgcttggtggtttggattttacaatatgagttttgggagaacacagacatttggacaatggcaaagatataaagaataactctatgccaacatgcatgaacaattacatacacatcaagaaatttttaggaaaaaaaactttcttatgttgacaaaaaattatgaatggttctatatttgttatagtaatttattctgtgatttaaaatctttaaatcttaaaaagatacaattccataaggcttcactagtaaggttttgcaaccattttaggaaggcatgacatcgttctcataccaagtatgctaaagataagaaaaagggatggctagtcccaacatattttataaagccagcatataatttaaattaaagaatgttaaagagattgcaagaaagaaaaataacagcccattttctctatgaataattacttcagatcctaaacaaaatatgtgtaacaggaatcggtgatatattgaaataataacacatacagaccaatattgttttattccagagatgcaagcttggtttgatattcaaataacaattcgtataggcatcaaaataaatacaaataagcaaagtagaggagaaaatgtatatgcataagcaactcagtagaaacataacaatatttgataaaatttaacttccacgtataaaaattagacactactactaaggggaaatcccttaacatgataagtttctaaaaagaaaatccatgaacaaactccaaaggctgtaattaaatgtaaataattaaaagatttctcttgatatttgaaatgcaaaaaacatactttaagtactaattctgttccataattactgtagtagatactcaataaaataagactgatatctaaaaaacccaaaaatgtaaggattaaagagaaataaaatcactcttactgacaaatgatgcaattgtgtatctgtaaaatccctaaaatttccaaagctaatcatgattataattaataactgattttagcaagactattggatataagcttaatttcataaaatcatattcctcatttccaacaacatacttttgaaaatattttaaaatataccattaaaatgccattaaaatatcagataattaggaattaatctaactgaagatatacaagatgtatagcatgagactatatgacattgagaggaattaaatgagatctgaataaatgcaggaatagatcatgtccctggactagaaaactcaatattgtaatattgtttattctccaaaaattaatctggatattcagtaaaattccagtaaaatttaatctatgtgtgtttatgtatttaaattggcaagcagattctaaatcaattggaggaacgcaaatagccaagaacactcaaattttaagaagtacaaagttagaagacattatgcttctgcatagtaatacttattataaagcggtattaaatgttatattgtggaagatggctgactagattaacctggtacacatctcctggacaacgaagaagcaaaatagcaagtagataatcacactttgaatagacgatgtaagagaaaatgctggaataaaacagagaaatgacaggaaacacccaaatcaaggaagaagagggaagcaaggcagcctggttagccacctgggatttgttgggagcccacagaggcaccccaacttagggaaagggtaagtgggagacccccagtggtcccattcccactcctagccatgggaaagcccctcaaccctcatgggccctaagactaacacagggagcttctgagagactgtacaacagcattcctccagaggagcataatagcttgtgctgcattccacactctccctgaattttaagcagctgcagcatggtgccatttgagatctcagtccccaacagactgtatcctgtcctgtggctaaacacatcgctacaactctggagccccattgatatcacctgcctgcagtgacagttgcagctggttactaccagcagggtcaaagcatgagcagtttacaagcaccctgaggacagcctatgcagcctgcagctgccacctatggctgaagtacacactctccagctgcctgcctacagtacatctgctgccactgaaagccaaccaccctccccagccactgctgctccaaccagaacatttcaccaggggcttgagaatcacctccccagtgcctaccacagccaccacctgtatgcagcactggggagcctgaagacaggcccacccagttcagttttctcccccccaccccaatactcaagcatgccacctggtggcatggatcttgcccagccttgtgcacaactattggctcctgagtgctttttccaggagcaggaggttgggcccacccaacctgccattgtcatcacagctggcacccaccagcatgcattacttatgggcctggggactggcctgcccagcccattgcagctcccatcaacaccaataaggacctcttgggaggcacagggttttcctgccactgctgctgccattgctaatgccatgtcatactgcctagaagcttgaggatccactacctgcctggcccacagctgtcactgtagcacccaagaaagccgccagaaatggcctgcctgtgcccactaaaactgtatacaccatcctggatcccaaggaaaggcatgctaggcccactgtttccaccactggggcctggagactgacctacctggcatccctatctccagcaagactttaccacagcttcctctaatgactgcaaggcactaaggaaatcagagacaatactaccctgtttacagctgaagaaatcatatggaaactacactaatgtgcacacccagaatcaaagccaaagtaccctatccaattattaataacaccagagatacattatcaggaaaaagtccttccctgtgaaagcaaattttaaaaataggaagaaggggcttgtaaaagagatgtgaagatatcaaagtaaggacacaagaaacatgaaaaagcaaggaaattcaacacctccaaagggacacaataatctttcaggaacaggttgcaagcaaaaataaatttttgaaaaccaagaaaaataattcaaaataatgatattaaataagcacagtgagatgcaagagaacagagaaagacattacaaagaaaccagaaaaacaattgaggatataaatgagaaatttaccaaagaggtacatatcatagtaaaaaaatggaaattctgggactgaggaattcattgaattaaatttaaaaagtacatttgaaactttcaacaataaactatatcaagcggaagaaagaatttgagaacttgaagacaagtcttttgaaataactcagaaaaagattttgtaaaaacgtttttaagtgaacaaaccctatatgacatgtggaacaccataaagcaaccaaatattcacattttaggtatcccaggaggtgaagacaaagggaaaggaatagaaaacctatttaatgaaataatagctgaaaatttcccaaatcagctcgagatttagatatccagatacaggaagctcggagatccccaaatacatacaattcaaaaaggtcttctctatggcaaatttcaaaaatcaaatacaaagagggattgtaaaaatagcaagagaaaagcacttagtcacttataaaggaacaatcagcagatttctcagcagaaaccttacaggtcaggagagaatgggatgatatatgcaaagtgatgaaagaaaaaactatcagccaaggatacagcaaagttatcctttataaataaaggagaaacaaagtcttccccagacatacaaaagctgagtggatttttcaccactagactagccctataagaaatatttaagggagtcccacacctggaagcaggaggatgatatctaccatcataaaaacacatgaaaatttaaacccccggttagagcaaacattacgaaaaaaggaaaagaaaaaactcaaaaattaccactacagaagattaccaaagcacaatgataaaaaataagagaaagaaatgaacaaaagataaacaaaacaaccaaaaatcaattaataaatgacaaaaatgagcactcacatattgataataaccttgaatataaacatattgaactgcccacttaaatgatatagactggttgattttttttttaaagaaagcatgattcaaccatatactgcctacaagaaactcatctcacccctaaagacacatatagactgaaagtaaagtgggggaaacagatactccatgcaaacatagaccaaaaaactagcagaggtagctatacctatgttagataaaacagatgttaagtcaaaaactgtaaaaagaaaaaaaaaaaggtcattatataatgataaagggatcaactcagcaagaggatataataattctaaacatatgtgcgcccaaggtcagagcacccagatatttaaagtatattattagtgcaaagggagggagactccactacaataatagttggggacttctgcactccattctcagcattagacagatcatctagacagaaaattagcaaagaaacattggacttaaattgcattttaaacttcatggacctaacagacatttacatttcattgaacagctacagaatactcattcttctcattggcacatggaacattctccaggataggtcatatgttaggacatgaaagaaatctcaacaaaaacaattttaaaaatcaaaatcctacagtatcttttcacaacataatgaaataacattagaaatccataacaagaggaactcaggaaactgtacaaatacatggaaattaaacaacatgctcctgaattacaactgggtcaaggaagaaattaaggaggaaataacaaagtttcttgaaacaaatgaaaacctaaacacaacatactcaaatctatggaatacagcaaaaactgtgctaagagggaagctgatagtaatccacacctacatcagaaaaaccagtaagatttcaaataaataatctaataatgcaccttgagtaactggaaaatcaagaacaaacaaaaccccaaattgctagaaggaaaggaataacaaagatccgagcagaaccaaacagaatggagacaacacacacacacacacacacacacacacacacacacacacacacatcaatgatgaaacagaaagttgtttttttgaaaaaataaactaaattgataacccactaggaagattaaccaataaaaaaaagacacaaataaacaaaatcaaaaatgaaatgggaaacacttcagctgataccacagaaatacaaagatcatcagagattattatgaacaactatatactcacaaacaggaaaacctagaagaaatggataaattatacatacaaactattaacactgaatgacaaatagaaaatctgaacagactaataatgagtgatgagactcagtcaggagtaagaagcctcctaacaaagaaaagtccaggactgaatgacttcactgccaaattctaccaaactatcaaagaagaactaatactagttctcctcaaactgttccaaaaacatgaggaggaaggaattctccttaactaattttataaggccagcactagcctgataccaaaaccagcttaggacacaacaaaaagaaaaactacaggccaatatccctgatgaacatagacacaaaatttctcaaaaaaatactagcaaactaaattccatagcacatcaaaaggataatataccgtgatttcaaataatataacataagatttcatattgtaatatgtaataatatatcgtaagatatcatgattgagtgggattttcccagggatgcaaggatggttcaacacttgcaaaccagcaaacgtcatgcatcatatcaacagaattagggacaaaagccagatgcaggaaaagcacttgataaaattcaacatctctttatgataaaaactttaagcaagtttttaactaggcatagaaggaatatacttcaacattataaaggcaaacccaaaaccagcatcatactgaatgaggaaaagccgaaagcctttcctctaagaactggacaagacttttaacactgctattcaacatagtactgaaaatcctagccagagaaatcaggcaagaaaaagaaataaatttatccaaattggaaaagaggaagtcaaagtgtccctctttactgataatatgatcttattctaaaaaaaaaaaactaaaaacttcaccaaaatactctttacagctgataaatgaattcagtaaagtttcaggatacaaaataaatatgcaaaaatcagtggcatacctatgtatcaataatgaactaactgaaagaaatcaagaaaacaatctcacttacaatggctacaaaaaaataaaatacttagtaataaatttaaccaagaaggtgaaagaccttaacagataaaaccacaaaacactgataaaggaaactaaacatgaacaaatggaaagacatcccttgctttccaatcaatattattaaaatgactgtcttagccaaagcaatctatagatacaatgccacctctataaaaagaccaatttcattttacatagaaatagaaaaacaactctaaaatttgtggaaccaaaaagagtccaaatactcaaaataatcctaggcaaaaacaataaagctggaggcgtcacacaacttgatttcaaaatatattacaaggctatagtaaaacaacatggtatgtatataaaaagagacgtggataaatggaacagaatgatgagcccagaaataaatctacatatgtacagctacacatttatgtatttttgatagaggtgtcaagaacatacactggggaaaagacaccctcttcaaaaagtggtgctgggaaaattggatatccatataaagagaatgaaaatagactcctgtgtttcacatatacaaaaatcaatttaagataaagacctgacactataaaacttctagaagaaaacataagggaaacactccaggatatgagtctaggcaaagattttatggttgagacctcaaaagcactggcaacaaaaagaaaaatagacaaatggagctatattaaacttaaaaaaaaacttctccatagaaaaggaaacaatgaacagagtgacgaggcaaactgttgaaatgaaaagaaaatatttgccaactattgatctgacaagtggctaatgtccagaatataaagaaactgaagtaactaaacaagtaaatactcagggtaatggaaactctaaatactctgacttaatcattacacattctatgcatgtaataaagtgtcacatgtaccttgtatatatatatacaaatattatgtagcaatttaaaaagatattgtgattagtgaaaggatagacaaatagaatgatggaactgaatagagccctgactagacacatttacagtcacttgattgatgccccaggtgactgacaataccaactgtcatagtatgtggagtaattggaacactcatacactggcattaagagtgtaaatacgtgtaaacttatgatttcatgtggaattctgttagaattccaattctaacagaaatgcacatgtgtaacaaaggaatgtttgcaggagttaggaataaacaaaggattgttattcataataacacagcagaaaacaaactcatatgtcctcaaaagttgaatggacaaattatggaatattcataaattatgttcatgcatatgatacggcaataagtaaagataactattgtgtcatgcatcgtaggtggatctcactagcgtaatactgagccaaataagtaaaacacagaggcattatctatggtcccacagaagttcaaaggatccaatattaagagaagggagtttgtgattgatgaggagggagacgtgggttcctctgatatgcaagttatatgctatttctggatctggtcagaagttaacttctcattttgggaaaatgtataaatctgtaactttttctatatctacatgtcagaaacatttttatatcaaagacaaagtaaaagtagcaactgattcataaaagagattacctttgaaaactatggaggatgttcttcatatggttaaattcatttgacagttaaatttagacaaagattaagaagtgtttattaaatttcatagctagaaggtcgttggcaattttcctaagagtgttttctatggagtagtgggggttgaaaacaggctgaagtgtgctgaagagctcctgggtggcatggcagtgttagaaaatgccaaaatgataagacttcttttgaaactgaaattaacatccttttgccatgaatacagaattttattggagaaatcccaaagttttttctcaatatctattctcttcttcaactactttgtatttaaatacctagagaaataaatatttcctgacttaaagatagtcacaacatagaaattaatttccttttagtgtggtctgtgtgagctctggagtagatggccaataaaaattagaatgtttttatacatttttggcatttatctaatagacttaattgctaaaaattttggggagggttgttgcacagtcttagtattagtttaatgtacctatatattctcacccataccttcaaacacacattttgaaatttccattatgactcatccatggcaaataaaatggactctcagtagttgtagctataacctatgcttaatagacatatcatattgtgaaaaaaaatgaggtggagttttgcatcacagtgggagttctctattaaccattagttatacctactgaaagcaggttgagaaatgattctgctggtaacaaaattattatatatggtagaggtcatataatagtggccttcaggccaatttagcctactggtgtgttttgtttcctatattcctcagttattgttttcatttttttgatatatttaaatgccagaaggcagtacctatgttctctagtttgtcactattccatgtgccttattatttctgccttctgggtggaagtatagaatagtgactaagtgtgggctctggggtcagcccacttgagtttgaatcctgtttctactggttactatgtgtctttgggcagttacttaatatttctgtacctctgacttctcatcttcaaacagggaattgcataattttgtacctattaggtacaggtataaagtccaaaattatagagctgagtagtgcttaggaatgaagcaatatgaaggaataggaatcctaattccctgctgctgggagcacagggtttgcagaaactatatggaaagcaaggtgacaaagtttaggtaagtatatccacaggttttgaatccaattttacccttctgtgtatacgtatttcccccaaattttcaaaaatttgcacatatttctacatgttctcttacagaagttccctatgtgtacataagggaatgtgtagcagcacatttagtgaacatttgtaacaaagagaacacataaagtcaaaatggaaacatttgttttggaaggcctgaacaaccttggtatctattgttggaagtgtagattggtcatatgtagcagagacacattatggaatactttacagcagttagacacaataaattaagtgcaacaggcatgaagcttaatgtacaaaatgcacagtttgcaggaacagagacaaaaagataatgattaaaattattaactgattgggagaggtgggaagtaatggcagtgggggtataagaatagggataaataaataaaacacagataataatattgatatgccacaatctgatggggtattttgagctcataccactgcacctgtggtccaaaatgaaattaaatggaagaagcatcaatcatagaacactttcttcgtacaagatgtgatgataaacaagttaatgcttttacactgttggtgggactgtaaactagttcaaccattgtggaagacagtgtggggattcctcagggatctaaaattagaaataccattttgtgtttggaattggtgggttcttggtctcgccgacttcaagaatgaagccatggactctcgcggtgttacagttcttaaagatggtgtgtccagagttttttccttctgatgttcagaggtctccagagtttcttccttctggtgggttcatggtctcactgacttcaggattgaagctgcagaccttcacagtgagtgttacagctcacaaaggcagtgcagacccaaagagtgagcagcagcaagatttcttgcaaacagtgaaagaacaaagcctccaaagggtggaaagagaccccagcaggttgctggtgtgggctccgtggcctgcttttattcccttatttggtcccacccacatcctgctgattggtccattttacagggagttgattggtccattatacagagtgctgattggtctgttttacagagtgctgattggtctgttttgacagagtgctgattggtgcatttataaatctttagctagacacaaagtgctgattggtgtatttacaatcctttagctaaacagaaatgttctccaagtcccctacccgattagctagacacagagcactgattggtgtgtttacaaacctttagctagacatagagcgctgattggtgcatttataatcctttagctagacagaaaagttctccaaatccccatcccacccaaaagcccagccagcttcacctctcaatttgacccagccatcccattactgggtatatacccaaaggattataaatcatgctgctatgaagacacatgcacatgtgtgtttattgcggcactattcacaatagcaaagacttggaaccaaccgaaatgtccatcagtgatagactgtattaagaaaatgtggcacatatacaccatggaatactatgcagccataaaaaaggatgatttcatgtcctttgtagggacatggatgaagctggaaaccatcattctgagccaactattgcaaagacagaaaaccaaacactgcatattctcactcgtaggtgggaattgaacaatgagaacacttagacacagggtggggaacatcacacactggggcctgtcatggggtggggggaggggggagagatagcattaggagatatacctaatgtaaatgaggagttaatgggtgcagcacaccaacatggcaaatgtatacatgtgtaaaaaacgtgcacgttgtacacatgtacccagaacttaaagtataataatataaaaaagcacctagaatattacctaactcataagtactcaataattgttagctattccttcagaaatgtaacttgctcagctccagaaggcattttggttgtgaagtcaggtataaaggagtgctcatttggagaagtgttttaactttaaattgctcatttatctgctgtaccatgatatcaatcaatgaatgattagatatttataacatttctatttcttcttacaccatcatttacccagtttttctctctgtatagttatgaggagttcagagcctcccatgtaattgtacatatcttcagattcatttaaagaagaaaaggacacatttgctaagagtgtaagggattttagccaaagtaaatgaatgagagggtattaattcacaagggttcaaattcatttaggcctgtcatatcctacaaaggaaaatcagcaaccagaaaggggcagtcaggcatgatattaaacagctgagcatgtcaaaataatcacttcatcgttatggagttccattcagtacatccgtgcttgagctgttgccattgtgtgggattttcacacttcttgataaattgatctgtttttcctaatataattatcatgaagttttctcaggaatgcatatttaaactgaataagtccattgggttatcattcttagaatatttgatttaaacatcaaatacatttaatttgtaaagtaggtttccatatgggaggaatgctattttttactatctattggcacatgatagaattggatgtacttactagaaaccagcaattttcttcatattcttcaatttcttcctgaacttctaaatagaaataattagacaactaaaaggtaaattcctcatacggacacgtgaaagccagtggtgttttttaagctcagcaatatgttaccagaaaagttcattttcaggtcatttagcagcctgacatcagtgagttgaataattcactaaattattaatacagaacaacttactttaacatttccctttagacttagtgcagaaaaagcatagaaataggaataaacttctcttatacaatcaaaagtgtataatgggagcagtaaatggtcagaaaagagattcattgtcagtttttatgggacatggttttatcaagagacttggaggtattttgttgtatttcagaaaattaggaagaatatagaccatacaagtaacaaattgcttcgtagtaaaatattttattctgaatattaaacaaaagatgtgcagacagagattgagacaggtgtatgtattcagtctgtatcatgtttatgtgtaggatatgtttgcttcaaaatatttccttgcaacttaggcatgtttattcattgtttattcttactgcatcaatcaaaacttatcaggagtctaatacctcactgactcttctagtcaaaagtttagttaccttaagtagatatttgaagttgatgaaatgcattcatgcattgatcatgagctgaactatgatgtaagtcataaaaggcctgattcacttaaaaactgacactgatattttttaaaaggggaaaaaagcaaataaagaatgcacctgtgcagaagtgtactgtttactactgagagtttaacaacaaaatattgcaatctgattatacacaaaatgactccaaaatatgttataaatacttgaagttaaatatttgaataaacactatttcctatatgttaaagtaacacttatttgcttttccatattgtattagcatactcacgctactgataaagatatacctgagactgagtaatttataaagaaaaagaagtttaatggactcacagttctacgtggctggggaggcctcataatcatggcagaaggtgaaagccgtgtcttacatggtggcagacaagagtgaatgagagagaaccaagtgaaaggggtttccctttataaaaccatcagatctggtgagacttattcactaccatgagaacagtaaagagaaaactgccccatgattcaattatctcccactggttccctcccacaacacatgggaattatgggagctacaattcaagataagatttgggtggtgacacagttaaaccatattacatatttatcttgatcatttttatactttaaaaaatttgtatttttagtattataaaagtaaaatatactcagttagaagaacttaaaactgtaaaaatcattagaatattaaaatgacctataattttaaaacatattaaattaaaaaaattatttttcccagtctttgtctagctttttgttcagatttttgaaaattaagttagatttatacttatgaactcatatgcttttactaatgatcataaagtttctaaaattataaatgcttttaaatacatcatttccatggctatgtaacaccctggtagaagagcatttcataatttaaccatcagcaatatttatatattattgttaattttgtaaacattttcatatacaaaatcatcagtggaataaagaggatgctttttaaaagtttcttaatatttattagcatgtaatttcaactaaagtttatacaatttatctggccatattagagagctccatttctgtcacatgcttgccaacattattatttttaatttttattgttttcatttgcatttctgtaactcctaatggaattcaatatttttaaaatgtgtattagttataattgttcattttctaaattttctgttgctgtaactatgtattctttgggaccattatactttttataattcatttgaatgaattatccctagtaatgatattaactttcatttgctgtatttgtagaacacatattttaaatttatttgccttttattttgttaacagtgtttcttagttttagaaatgtgtcctttgtttaattacattcttgatttcttgtatacatagaaaatcttttctcattccaaaagcaaaattatattcctcatgtattttttcctattttaaagtttttttttatgttgtacatttaatccatccatttttctagatttaattgtggtacatagtatcagataaatatctaagagtttctcctaaatattgatggtattgtctgagtataactctttaacacactatttaaattgcaactcaactgtgttgaaatttaatattaatatatgtttcaaaatgtgatagtttttaatgatgcttctttttttttctttttttgttttgagatggagtcttgctctgtcgcccaggctggagagcaatggcgcaatctcggctcactgcaacctccacctcccaggttcaagcgattcttctgcctcagcctcccaagtatctgggactacaggcatgtgccaccatgcctggctaatttttgtacttttagtagaagtggggtttcaccatgttagccaggcttgtctcgaactcctgacctcaggtgatcttcccacctcagcctcccaaagtgctgggattacaggcgtgagccactgcgcccgggcaataattcttctaaatatgcttttgacagtgccataccactgtgctattgaatctctgggtatgttctattagattgttgagccagctcccatcatcatcactactacttattttccttattttttgtcttccttttcttgttctctttgtcctcctctttcttttccctttatctttcttctttctctttttttctatttcttttcctgattatttttcttttgagatggagtctccactctgtcaaccaggctggattgcagtggtgtgatctcgactaactgcagcctccgcctcccaggttcaagcgattctcctgcctcagcctcccaagttgctgggattacaggtgcatgccaccaccctcagctaatttttgtatttttagtagaggcaaggtttccccatgttggtcaggttggttttgaactcctgacctcatgatcctcttgcctaggctttccaaagtgctgggattacaggtgtgagccaccatgcctgacctatttttcttatactttaagttatttctttgatacattttaaaatttgctaatagcatggatatctgacattatctttttacaaaataagttatgaacacaaaaaagttaactcaaaatggattaaaggcttacatagaaatgtaaatcttctagaaaaaaatcataggtaggaaaactctttggcactggtcttgatggtaattttttttgatatgacactaagagcacagatgaaaaaaaataaaacaaggggtactataccaattttaaaagcttctgtacatcaaagagaataatcaacaaaatgaaagggcaacctatggaaggggagaaaacatttgcaaaccatatatctagggactctcaatttccaaaatacttaaataacatacaactaaacagcaaaatcaaataatgtgattaaaacttggcaaaggatctgagcagagatttcacaaaataaaacataaaatagccaacacgtttatgaaaaggtgctcaacatcaataatcatcagaaaaattcagatcaaaaccacaattatatatcgccacattggttgggatatctgttgtacaaaaaaacaaaaaaaggattacaagtgttggtgaggatatggagaaaagggacctcttatacgcactgttcatggaaatataatttggtacaacgagtatggaaaacagcatgcactcccatgttgtttttgcagcattattcccaatagtcaagatgaggaatcaacctgagggttcatcaaggaataaatggtaaagaaaatgtgctagatacacacaatggaaaactattcagtatttaaaaaagagggaaattttgccttccatttgcaacaacatggatgagcccagagggtattttgccaactgaaataagccaggcacagagagacaaataccacatgatttaatttatatgtggaacctaaaaaaggtgaacttatagaaatagaagtagagagtcgattgctgattgccagggcccggggatggaagagtggggaatggggaatggggagatattggcaaaaagatacaaaccctcagttataacatgaataagttctggagatctaatgtacaatgtcatgattagagttaacaatgctgtattgtatgctttaaatttgctaggagtagattgcccccccctcacacatacacacatacatacacacaagctatgtgagattatagatatgtcagttagttagactgtgatagtcatttcacagtatatacatctataaatcaccacattgtctgcattaagtaacacagtttgtatttgtcagttgtacctcaatgaagaaaaaaaatgaggagtaataaaagcaaaaaaatagtgaaaacatcaatacctaatttattgagagtttttagcatgaagggttgttgaattttgtcaaaggccttttctgcatctattgagataatcatgtggtttttgtctttggttctgtttatatactggattacatttattgatttgtgaatgttgaaccaaccttgcatcccagggatgaagcccacttgatcatggtggataagctttttgatgtgctgctggattcggtttgccagtattttattcaggatttttgcatcaatgttcatcaaggatattggtctaaagttctcttttttggttgtgtctctgccaggctttggtatcaggatgatgctggcctcataaaatgagttaggaaggattccctcttttgctattgattggaatagtttcagaaggaatggtaccagctcctccttgtacctctggtagaatttggctatgaatccatctggtcctggactttttttggttggtagactattgattattcccacaatttcagagcctgttattggtctattcagagattcaacttcttcttggtttagtcttgggagggtgtatgtgtcgaggaatttatccatttcttctagattttctagtttatttgcgtagaggtgtttgtagtattctctgatggtcgtttgtatttctgtgggatcggtggtgatatcccctttatcattttttattgcatctatttgattcttctctcttttcttctttattagtcttgctagcggtctatcaattttgttgatcttttcaaaaaaccagctcctagattcactaattttttgaagagattttgtgtctctgtttccttcagttctgctctgattttagttatttcttgctttgtgctagcttttgaatgtgtttgctcttgcttctctagttcttttaattgtgatgttagggtgtcaattttggatctttcctgctttctcttgtgggcatttagtgctataaatttccctctacacactgctttgaatgtgtcccagagattctggtatgttgtgtctttgttctcattggtttcaaagaacatctttatttctgccttcatttcgttatgtacccagtagtcattcagaagcatgttgttaagtttccatgtagttgagcagttttgagtgagtttcttaatcctgagttctagtttgattgcactgtggtctgagagacagtttgttatcatttctgttcttttacatttgctgaggagtgctttacttccaactatgtggtcaattttggaataggtgtggtgtggtgctggaaaaaatgtatattctgttgatttggggtggagagttctgtagatgtctattaggtctgcttggtgcagagctgagttcagttcctggatatccttattaactttctgtgtcgttgatctgtctaatgttgacagtggggtgttaaagtctcccattattattgtgttggagtctaagtctctttgtaggtcactaaggacttgctttatgaatctgggtgctcctgtattgggtgcatatatatttaggatagttagctcttcttgttgaactgatccctttaccattatgtaatggccttctttgtctcttttgatctttgttggtttaaagtctgttttatcagagactaggattgcaacccctgcctttttttgttttccattttcttagtagatcttcctccatccctttattttaagcctatgtgtgtctctgcacgtgagatgggtttcctgaatacagcacactgatgggtcttgactctttatccaatttgccagtctgtgtcttttaattggagcatttagcccatttacatttaaagttaatattgttatgtgtgaatttgatcctgtcattatgatgttagctggtcattttgcttgttagttgatacagtttcttcctagccttgatggtctttacattttggcatgtttttgcagtggctggtaccggttgttcctttccatgtttagtgcttccttcaggagctcttttagggcaggcctggtggtgacaaaatctctcagcatttgcttgtctgtaaagtattttatttctccttcacttgttaagcttagtttggctggatatgaaattctgggttgaaaattcttttctttaagaatgttgaatattggcccccactctcttctggcttgtagagtttctgctgagagatccactgttagtctgatgggcttccctttgtgggtaaccctacctttctctctggctgcccttaacattttttccttcatttcagctttggtgaatctgacaattatgtgttttggagttgctcttctcgaggagtatctttgtggcgttctctgtatttcctgaatctgaatgttggcctgccttgctagattgggggagttctcctggataatatcctgcagagtgttttccaacttggttccattctccccgtcactttcaggtacaccaatcagatgtagatttggtcttttcacatagtctcatatttcttggaggctttgttcgtttctttttattcttttttctctaaacttcccttcttgcttcatttcattcatttcgtcttccatcactgataccctttcttccagttgatctcattggctcctgaggcttctgcatttttcacatagttctcgagccttggctttcagctccatcagctcctttaaggacttctctgcattagttattctagtcatccattcgtctaattatttttcaaagtttctaacttctttgccattggtttgaatttcctcctgtagcttggagtggtttgatcatctggagccttcttctctcaactcgtcaaagtcattctccgtccagctttgttccgttgctggtgaggagctgtgttcttttggaggaggagaggcactctgctttttagagtttccggtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactcctgaccctgtttgcctgggtgtcagcagcggtggctgcagaacagcggtggctgtagaacagtggattttggtgacccgcaaatgctgctgcctgatcattcctctggaagttttgtctcagaggagtacccggccgtgtgaggtgtcagtctgcccctacagggggatgcctcccagttaggctgctcggggttcagggacccacttgaggaggcagtatgcccgttctcagatctccagctgcgtgctgggagaaccactactctcttcaaagttgtcagacagggacatttaagtctgcagaggttactgctgtcttttcgtttgtctttgccctcccccagaggtggaatctacagaggcaggcaggcctccttgagctgtggtgggctcagagctatctatgacaaacccacagccaatatcatactgaatgggcaaaaactggaagcattccctttgaaaactggcacaagacagggatgacctctctcaccgctcctattcaacatagtgttggaagttctggccagggcaattaggcaggagaatgaaataaagggtattcaattagggaaagaggaagtcaaattgtccctgtttgtagatgacatgattgtatatctagaaaaacccattgtctcagctcaaaatctccttaagctgataagcaacttcagcaaagtctcaggatacaaaatcaatgtacaaaaatcacaagcattcttagacaccaataacagacaaacagaaagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattgcatgctcatgggtaggaagaatcaatatggtgaaaatggccatactacccaaggtaatttatagattcaatgccatccccatcaagttaccaatgactttcctcacagaattggaaaaaactactttaaagttcatatggaaccaaaaaagagcccacaatgccaagacaatcctaagccaaaagaacaaagccggaggcatcccgctacctgacttcaaactatactacaaggctacagtaaccaaaacagcatggcactggtaccaaaacagagatatagatcaatggaacagaacagagccctcagaaataatgccgcatatctacaaccatctgatctctcacaaacctgacaaaaacaagcaatggggaaaggattccctatttaataaatggtgctgggaaaactggctagacatatgtagaaagatgaaactggatcccttcctcacaccttatacaaaaattaattcaagatggattaaagacttaaacgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccgtcagagtgaacacgcaacctacaaaatgggagaaaatttttgcaacctactcatctgacaaagggctaatatccagaatctacaatgaactcaaacaaatttacaagaaaaaaacaaacaaccccatcaaaaagtgggcaaaggatatgaacagacactcctcaaaagaagacatttatgcagccaaaacacacatgaaaaaatgctcatcatcactggccatcagagaaatgcaaatcaaaaccacaataagataccatctcacaccagttagaaaggtgatcattaaaaagtcaggaaacaacaggtgctggagaggatgtggagaaataggaacacttttacactgttggtgggactgtaaactaattcaaccattgtggaagtcagtgtggcgattcctcagggatctagaactagaaataccatttgacccagccatcccattactgggtatatacccaaaggattataaatcatgctgctataaagacacatgcacacatatgtttattgcggcactattcacactagcaaagacttggaaccaacccaaatgcccaacaatgatagactggattaagaaaatgtggcacatatacaccatggaataccatgcagccataaaaaatgatgagttcatgtcctttgtagggacatggatgaaactggaaaccatcattctcagccaactattgcaaggacaaaaaaccaaacaccgcatgttctcactcatagctaggaattgaacaatgagaacacatggacacaggaaggggaacatcacgctctggggactgttatggggttgggggagggggaagggatagcattaggagatatacctaatgttaaatgacgagttaatgggtgcagcacaccaacatggcaacatgtatacatatgtaactaacctgcacgttgtgcacatgtaccctaaacttaaagtgtaataataataaaagaaaatttaaaaaaatagtgaaaacatcatggcaataataaacttaaaactgttactgaagtgccagagatttggtttaggtcctgctgctcactgcatagaaagccaattactgagacaatgagtattgccagggaagaaggctttaattgggtgccactgctgaggagatgggagatcagcctcaaatccgtctctctgatgccctacaattaggagtttatatagcagagaaggaatgtaactaagctgtgggaaaacaggaattagagagggataaggaagaggagttggtcaacaggaagcaggaggttggtttgggaattatgacacgtgaagagtctggcatctcattatctggatgcagtgatctggcgagtttcagttccttgatactatttggaaggcatgatggttttcctgaggaagaaactcagataagacaaatgtaagtttcaggctttaagacaaacagaggccgagcgcggtggctcacgcctgtaatcccagcactttgggaggctgtggcaggcgaaacacttgaggtcaggagtttgagatcagcctggccaacatggtgaaaccccgtctctactaaaaacacaaaaattagctcgcatggtggcacacacctgtagtcccagatgctcgggaagctgagacaggagagtcacttgaacccaggagatggaggtttcagtgaaccaagatcatgccattgcactccagcctggatgacagagcaagattctgtctcaataaataaataaataaataaataaataaataaataaataaataaaataaccaagagagtcaatttttatgtttatccaaaaaacagtaaacatcgttctatggaccaattgggccaatttcaaaactgttaaaaatatgatatgtaaataaatatgccatgtttctaaggagaatacaggcagatgtttgatttattcagaatattcctatatattgtactattttcttagctcatcattttaattccatatataaggatacatgagtgaaaatcaatgcttagtaatgagcactgtgtgcaacactaaatattccttaatgtggggaaaaggaagaaagcaatttgttataattaagcaattgaagacaccctttttagacagatattttttcagctctgtatctattttatgactgtgcaacatgtcatttaagaaaaaatcccatcttcaatggtcatacttcactcaacagtaacagaatacaccacccaataatatgccactttgacattaggattatttttaaggattattttgagctaaacacatttgggaaatagacaatgcaaaaaagggcattctaaacctcccttttcttcctaaaatcagattaaaaactcccttgttaaagatacctccttcccccataaaagtggtcatagccaagagaattctatgcaaacatactttgttaaaataattctcatcttgttttagcctccccacataatttagttactgttacacaattgcctctttttgttcaacctgttataaaaacttttagcgctaggtgcaatggatcatgcctgtaatctcggcactttgggaggtggaggtgggagaatcccttgtgcccaggagttcaagaccagccttggaaacataacgagaccgccatctctaaaagaaaaaagaaagaaagaaagaaagaaagaaagaaaagaaaaaaaaaattaaattagctgggcatagtggtgtacacttgtagtcccagctacagagaaggctgaggtgagaggatatagcttgagcccaggaggtcgaggctgcagtaagccatgagccatgatcgtgccactgcatgttctcatgaaggctctcatatcacatgagacttacattaaatttgtattctcaggcccagctgaaagctaaggagatagaggtacaattttgcctcctcaacatcagcatgttcggattactgctatttttttccaaatcgtattaacacatagtcactatgctctgaatttttatttgcctgttcatttatttactcattgtagcaatatttattgaatgtttcctatgcacctagaatataggctccactttcattgcacagtatttgatggcagaggtagataaaccaaccactggcgacaaatatagccataagattactaccagttgtggtgagcattatagtagcaataacaaaagcaaatgtttgtgagagagacagagttatgcaagtgaggctaggctactgtggataagttttggagggaaggcctctctagctgacatttgatttgttaccatgagacacacaggaagacatcagatttccctaagtagagacagagccttgggagctagagacagttcaaccacagccagtggaccatggaaaggagtgagtcttattttattttaaatgcattaaaaagtcattgccaggttttaaggaaaggaaagacattacttaataaaaagattatctgatggctttgtggaaaatgggtaatatgagggcaggatgattgactgagtaatatgatagtccaggtgagatatgataatggcttggaataagattatggcagtagaaatgaagaggacttggaagatttatgatccattttgagaaagtattgacagaacaggttgataagatgaaagcagggaattaaagaaataagcaaattggcatcttaaatattttgcttgagctattgtctggatggttttgccatttactgagaagggatagaatgagagaggaatagacttgggtgagggtggagattaacagattaattctaatgcttttgttatgagatgtctaaatagccatccaagcagagataccaaacaggtagttggatattatcttaattcaaagaaatgggagagctagaggtaaggggaaataaaaagcccatagtgattttttttttaaatctgtgtcattaacatcacggaggtattcaaagctatgtgttcagataggtgtcccagaggaagcagtaggtagatagtaagaactagaataaaactttaatacattacaaattcatttttcattaattcagcttatattttaagtttacattaaagcattctaattttccaaatgtcctgctgataatgtgttatcacatgtattaatgttttgaaatgatattactacccttctaagcacatgactattcttagaaaatgggctatatcgacctttgattcaattccacaactttggagaaagacttatatctgcaggtactatgggtgtaatgttttctggtattgaataatgtgtgataaaactccccaaactctataataagtttatgcatattagccattgagaaattcagacatgatcatattcctgcggctcctctgtgggagctgggttaaaacatatgtcagcccaaagtctctgcattcactgttcagtttctatgtcacatattctttacacttaaagaaattcctatgggcacaaatgtaataagattgcagcaacagcacttattatcccttggttcaacagattctggatgcctgccctgtgtgatcagaaacatctatgcataaaggagttagtacatatgactgtgttgaacactgataatcacaagtcacttaacacaacactttgctactttcaagagacacctccgccttttactttatctttcatgatgaagcagtggaggagatgaagcagagatgtagtaaatgaagaaactgatgcaaaagaatactataggcccagagtcccatatttattaaagagcaaagctgtgattggagggaaaaaaagcttccaaagtttagtccataccttctacagaaatccaacactgtgacagagaaaacaatgtgcattcaaagtatcaaagtgtgcatttaaaagtattgcatatctcctagaaaaagttctaaaataagaattagtgcatatggtgtctaggccacttagattagctatgtcactggaaaagacacatgacatccatagacttcaggatttttttaagatctattccccacagtaattcaacttctttttattgagtttcaagttagaataatacagtgcacagtcttaactttacaatgcaatgactttttacaaatatatacactcacggaaccaccaaagttcaagataaattacttccaccacccagaagcccctttctcccaacttccagtcaatacttcccataaaatcaacaccattctgacttctttcaccatagattcattttgtttgtttgcgaactttaaagaatcacaaaatacctatccctcgatgtccgatgtccagctctttactttttaagaatcaagtttttaactgaattataacatacagtgaagtgcacaattaagtatatagctacttgaatttttactaaatatatccatccaagtaaccagcacccagatcaaaaattaaaccattaccagcacaccaggatcccctgtcatgtccctttcaatcaggaactgatttctaagactataggttagttcacctttatgtaagtgggaacgtagagtgtgcacacttctgtgtttgatgtctttcaccccaaattatatttggtagatttatctatattaaggtgtatagttctagttttattctttttcacttctgtttagtatttcattgaaagactataccaacatttttagaaatccattttatatttttggacatgtgaattctttgcagtgtgggtctattatgaatcgtgctgctaagagtattattgtttgtgtctttttgtgagtatatgtatgcatttctgttggatatatacctagtagtggaaccacgtatgttcatgtttgggagatactgctaaacagttttctaaagtgattaccagcattttatgaaattttgagctattctacatccatgccagcactacacagtgatgtgttgataaactggctctttggagaagaaaattcgacctcaagagttcttacctttttttttttttttgagacggagtctcgctctgtcgcccaggctggagtgcagtggcgcgatctcggctcactgcaagctccgcctcccgggttcacgccattctcctgcctcagcctcccaagtagctgggactacaggtgcccgccactacgcccggctaattttttgtatttttagtacagactgggtttcaccgtgttagccaggatggtctcgatctcctgacctcgtgatccgcccacctcggcctcccaaagtgctgggattacaggcgtgagccaccgcgcccgaccgtaagagttcttatctttaaatgaggatgaaattgacttcattcaaacatttatttattcaggaaacacttgacattgtgctagatataatccttatcacctaaactagtatagaagacaaattgattaaaataaggtgttattggtgtgaaagacatgtaaccaagatgttaataataattcatagttgggacatttaatcttgactcacccatttgttgaaaatattatggactgtttttttatgttccatgaattgtgccagatgctgaaaacacaaaagtgaataatgaaggatttgaaggataagagttagctcagtaaacagggaatgatgagaggctggaacagaacatattaggcaataaaggaagcaagttggaaagcgatgagactggaaagggaggcaggagtctgtttatgaaggttcctcgcttgctgtggttaagtagtagatacgtaatccaaaaatccatagagagctggagagggaagcaggaagatgacagggtaagatctgtgttgtaagcaatcacactggcagcgatgtgaagacaggattaggggagccatggccagaggcagaggtcattcatgagactgttataagggactactgacttcatcccttgaaggacaatgtgacaatatccataacaacagaaaatgttcattctctttaattccagttctaggggatgatcccacaaatatattcaaatgtgtgagaggtgttcaggattatttgacatagcaaaagactattaaaactgtttttcagtgctacactaatggttaattaaatgatgtaacatctataccacagagatgaaaaataatattgtagatgtatgtataatgaaacaaaataataaaaaagctatgttgttgagtgaaaaaaaaaagcaaaaaggattagggaaggtatatataatgagtggctgcacagttagctgaagagcattaacatacaaagagtgagtgaaagacgaaaatctaggcaaggggacttaaaataagtaagcataaaaatgggaaggaagtcaaaggagaattagatactattagtgacataaaagtgggttttaagaaggagaaagtgataaatggtgccacacacctcagagagaccagtcaaagaggagctgaaaagtgtccacaagatttagtaataggaggccagtcataggtggctttgataattgacatcctaggtagttttgagaattattccattagagttcctggcttttcattttttcagcaacataaggaagagaagagcttccgagtcagggtaacctttactcacagacacatactactagcacaatatggtattaacataaaataagtttattaatgaaaatgttcaaatacagagcaataattccctaggctcttattatcccatagaaagagttatgcttgggttagtacaactggactaagagcaacataaaaaggacccaaggtgccggtcgcggtggctcacgcctgtaatcccagcactttgggatgccgagacgggcggatcacgaggtcaggagatcgagaccatcctggctaacacggtgaaaccccgtctctactaaaaatacaaaaaaattagccgggcgtactggcgggcgcctgtagtcccagctacttgggaggctgaggcaggagaatggcgagaacccgggaggcggagcttgcagtgagctgagatagcgccactgcacttcagcctgggcgacagagccagaccctgtctcaaaaaaaaaaggacccaagggaggaggaaaagagaggctgacaacatctaggtgacagtgtggcaagagcttcctggtcaagtaagtatcttagaaagcagaggctgatgctggagagctgtattttttcattgaactgactcagacttgctgaaccagctctttgctgacatcctaaaagaggaaggaactaaaactccaggacatccacaatcgtctctccaggtctaccccactattccttggaagctcattaaatagaattctctccagacactcgatttgatgtcaaattgcagcattttctaatgtgtagttctggagcagaatattgataaggccatttgtagcttggtcaaatagccaaacggggagtgacattttcaaacttataaagtcatgttactacctactgtccaggggtgacatggatgatctgaggggctgccatttcatattcgtaattggaatacagggaattattccttaattccctacctacatcctgaggtcaaccgatttgtgcccaaccagtctttcatccttccttgagaataaatcagacactctgctctttatttgcagttataaatttcataaacattcagtagattgccaatttggcttcatcagcactcactgcttggatgagcgtggtcaaataaccatcgaagtgaaagtaagtgtccaactttatatttctagatttgtgctccacccgaacaacatatttgtcaaagtaatttctcttaagtcaattctgagttgttttcggtggtcctcataccacggtgaagttaagtcaacattgttttagcaattattattgagaagtgatggttgcattttgttgttgttattactattccattattattctgcactggcagttattgtagacaactgaaaaactgagtatgtgactaaattgttttatctgtttctataatcgttattcaatctggctcaataataaaagagcacaccatggagatgaacacatctgatggcatgctatatctgtccactatgatgataacatgctaacagccaatggcattgagtagaacttcgggctatagtccctgatctgcactttacgtggtactcttgattgtacagcacatcatcctaaggtctaattagggttgtactgcaaagagcacgctcacgtggacaacccgtatgtgtaacataaatattgaatttatgattgagtcatcgtagttgttttcatgagagggctttcttttaatactagttatttttgtggtgtatagttgtatctagctgtagttgtaatgtgcatttccctggtaactaatgtgtaccttagtaatttcaatattttcttttgtaaagtgttagtttaatgttgttttttagccttattttctttttcattaaaaagcctaaacattatttaacatttggccatttttatttatcttggcagtactgacttcaggtttattttgtgaacagagaacatattctccgtgattttaataattcagaatttttgagatttgctttatggtgtaaaatataatctaccttggtaaatgttcaaatgtccatctaaaagaatgtgtgtcatgcacttatttgcacagtttcaaagatgacaaattaagccaaattggcaaattgtacattctgtcattagtgatattttatatgttttttctaattagaaagttatcgtaaattattcagctatgattatgcatttgtctaagtttacatttacttttttccacttctgtcttttatattttgaagatgtattatttgttgtatgcacatttaggattactttatgtttttgttaaactgccccttttatcgttgtaaagaggccagtttattcttgtaatatttttgccttaaagtcggctttgactggtattgacatagtaattttccttgcttaatgtttgcttggtatatgttttgtcatcatttacttttatgtgtcttatgttcttatatctgatgtttgtctgtgtaataaaatcagcattttttttttttttactagtgtgacaatctttgccttttaattatttggttcacttcgattttttaaatctactgttttgtttggtttaaagtctatcatctttctatttgttttttacttgtttcatctgctcttttatttcttatttatcgtttcttggcttttattgcactaaattatttttataattgattttgttctttaaaattgacttttcagttacacatgtttattcattttgtagttaaatttgttttcaatgtaccttcttgatttgttgtagcctattttaagatagcacttttattacttcccaaacaatccaagaaactttctactacttaactttactttcttatcccttcagccttttgtgctattttgtcatatattttatttctacatatgttataaaccctacaggggaagcacagcttgcaatgactaaaacaacaccacatagtgtatcttcttcaagataactggtaaattgtgttctgaaaattcttaggggatacatgcaaaaaagatgaaaaccaaaatactcaatgccacttttcagtgcagtcataggcatccaggactctgatcccagccaacttctcaattgtaaagatgaaatttactacactagtagtcaaaaagttttaaaatatatatctatattttaaatttattcttagccaatacttttttttttttttttttttttgagacggagtcttgctgtgtcgcccaggctggagtgcagtggcgagatctgggcttactgcaagctccgcctcccaggttcataccattctcctgcctcagcctcccgagtatctgggactacaggcacccaccaccatgcccggctaattttttgtatttttagtagagacggggtttcatcatgttagccagcatggtctcagtctcctaacctcgtgatccacccgcctcggcctcccaaagtgctgggattacaggcgtcagccaccacgcccggccgccaatacattctttattattttctactttttaaacacttaagtaacttactagaaactacgatttagatgaatctttcagatgaaattaatttgtaaacttttctgaatttgtttgtagctatttcctgttcccagctttacattttcatatagttcaaccatatgtttctttaagtcccagatcttctactctctgcagcaagcatgacatgactcctatagtgagcacctcacttatttcaaatttaagagtagctctcttacattgttttcccaaccattactttgtataacagtaattagacatgtatatcatcttcctcactagacctaagttccttaatgtcagatcttaaatatatattctttatatgttctcaatgaaatattttctttttatattctctatgaaaacatagagtaatcaattgaaacatggacatagccttcatggtatatgttagtaaaaacatttatatttctacagcgtgtttaagccagagctaattttgaagcctctgctttgccaatggattcttgtgtagatagttacaaggtgactgtggctgaatgcttcattaagcagtgggagttttgagccaggggcaatatatcagggattaattgtcagttggtaagcaaagtagataacaatcaaggttacacaaagattacagtgtcttaagaataaatgttagccaggatggcataaatgaactgataatcaggtaggaagacgttatggcaaggaatgtgtttccttaaacaacttttaaaactaatagaatttaaataagatattacccccagtcaataaaattctactgaaaaataatgaagcctgcaagtgtgatggttgcaatgctgcaggcacccacggagactctgcaggaggcctgcacatgcttcttccctgcctctcctactatttacaaacataatgaaaatgaaaatgaatatgctgcttgactgctactcttaacagcaaggactgtgagaagaatattgttttagtttgtctgttagggtgacctttatgaatttcactgttgctagaaaactcaggctgattggacaacgttcccatttctttaagaaagatttgaaagttcacagggactacttttagagttacttcttggagaagtgttgcttttttatatgcatttagttcactttgtttttatattaaaatctattataatttatgtttttgacaaatgaagatgaataaagggagattgagtataacttctcagtaattgctaaatgaaatttgggaattgtcagtccatgtattgctttggtcttttatgtgaccagtaggaatcacttagccactctctagatttcacaatagtatataaatactatatatagtatttatattatattatgtataatactatttatatatatagtattatattatgtataaataccatatatagtatttatattatatataaatatactatatataattatatatattattttatattatatatttaatatacatatttacttatatataatcatacgatgtagtatatataaacatactatacattatagtaattattatagtaaatatataatatagtaatagttacatgtaattatatattatataaaatacataaaaatatactatatatagtatttatatataaatatatatatgaggaatactatatatagtattcttcataatactatataaaccaggtctcagaagcttttagatacatatttttaaggccattattatgctaacacttgaaagagaggcagaagccttcacatttcaacccaagatcaaacattgctttttctctgaaataaagattacagaggcatcaggttttctacacatgaaatgaacatgtggtgtgaattgttatgaatatccttgtatatgagaaagccagaaagtcaaggagacacagagagagaattcagaattgttctgggttggaattctggctttctctaaagatccctgcatatggaagtcagaaagcttcgcagcatgaaatctttgatccaaaacactcttttgacttttcagaaaggccttcagacacttaaacctattaactacacaggattctaagtatccagatgagctgatctcagacaaaagcagattaggaacagcaatctggaagatcagcgctgtgaaaggcatgctgttggtagcagagcagccatctgatatcatgatgctaagaaagacaaaaatcaaacctcctgtatgccaagctagcacaatttctgattggtcacgattttagctatcatggaaatttaagatttgtattatggggaaataaacctggacccataaacagtaattcattttagagacccattttccatcaagctttaaggtctgttatctggaaatttgttatgtggaatactctaatgatactgaaatgatggtcgtcttccttgcttgattagcacttggtcaaaacctcaattctggagtgttttagatttgaaatagtctcacattgattatcatgtttgaaatctgcagtcatcctgggaggcaggcagggcaagtattattattttaattgtacatatagaacactacaaacccagaataatcagtggctttctcatttcacatgacagtaaaaatacaaaacacaacaaaaagcaaaaatgcagtcaagtctcctgtttactcctcattaccctccgctgaaccacatccttcatttgggaacctgttagattggagcctcagtggccacactccttcctgtctgggtaagatgggaagttcttccaggcagttttataaagtaggttttttactgagttattttagcattattgtgtgtaaagaaaagttagaatttgttaaagaaacatgatataaatgcattcaaatatagtctatgtcctttagacttctgtttctaaatcccatatgattcccattactctaaacatgtaagatgaatatgatggcctttgacgtatactgcaatgttgtaatcaaaagaagaaattgaactgatgctacctgcaaaagacaatgccaggttttatgtaaaataatctcgtacttacaaatgaatggctctttaaaactgtataaccacatgctaaaacattgagatgtgtttttaatgaatgtatggttattgctttggtgtaaaatcttgcattcaaggattacatacaaatctagtgcctttgagtactgttatacgataggtactagaaatagtcaggtaaatataaaaggcatgtcatttattctctcagaactttgaatcatagtgttctggttcaataagcaagtgtttcaacaatgattacaaacatataatagcatgcaattactattttgcaagaattatattatcaccaatacacaataattactatgaatgctacacaaatattattggtgtactttattaaaataaaatttgtatacatattgactatacagttattactctaatttaataacccatatattgaattgcattaaaagtggatgccaaagaaaatgtgaggataagtgaagagaattaaaaaaaacttcaccctttttgctttctttgtgtgacacataaagttaaaacctgcatgattcatattcataactatagtaattttaaaatagctcagccataaacagcatttcttttctcacagagatatgaagataacctcagggttcccatctatgctataattatgtaaataacaatatattggtattatgatttttagtgttctggaataagtctatttttatagctattttcacaacagttgtaccacagggactacaagttaaactctttggttgcaaaaatattcacaattcttaaactcaagtaaaagtgagcaaaatgtcaggagagacaattttgtgtctttaaagtatcagtgatctgggtttgaaacaacccaaagattctctggccatgtgacagatagataatttaattatattttctaaacctcagttttctcgttggtacaggggtggctgtgaggactgagagtggtatgtatgtaaaaattgcagcgtggtgcctggaacatagtaagcactcaggaaatggtaacaccaagacaaaggcaggtaaaataggagataggttttctttttcctcttgaagatttgtattacctagtgatattgttcttataattaacttttaatatgtttaatacatttaaaaatatatttttgtatcttattttatactgagttttagagaatggtaattcagtcaacaagtgccgatgagttggtgctgtgcacagtgtatcatgcgcaatgctgtgcagagatgaaggggcttgtatattgctcacgcagtcagagaactgtcaccaggaggcattttccttacagatcagcaatgcaggtgtttccactctgggtacattttagaacaaaataaaagaatagacatagatacagctattgcaaataaatgcatgatttaaaattcaaacctctcacttatcaagtggtattcatgaattaattagatctcccccaagtgtagtttacttaataagaattgtgtttaccgaaattatggtagtctcattcactgtagagctatggttattaaaaatggtagcggaaagtgtgcttttgggaaggcaaatttcacacacctaagttgtgtgtgcattcatagcaaaagcaatggcaccagcccgaggacacattagtcaatggcaactcagcctaatgaagacacaactatgatgatcgtacacaatggcttccacttgctatttacctcatagaatcattgtatttgtaaatttcacttaccacctttcacagccctccttgtaattgtgttttgcagtttcctcgtctctaaagtgaaaggactaaacgaaggaatttctacagttcgatgactctgtcttgcaagaaagattgcaatttctttgctgtcagagacataatctgttttatttatctttgtatatttcataatgctcagtaaatgataaataaatgacatttaaaatatatcttattttccttctgaatggtagttatacatacttactagtactatctttcatatgggctcatttgaatgagtgggtactagctttaatattttcataaagtgcaaagccagagataaaagtcaaagggataaaggaagaattttttttttctctctctctctatacacacactcacacacacattttcccgtaaacatcaagttgtagaactggtgtgtgtgtttacagactttttttgaattccaaaaagaattatactgtgaacattttttaataggaaacatactgtaaataaaaatacaaatgagctggataaaatgttctgtctggttagaattggttcatgaattctattttttgtcttcatgctctgtgactggaacacaggatacttaacaagatagttaatttctctgcatcttaggtttcctgcaaaatcgctacatttttataaacattagtgtgtggttaggaaatatgctttttatttccaaataaaaaatgtattattgatttatattcacacatgcagttaatgtgtttatgatgtacacatacatatatagaattttatggtacatgttaggataaaaatctaaggactatatttcttttgattttttaatttttattttttgagacagggccttgttccattgctcaggctggtgtgtgtagtagtggtcatagattactgcaaccttgaactcctgggctcaagtgatcctcctgcctcccaagtagcagggactataggtgcacaacactattcctggctaattttttgaaactttttcagagagaggatctcgctctattgctcaggctggtctccatctcatggcctcaatccatcctcccacctcagccgccaaaaatactgggattataggtgcaagccaccatgctgggtctaagggttatagttattattctaccagtagccagtggaaaacataaccattctttaaagagctaatccatttattatgaaaaaaatttagaaatttagtctttaaacatttgtatgaagctatttacttttttttttttttttgaggtggagtctcactctgtcatccaggttggagtgcagtggcgcgatcttggctcactgcaacctttgccttccaggttcaagcgattctcctgcctcagcctgccaagtagcttggactgcaggcgtcagccaccatgcctggctaatttttgtatttttagtagagatggagattcactgtgttggccaggctggttttgaacacctgacctcatgatctgcccacctcatcctcccaaagttctgggattacaggtataagccaccatgcctggctaaagctatttactttttaggaaaattcagtgcaattacatatatataaagctcaataaacatgccactgcttgttcaatggtaactacagtaatatttgcaaaacagaagactcctgattgtagttctagggaactgtttcattcatggtcacatgaaaaggaaaagttatctccacttgtaggaaaaaaataagatagttgtaacacaaaggaacagagttaactgatattaatccattttaaacgaatgtgtcattcttagtaaattgtgtgtcatttctcttagtaaatttcaaaattttctgtaaaataactggcgttgattatttgcactctctctgagacagacacatattgttcatgtacctttgttctttgcagtttgagctaaaatatatatttgaagtgaacagtttttgctaaagaacacagctctgttggatgcctttatttctacctctgaattatcttcaacctcccttcctcagccttttcaggcctcaaatcctcttttaattttaattcaaatgagcaaactgcaattctacactttaaaatgtgtcacgttatgtttaccctcataacttgaaactgcgtataccttttttttttcctccagaaatcaaccctgaattatggttctttttttggtttcctccatgatgatttgagaatgcagatttgaaagggagaatataatattaaaaattttgtatgagctcacatgaagcaataagacaacagaatgataatttcattcaaacttatcaaagtgtcagcagaaacacgttttgtcagatcaattgtcatgtaattctggtaagttccaggttgaatgtgtgtgtctgtgtgtgtgcacgcactcacacacacacattaaggctgtttcaggctttattcaatatccacaatgaacatttttttcatgaaaatgaaatactcttttttataggtgaaagaccgattcctttctcatttattgaatctcaaaatatctcatatgtctagtggtaagtcttcattcatgttatttcagagtgtcagttgtagtgcagaacttcagctatccagtcaccttagctttaagctagaaaataagaaaatgatcaggatgtctgtgacaatattatataatgtgacacttgatacagtacgaagtccaagagtactcagagatgtgcagagaaagtaagccaatttaataaaaggggacaaagaactgcaatgacataaatcccaaaagcaattttatagtcagtatgttttttacacagaaaccagggaactgcctaacgttgagatgttttactgaatctttgaacagtatatgccactttggctctattaccaaaatgttgcccaggtactagtggtgtgttcagaggaatacaagtaagaaaaggccagtcctcgaagaggaaaactgcaagtgaatatgcatgtataccgtaaaggagagaaagctttatcaagtgagctagccctgaaaaggaaaatttttatgatagcatctaacacatgcacttacccccttcattttgtttatccataattgtgcctgacacgttactactgcatcatctaagctacaaatatatatgttgttgaaggcatcaaagaagcctgtgttgggccatcatggattttccttatattcattcaaaacccagcaaatctttatagagtgactgttaggtactgagatacaacaaagaaggaatcatacagctttaagtgagaattatcaattgttaatgattcttaattaaacttcgagcacagtcttttaatcatatcaattcacctaatgatctatcatcaagcctacattgtcttatctattccaaaaaatacagtgagttgctttgtcttgcctaaattctgatgcatagggccctgcctgtaggattttactgagatcaccagagcaacagaacagggtacttagcctacttcagctcactactttcattgttaattacacaaaagtcctttgttacaatctgttatagaattttgtctggcatcaaccctgatccccattttagcaactatcttccttataattaaaacaacgacaacaacaaaaatgaggctactatgttctgaaatttatttaattccagtggaacttcagatttatgcatttatttacttgtttgcttgtttgtttagttgacaatgtttttacctgcaaacttacctttttttattttttattttttatttttttgagacagagtcttgctctgtcacccaggctggagtgcagtggtgcaatctcggctcactgcaagatccgactcccaggttcacaccattctcctgcctcagcctcccaagtagctgcgactacaggcgcccaccaccacgcccagctaatttttttgtatttttagtagagacggggtttcactgtgttagccaggatggtctcgatctcctgacctcatgatctgcccgcctcagcctcccaaagtgctgggattacaggagtgagccaccatgcccggcctgaaacttatcttcttttaaatgacttgactgactttgcaatttccttatccatttcgaattttgtaaaattattttttattattgactggctatcttctgaagtctggagattgttcttctagaccaaactagaaaaggtaaaaaagtaagagttaactttggggctgagattgaaatatgcttctaacacttacaggcagcaagacatttgcaagttaaacaagatctaagtgcttctgttctgttcccttgttgtaaaacggggaaaataatagcactttacccacagaactgtggtaaaatttaaatttgattcttgtaaagcactcaaaataatgcctcgaatatagtaaacattcaaaactattagataatttttttagtaacaacattagatactaaactcatgttgtttctctaaacaacttaaaatcaattttattggtattatcatttttatacaagttagctcatttgaaattataaatcagtcagtaagatcatatacatctgggccactggtatatatttaagttttatcatgcataaaattctcaacttcttctacagtttctggtgcaataaggcattttaggtctctggttgcaagacagacactgacctttgtggtgaagaacctaggttccatgtgagactgatgggctctaccacctgctagaggcttgctcttagacaagtgcattactattcagatggaattatgggcagttccctctttgggttgtggcacttgaagcctttttaatcccaaatgttttattacatttacagactcaggggcaaaaggtaagaattccatttattctcctttagatctttcattgtttttttgaggacaaggaagaaaatcttcacatccctgagctctagatattgatgtggtttatgtgtctgtgtagtctaatgcttgctggtctatttggaggctgctctccacgttctcacttttccctgcaggaaagtgttagatcagttatctccactaggactccaacagggttcaaggtctggttgcaaacatcttctctctagcccaggctatagctaagacttaagggcaaggtggccatattctagttgctacaatgcaagagaatctatttgtgcagaacagaacatactcataaggcacaaagaaacctattacattatagtcatcagatatagtagaatgagacttttataaatatttatttctgcaaatcctacagaagtaagtttttaaaagcaaaaaaaattaaatataacacatagcaaaaagtacaataaactaaaatatagctaaattaattgtcacaaaatatagttgtgtaactgccacttaagtcatgaactagaacatggcaaggacttgaaaaagcccccactttgtgttctctttggatccctacccctccctctaagctaattctgctcttacttctaacactgtagtttactttgatctttgttaattttaaaacactgtataagtggaatcacacacattgtattcttttttgtctgtctcctttcattgaacattatgtttcattgagtattatgtttacgtttgggattcatccatgttgtagtatgtagcaattgtatgcatttttattgttatgtagtattgtatcatacaaatataataccacttgtctcttctattaattatattagtataatataaaacattattgtaagtatcttaattataatatatcccatctattattaatatcctttattgtttatattaggaatatcggtgatacacacatttttttatttttggtacatgtgaagacacatttctatggagtatagctgtaagcataaacattggttcatagagttgaatttttttaaagtaatggtactaactcacagaaccacctgtatatatgatggttctgttttgcctcctatcttcactgatatgtcgtactgtcaatttatctatgatactggatgaggagtgatatcttattttaaacataatttttatttccttgtcttcttacaaagtggagcacttcctcacaagtttattgtacatatgtaattcttcttttgtaccatccatcttcaaccctaaagcttattttccatcaggttttcagccttctctttgttggtttgtagatacactttccattccagaccagttccctctatttgttaaatgtggtacagatatcttcttccatgatgatttgccattacactctcctcttggtttttgtttgtttgtttgtttaagacagagtctcgctctgtcacccagacaggagtgcagtggcgtgatctcagctcactgcaacctccgcctcccaggttccagcgattctcctgcctcagcctcccgagtagctggaattacagatgcaggacaccacacacagctaattttttgtctttttagtagagacggggtttcaccatgttggctaggttggtcttgaactcctgacctcaaatgatctgcccgcctcagcctcccaaagtgctgggattacaggcgtgagccaccacacctggcccctcttggttgttttaataaagggaagttttaatttgaatttgctcaaatgtagttattttctttatggttaaattgtttatactatgtttggaaataatttccctaaaagttctagaaattctttcaaggtcatgaagttattcttccatatcattttctaaaagctttgttttacactcacatttatttttatagtagtttataaatagtataagctagcaaatagaattgtttttctattgcctaatcacagtttattagatatgtggatattcaattgccctatcacaatttattgaaaagttttttattccctgttgctcttcaggacaaatgtcacacttcacttactgcccgtgtagggctgaatttgcttctagactcagcattccattcccctcttctatttttctctgtctgtaccaatactatccagtactaaatgctgtaggtatagaataacttgatacctgatccaactccttccactttgctcttcaagattatcttggcctgatggcatttctatgtaactttctgaaaacatgccaatttcaccaagacaaacacatacacacaccctgttagaatcatgattaatatcatatataatttctggattaattttaagagaatctgcaattcataatgtaaggctttccaatccataaacatgacctaatctcctatttattgagatctttaatttcttaatgtcatcccaacctccacaccagttttcaccatagaaccacctgttattatagatcctggaagatgataaacacattatcataaataaaatggaacccaatgtctctgcaaagatactataatgagaaaactgaaaatgagtgtggcttaattggcttcctagttcaagaatatgttattttcttgttacagcaaaatgcagtttaatttaataaatggtgtctttgccaggaggtggcgagtcagtctgtgattcacattatgtaatgagggcttattattttttgctggtcctggtatgagaaaacctaaaccatccgtccaagccacacagaactgagttatatgactgaactgtccattcaaagggccttattgacctaatagcactgaatagttcaaagatagataaacagaacttccctgagtctttcttactagaactagcagaacttcaataaaaaatataattctagctcaataggctttgcaaattttaatgttggccatgtttaaatcctttctctttaacctgaactttacagtctgtatctctggctatggtttgtagttgcatttttctctgtggaatcagctttcctctctgaataaagagaaatttaatctcattttatgaagaattctatcttccttaagtgcatcaaaataaccttttttttttctgtaatgctatgaaacatactccagtaaagcttaatgcaggaaattatcatttaatcccatattgcctaatttcacatggcctctaaacacattcaaattcagaatgtgagaaggtaaaactatctcttcaaaagatgatgaccataattccattgtcaacttcaacctcaaggatggataaatagaaatatggaatcattttgtttaggtattccccattttgcttaaaattttacttcattatattttgcttagttgacttgttcacatattgacttttccctttgggctcaaagatgttatttacttggggatgtgggatgtttttccatttcaaatatattagatacagactcaaaccttcaccaagtagcaaaatgaatactcaaacaacataatcaataaatagtcattctcttttattcatttgctgtgaaaatctcatggccaccttattcgagtaataatgacttgtttctagatgaacaatctcatcatgtttgtcagaattcacttctattattttaattttattttacatctatgtatcaatgaaaatcctagaaccaaaaaatgtagatgtaactcctgcactatattctgtagtggcaacactggacacataatttttctaattccactttctgcatctgcagataagaaattttaaggagttactttgaaaattaaatgataaagtccatgaatatatataataaactgaaaagttctgtatctaaatataagttatttttgctgaattgaaatctggccagtgatctctataaaacaagcttaattctcaagagcttgtattcttgaagatgaaataagatctaacattttcaagaatgtaatccatgaataaaaattgtaaaggtaataataacaacaatctgttttaatctgggagatacctgcttgtgcacccttctcctgggtagccattttcatttctgtcttcccaaaattcttaacagcatatgcttagaccaaaagagtggtttctccgagacactgagcacaaacatggtgtgcatattttttttattaaaaaatagttctatatttggatagaggaaaatagaaacaaaagatatggttactatccttgtatttttgagactcaactattcttcagaaataaatatatatcattcttaaaactttaggtgagacacatcttctagagttttgtccaaactggagtatattatattataattatattacaatataataatgtcattactcattagtttacctagaattacagtcaatgtttggaaggttgtaggaatttccagtttttttgttggcattgtgtttgtttaggccttaaatgactttagatgtggatgattttcccaatagaatgttcagcaattcatttttcttgaaacacaaacagatatgctgtctgcgtgccctgctggatggccagaatcctctggggaacacactgattgtaactaaaggcagtcatttagcacatcctcagatgctggcaggtagcaggcataataagctgtgggatttcttggtatttagcatgcctctgaaactgagaggaaccataccttttataattttggaactttagcaatatagaacactatatgtaaggctaggcaatgttacacgccatgccatttcagaagggttccaggctatccaaatcctattcaggccactgagaaagctgggtgtggagaataggtaacagccacacagtgttgaggcaaaattaagtgaagagatggccttagctgtattggctttcaccattcctggctcagtgcctgccacaaactgtactttaagtaagtatgtcttccttggataccaaagtgtcacttccatttgatcatgttcagcattgtggttccagaataataggcatagcatagtttgtttaagcaaagcaaagacattgagggtgaagttgttagtactattttgtgagttatagttatccccagtgaaacattacttgaatacacacaggtgagttatttggaaaagcaattaatctcaggaaaattaactacttaaatgcatatactatgattggcaaagggattttgttttttcatgtaaattttattatgttttttggctttgtgctaaatattatctggtgccaagagttatttgaaggccaatgctggatcattcaaaatgagattacagagatatatcaagattccattataaattgagcaattaaaaaaatactattgttcttacttttccaagtttctctcttgcctacttttggacagagataccacaatccactagataatataagtagagcaggtatgctgatattagtactggaatgctgagggatcaatttacactaatttttaattgaaaaaatggccatgtagtaattgaaagcaaaagcatttaatactggatactgaagaaatttaatttaaatgtaaaaagtattgtaaaagttaaatcgtattccattacattttattttttgtgtccacaagaaaaatattttgatgaaggtatacatttttaaaaaacaatcacttttttcttattgcaataaagagcacttgagagaagcatattagatacaacaaaagaaaatattagtgaattggaaggcatattaaactacttactttactggaattctcatttttagttttgacatctgttttatatttttgtgccatttggaatgtaggtcaaaaattcttgcattgtgaaagacattaaataacattccaaaatgaattgtggacaataaagagtaagcctttctgtgcctgtacatctgctgtcctccacacaatttctggtactgacatgagaggcggtaatttttctttttgtttccttttgtttacccctctctctgtatgttttctgaatactttggaacaactgacaaaaatctgatttggttgctctgaaggacttacagatagggaatacctacatatacctaaggacacaggcaaggaaaggttaaaaaagaatgcttctatacagggagaacaaagaggtttgttaaattgtattacaaaaagcgtattaactgtcattatctccataattctgcccagtctaagataatccattttcacctagactcccaagcagaaattttactcttgtcacccaaaggaattaaaatattatctttttacaccaaaactgagacaagaacacaaaattccaagaactgggcaggagtcaataaaccataatgtcttacatggagaaagagatgccattgtgagatgataagcaaagcagatgccaccaacattttgttggatgttgtggagggaaaaccattctttatagtaacatgttacaaagactggaaacataagggatacatttgaataagcacacaaaaatagtaaaaacgtatgcaaagaattaaagtaccaattcaaataggcagtatgctatttaaagtaaacaagaaacaagataggaatggaacatataaagtgaacaacaaccaaaaaaaactacttttaggaatgaccaaatcagacaatactacaggctggtgtatcttaatttctaaaaaagcaaaaacagaccctttctttattcagttgatatgagctgaaaactcttccctgtgccagcactctgctgttcagaagctgaacctacagggtggatggatgtaaccacagttgttggctatgttgttacttagaaacaaagagtaaagcatttaagaacatttaaatggaagagtaggaaaccctgaggtacttaacaaaatttaaaagtagtagaaaaaaattactccacctggccaggcacagtggctcactcctataatcccagcactttgggaggccaaggcgggtggatcaccaaaggtctggagttcgagaccagcttggccaacatgacaaaaccccgtctctactaaaaatacaaaaattagctgggcgtggtggtgcatacctgtaatcccagctactcccagctactcaggagactgaggcaggagaatagcttgaatctgggaagcggcagttggagtgagccaagatggcaccactgcaccccagcctgggcaacagagtgagtctctgtcttaacacaaaaaaaaaaaaaaaaaaagaaaagaaatgttttaaaaaagaaaattactctatctgatattgtagataagcacctagtatttgctccaatccatagaacatcagaaatttaccatccaatcgagattttttttttcagtgaaaggatgtttgttttcttcaattgaaaatattagagttaaactctatatgcagcagtttgaacccaaatataacatttaacagattataggatgtcagtatttcaaatctagtaaggctaaattgtacattagatgaacacatttacaaatttgttttaatcggttcaactagttaattcttgattgtaatagtgcacatccaatctgtattttgttattctttttgctataatctaattcccttcttttcttggtaattaaacaagcataaaaataaagaaataacagccctttcacatctactgtgaacaataatacagtaagttgtgagtagtcttgatccatattgatgaaatgttacacttcagaattcaggcagtacaagtacaaaatgagagaagattaaaatcactaaatctgatctgtgagaagattaaaaacaagcctcttataatctctcactgctgccagaagtggattaaaaaattaaaagatcctcctacctcctcaccaggagttttatgaagtatataccatgaacatcactagaattttgaacaagaaacttgatagaaaatttagctgaagctatttttcctatagaatatttctcaagattttgttactgtaaaaacagttttgactttattttcccaaagtgtttattcttcttatgcatttaataatgacactataggccaggcgcagtagctcatgcctgtaatcctagcactttgggaggctgaggtaggtggatcacaaggtcaagagatggagaccatcctggccaacatggtgaaaccctgtctctactaaaaatacaaaaattaactggatgtggtgacgtgcgcctgtagtcccagctactcaggaggctgaggcaggagaatcacttgaaccagggaggtggaggttgcaatgagctgagattgcaccactgcactccatcctggagacagagtgagactccgtctcaaaaaaaaaaaaaattatatatatatatatatatatatatatatataattacactatagcttttcatgcaaagagtacttatctacaaagtatatatgactctattcatgcaatcagagtcatggattaaaagaaaattaatgttagatagaatagagtcacaatttacattagtacattttcatgctgctgataaagacgtaaccgagactggataatttataaagaaaaagaggtttaatggactcagttccatgtggatggggaggcctcacaatcatggtggaaggtgaaaagcacatcttacgtggtggcaggcaagaaagaataaaaaccaagtgaaaagggaaaccccttgtaaaaacatcagatcttaagagacttattcactaacatgagaacattgtaggggaaactgccctcatgattcaattatctcccaccaggtccctcccataacacgtgagaattatcggagctgcaattcaaaataaaatttagatggcttgcttttattctggccacactggcagctgattagattttgccacccaaattgagggtgggtctgcctttctcagtccactgactcaaatatgaatctcctttggcaacatactccatagacacacccaggaacaatactttgcatccttcaatccaatcaacttgaccctcagtattaactatcacacaagtttagcacaaatcccctttgtttgcaatccctaaaaaagaaaactaaagtcggttaagattttccctccctggcttacaggattccatcaagaggaatgaaaagggagcccaagaaatttcttatacttcacaaaactgcaacagccttacactactttggccttttatccacgtttaaatctgttgtgactagaagctgaaaactcactctgccaccatagtcttcgccttgatttctcctcccgtttggctacagccctcttgattctagctttcctgtggttagggccctcagcttcaggtcctcacaccaataccacatttttagtgatgtcttacacagacgtcatagaagggactattatcccttctcctttcagggttccttatcctcctcttatccctaattttatgtataggatatattgctatttacaaatatttgtgtatgtattatatatgtatatacacagatacatgtaacttatttgattatccatatctcccttctagactataagctccaagaaagcaaaaacattgcctattgtgttcactgctatatctccctgcacccaggacagttcctagcctataattagtgatcaacaaatatctgctggttcttctgcatatggatatccagtttttccattgaatgaatgaatggtttaacaatattggaatatttcctgagtttatatcattattgggaaagaagatatttatatgccactaaattagttactcatagatagtgggagaaaagtatcctcaagctaggagcactgtgtattctcaaagaaactagatgtaacctgataaacctttttttctggctataaaagacccacaaaagtctatacttagcatctaccccaagacatgaaagaaaatatattttcctttctaatgttgtcacttggagaaatacttagtccagttataccataaaaagtatcttacaccactgagtttgtatattataaatgtataatgtttgtggcttttatgacatatgtgcaaacaatatacagtaagtattatctgtcttttctgtactcaaaatgatggcatagtctgaatcatcagaagtaaaattggaaaaatgtaccaaaataatttaagtggataaatgacagctaaatatacagaaatatatgtatattttgacagtgcttcctaaaaccatttctgtgaaatgtgagattacttcctaaatgaactctagttgccttatctggaaaagttgtacttctgtgacaagcaattagcactctctaaggctaagaaattgtgtgttttaaaaaagtaaataaatattgatttccttttagcttgaagagttttgaaactccacttgtctagcacaaaagtgccttcctactacctttgtcttatactaggctctgaatttctctcctaatgtcgattcatacccaagtaaactcttgatcttgtatcaaatgtagtggaaaacatttacctttaagttacttccaaagagaacttccttgacctaccaagatcttacaatcaaagatgcttgtatttctcagtagacttttcattatttcagattatgaaaatgaagagagagagacacacacacattcataaacatacacacacacacagatatagtagaagtatattctttgcctaattttgtgagtttcatagcttatagatttggagaatgatcgagttggctgattttcattatccactcattagttaattaactttgttttattataaagtacatttttgtaatgttgtagcatacatagttgtggatgttatgaattctgctttaattacatatcttcaatcatattgcttagttaagtattaataattgagtttgtcttattaagcactttcttgtgacctttaatatgataaagtaaatttgtattgatgctagtgtgcaattttaaaccataaaagttcagtatgcaatatgacatttcattccagggaaaatattcttagctgttttcacaatttactctcaatatcaagctataacaggatttctatttatcaacacactgcataatggccaggccagcatacatattttaaaaggcaataatcatttgacattgcactatgcatttggctccctgtcatcatttgcctctactaatcataacagtagatatattggctgaaatctcctattggagttgtagtttagtctaccacatttttcattccatcagtttttgttttatgcatattgaagttctgatattaggttcatacacgtttaggattgtttaatgtttttgatgaatttgcccttttgtcattataaagagtctgtctttattccacataataatatatattttgaaatatgctttgtgtgaagagctactccagcatccttatgattcgtttgtcaccaatattaatattagatttatctcggtctttatatttaaattgtgtgtctttcaggctgtatatggtttattttaaaacacaatttgtcaatctctgcttttttagaactttgaatcgttagtttttagtgtaattattaatatagtttgatttgaaattatagttctcctacttgctttccactttctaatctgttctagcttgttcttttcctccttttccttttatttttactctttgtttattatctagacgacttttaaaatatggtcgctcaagatgaaataggcactggcaacgtatcctagtctccctttatgccatgtacaccttcacatatgaggactccaaaactctatacttccgtttccactttactctttgggtgattgttcccatagcatttacttctacatatgttataaattctataattcctggttattagttttcttggaacagtacatgacttatcaaagaacacggtgaatgagaataatttttttttttttttttttttgagacggagtctcgctctgtcgcccaggctggagtgcagtggcgcaatctcggctcactgcaagctccgcctcccgggttcacgccattctcctgcttcagcctcctgagtagctgggactacaggcgcccgctaccacgcccggctaattttttgtatttttagtagagacggggtttcaccgtgttagccaggatggtctggatctcctgacctcgtgatccgcccgcctcggcctcccaaagtgctaggattacaggcgtgagccactgctcccggccgaaaatgttttatatttacctacagattgaacatttttcatttttcattcctttgtgaaatttagcgtttccatctggtgtcatttttcttccccatgaggaagcatctctttatgggttttttttttagtgctgtttgttggcagcacattctttcagtgtttgtttgactaaaagcaaaattatctttttaaaaaataattttggaataaagtttagctggatatagaattctatttgacaatgtagttccatttttcttctggtttaattaagcggtttctgaggaagaagccggcagtaattcttgtctccgtgttgtgtttgctaaacttcctgaatctgtgagtttttcgttttcatcaaatgtagatttttgacattacttcttgaaatttttttctgctcccctttctccctttaaaaattacagtttcacatatgttgtaatgtttaatattgtctcataggttagtatgctctgttcatttcatttttttcctttttttctctatgtgcttcaatttgcatagtttctattgctatgtcttcaaattcaccaatctttccttccgctatatccaatatgcttttaataccatctagtgaattatttatatcatatattttactttcatctgtagaagttttatctgattactttgttgtatattccatttcttgcctaattattttatgttttcctttaaatacttgaacaaatttataacagcttttattttatagcattatctctttcatttctggttatgcgtctactgaataacatttctcttggttaagagttcacttttttcttcttcttggcatatacaataattttgtatttgatgctcattatttttttttatctgttgagtgctggattttcgtgtgtgtgtgtgtgtgtgtgtgtgtgtgtgtttcaatatgggatggattttgttggagtaaccagtttagttactgggagatcagcttgattttatttcagagcttatttttaagcttttttgtgggggtcttgaatagcctttgttctgaggctagtctagttgtaaaataaaggtgacaatgtctagagactctactaactattcaatgagaactctcctctctggcaggtcaaaatgtaaaaacattcctcagtttacacccctgtcccccaatcattcttgctcaggcaggtagagttttatcttacacatatgcagcttttatattcagcaacaaagtctaaagaacccagtgcagatttctaggggtttttctccttgtagctttccactttctaattcttccctgcaaattccagccacctctgcctacccaaataatttcctttgtctcttcaagtcattcaagctatcaaatgtcacttgaaaaccccatttcttaaccactttcttgaaggttcctcctggcagagagccatagcaattaaggactcaccttttttatttatcttttctcacaggtcatagttctgtgcttcctactttccaagcttaaaaccatatttcacagttgctttcaatttccacttatttatatcatgagggtatatagtctaagtccagatactcatcttgagaagtggaatccccttgtataattttgtaaacatagagtactttgtatagatataaacaaaggaaataatataaaatgataaatgcataaacatatataaggataatataagcttggcagacttactcatcttcctcaggtatttctaaaatactgcattcttggtaagggctaacattattaccctgtttgggatttcactctgtttccattccctatccttctttcctgttttacatctgcttcaatacgtttatcagcacttaacatatcatatattttacatatttatgttgtttattttctgctctcccccagcctcaaagtaaagtatagccacatacacttgtgggtttttgctcgttttatttattgttgttttctaatatgtaggacagtaaatcacatatagtagaggttgaataaatattagttgactgagcaaataaatgaatatcgcaataagagttttatctggcaagggaaaaaaagttgaggaagtgctaattggattttgcaactgcacacatgttatggactgaactgtgttccccagaatctctatattgaagcactaagccccaacataattagacttggagacactatttttgggcaataattaaggttaaatgagtttataaaagtgaggctctaatccaataggactggtatccttataagaagaggaagatacatcacagccctctctccctttctctgtctctctccacccccactgcaaggaagaaaggccacagcaagagaatggtcatctcttgttgtgtaaggacacagcaagaaagtaggcatctacaagccaggaagggaggccacacgaggcaccaaccatgatggcaccttaaactttcagctttcggaattgtgataaaataaattcccattgtgtaatccacccagtgtgtggtattctgttatggcagcctgaacagactaatacaaactataagacaatatttcttaaatgatattaggagcaaatatgccaaaatgttatagattttctggaaggaggtacagagctctttattatatttatcttcaacagttttgcatgtgtgtgaatatgtaccaacatgaaatacattaaaaatactctttcaatagatgtaaatataactctatatgtgtagataactatatagataaggaatacattttaagcaaagatttttcattagaagacagaatgtgcaaaatattacatcgtgtctagaatatgataggattcattaaggagtagttcctttgttctcttctcctttccatcctctatttaatagacgaattggtccataagtataaatatatactagtgtgtgatcatcatttgtagctgttaacatgcaaaaaatttcaaaacaaaacatgcaatgtgttatccatgtgaaatattaaactttcttggtctgaaaagtcaaagtcacaggactaccccttcctgataaatatgatggaacataaatactctgtcatgtttcccaaggagatctgaaatttgcaaaatattgaattttgatttatatttttaagccttgtaagcttgtgattcattaatagccatcttagtcccagatctgcctctgggcactgatgatgctgccagtgtgagagcagcaggagatgatataataatgtggcatcctcttatggggtattacagtggaattagaaaacagctattgaactcagttttgcaagactgttccttatcttaacattttcaaagtcaattaaacatttaaaaatcatttatatataaagtgctagtttggtatcttcagtgaataaagtaataaaatgcttatcagtatattactatctttaattagtctactcgattttacaaattgagtggacactgacaaatttagaatctgcactaccacaattaattgctgtaatgttcacaggtcagtgctcacattgataatgatttttaaaagtcagacttacagaaaagagtttatttccaaaagcctaaatcttctgttctcaaccggaatggggaaggtttgaggagattctatgaggatagctgtggaagtgagcctgtcacagttgggtaattcaatgtagaacttctagaaaataataagagagaatttaatattatatgaagctctaataatgtagacctgagtttagtcaaatatattttattaatgaaattatggttttatttgtcttataaggtcatttcagtaatatattccatttttcaacatcctcatttggcattgctttttaatagcttgatttgaaaacgatttaatttttttcattttctttttgccttttctctacctatttgctataaatacataggaacttaaactatcaaaacatgctaattgtattaaattataaaataaacacttttataaaggaaaacatttttatctcctcttgttacttttaacttaattgtttatcatcctgatttttttaaaaaagaatttcttcttgcatatttggatgccagagaaaatcacaaatagttgtaaaacaaaagtcatttgaatgaaagaacatagcacttttactgatggtttgagaaagttaaataagtaccacttaattgaagtaaattataaatttgaatctttagtcatgcaataggtattcatttctttattttttgtagacataaagttaaaaaataaaaagttggggttgttttgtctgatactggatcactggattccaatctatgaattggtcacagagtaataatacttatcatatgtttctacataaatgctatctaagtttacattttattataaaataactttaaaataagaattaagaattactgatgctggatttctcttggcccctttgtcagactcgtgatgggggtgaacatttactcaacctgctgtgctcacctcttgtgggagggagcatgcatgtgagtgagtgcaggactcacagccagaccaggcacaagtgagtgcatgtgggacctggccagcaagctctgtgtggggcccacacccagaccaggttgtgggggcctgtgaccccgaagccccagagggcatgtcacatgctgtcttagctcttccatctgcagacagctgtgtgttatcagctcagttggccccttgcctcgttgcatgtggcagctgccctctgccagcaagagcaaagggccagtggtgacagccttttttggatacctgcaattggtggctcccaaactcttgtccagcatccaaaaagaatgaggttgatcaattggacacttgaaggatggtaaaggcagagaattttatttagcaatggaaatggctctcagcagagaggggagctggagaggggatgggatgggcaggtaatcttctcctgaagttcagctggttcttttctaaagtcaagccacctctcctgagaagtctagctgtctttctgaagtcaagttgcctctctccagtcaagctgcttctctctcctcttctgactgagtctggggtctttataggcacaggatggggtaggtggggttggccattggtagttttgcaaaaggcaacatttgattggcaaaaaggcattattcaaaaggaaccaattgggagagagcgagcaaacaggaatagacattctcgctttgggccatgggtttcaggctactttggcttaaaggtgggtttcaccagggacctgcccctgtctgccttaaatttctctgcctcctgcctctatcattacttgtgttaaattccctttttcccagcaataacgtacccaacttgatagattccaagccatataatttttaaatttttattcaaatatttatctgattttaactttaacatgaaaaatttttattatattgcaattattcttcataagttcagaaaaacctataaattgtcatataaagcttcataaatcaaaattaaaacatgatatatgtatttattatttcccaaaacagatattgccaccttttgccatcaatttaagtaagagatcatagatatagtgaaatcatgtttctgtaataatcatgtttatttttcaagattcatccaaaaaattgagacttctaggataattaggctttaaatgcatttgcatactttaatcatttttataaatagtagattccaagtgccatgagaacagaacattttctgacttgcctttatctacttagctcctagtacagtaactgacacttatggagtgctcattatgcataagcccatgatgtaatgctgactatagatacaaaagtcaaaatttaagagggcagaataatcaccatgaaaaaatctgtttttcttgcttgatatgctgatgttttcaggtaattctgatgctctaacttgaatggctgaattggctgggctttcattgtgtttcttttggtgatcgtaattcttcagcctgcccacgttgttgttggtgtttatgttagccccaacaccaaatagtatcctccttacaatgtgaaaggaatttctggtataattcagaaaaacataagggcaagctttgacaatgaacctttaatcaaatatattattttacttccatatctctaatggaatctattgcttgagatttgaagggttttctttttttggtgtttaatatgttcctaatccattctggagactctaatgttaccatattaattttctagagtgtgttacaatattttacaatatgaacatgcaaataacttttcatgttgaccatgaacaagtgacttattctagtataatatatacattattgactcaatttgttggtgatatcttgaatattttcttttcctgaggtcatctataatatacttacactgttgtattaaataatgcactcagatctatgcattagaaagatgattctaaattgggcaaaaagagtgtgcttagaaactgaatagtcttagcaaatatgggagtgccttgattcttagaaatggaagagtttgggtggctgatttgagtgatgaagttgatgtgtatatttgggcaagggatctagtgtcagtcacagggaggttccttattcttctcaccttggagcccctgagatgcatctagtaagtaccttaaaccagtgattctgaacttggtaaaaactgtgccccacaagcaaatacttttcaaagtctagagacatttttggttgtttcctcggggaaagggttggtattgatatccagcagtagaggccaaggatatgttaaatatcttacaatacccaggacagatcagcacaacaaagaattagccaaaaatatcagtagtgacggatgctatttagaaaccctgtcttagattgagaaaacactgaacaccagtgatatggttctaactgtctaaggaaataaccctttttctataaaatccccttttatagttacacattttagaggaccattttactcactaaatatatttattgtggtcaaatgaaacatgctactgcatatcttccacccaggtccctcttctcctacaaaaggaaaactacataaaagtaagtaaattgaaaagcaaatgggcatattgtagatacatttttatctacactacctagtgtttactgtttttatttgttattgagaggtagtaaaactcaaagagatcaagttatctcccgtaagtcacaaattagtagaattcaaactaagagcttatattttgtgcctagtaagctttttaattctgtaggtggaataactttttcatgtgacagattttcaggtgcttaatttttttcaatctccatctatcccacacatcttttacaaactatttcagattcagttatgtatatatagcaattattgttgcaacaaatgccaagcagataaatgaatgaatagaattattttgggagttgaaatatacctcactgaacatctcttttatttacttttaaatgcttacacaaaaaatagcttatatattgtccatacaacaatctactctactgcttctggatgatgggtgcatttcttcatgcagtaattctgcagtgcagggaaataagtggaaaaggcacaatcacttctgaagtttttattctgatacacatcacttccatttacctctgcagtggcaataattagtacatgaccacatttagataagaatcgggtcaagaaagtggttactgggagagcagcttgcacttttcaatgtcaaatgcacgctatggaacttgaagtacagacttttggtggaaagggtagcagaggaaaaagaaaaagaatttataatgaaatgtctaccatttcttcagtatttccaatatgtcagacataatgttatacatgtttttcatatattatttatacattgttttatgaaatgggaatcgttgtctttattctgcaggaaacaaattggaagcttttcggaatgaatcatcttatctaaaggctcacagctacgtgacagtaatgttgagatttgccatgttctagtgaccctgtaattgttataagcaagaatttagggtggatgacctataattcaacttctgattctaaattttattttctttcttgtttttgatttcatatgcttgattctacacatatttatgcacctttctgtgcttaatgtattactgccaatacacgcctaagcttttaaatggtgtgaatcaatataggctctttgaatgtggtttcatatttgagtgttattttgacagccattttaactaaaatcctgtaaaataaaaatgttttctcttattttcttttcttctttttttttttttcttttgagccagagttttgctctgtcaccaaggctggagtgcagtggtgcgatcttggctcactgcaacctccgccttctgggttcactcagttctcctcttcagccgagtctccactaatatcatcctgcctgggaagagtaggaatgctttgttactatttcccaatggcctctactgatattatagggagtacagtggcctcattacctctggacaatggtgaaagtactgtctccactacatttcttttgacaagactttagcagagaggggaacaatggcctgtcgatgctgggtggtgttgggaatctctacaccaacccatgaggtatccttttacactgtggtggcgtggtggagttggtggttgtggtgtaggggctctttactctctagcaggaataaaggttggttttccacctagcatcctcggacaccaagagtgctgaggctggtggctgaaccaactcattacaacctggtaagagtggagatctaggacttccactgacttttcctagtgatatgttattgtttaatattttctgttttggtaggctgatccttttctggttcttaggtagagagagctggctctttttttctgcctgtactcattggtcatcccggttttctggcttttccagcattcaatctgggataagtgatgcaaaaacaaaacccaaataactcactgccaagtcatccttcatgccacagtgtcctttggcaggttatcatttcttcagacttcagggttgtcttatgtttgttttatacataaagtccccacctttctgagagctggtcggtcaactcacatttttaaagttccaaataatattataagatgttgaacttctgtattaaaaagaaaattcatataaaaatatgattcagtggatggcatataatcagtgcacagtgccttttagaaatcataagacccatgtgtgtctatacatgtgcacaagtacacacacacatgcacaagtacacacacacttccacaaaataaacacacacgtgcatgagtacacacacacgcatgagtacacacacgcatgagtacacacacgcatgagcacacacatacacacttccacaaaatacacacatacgcgtgcatgagtacctacacttccacaaaatacacacgtacacgtgcatgagtacatacacacttccacaaaatgcacacatacacatgcacgagtacatacacgtgcagcacgagtacacacacacacacacgagtacacacatacacatgcacgagtacacacacacacaagcttccacaaaacacctgggcctttagtggctgagggctttttaaagaactggtatctggagcaaattctcagaattgccaaattcattgctaatgaaatgcaaccccggtgcaacagctctttgagaattgcataaatgcctaccaaaggtaggcatttattttttacaataagtaagtctttttaaaattgtttcagcatccaattagtatatgccttggattccataatatcctcagattataaaatagtaaaaaatatttttatatgtgtatgtttaaaaaaaggtttcacctaaaaagtttagtttaatggctttatgtagatatgaacagaattttggggagttcgactatataaggaagagggaaataagaggaaatctaatattatcccatctcctaggacagaaacaaaacgtaacgtgcctgttttttattcaatatttgtgtttgaatggtacttaaaaaaagaaaaacaacacaggataaccaaattcaaatattttatgcttctaatcatcctcaatctctggggtggtgggggagcagtttatgtcattatatatttaagtgaagtttaagaaaaaagctcaaattctgaagaattcaaaagatgtcattaaaaatacgtaactagaaatcaagattttcaaattcttcagtatttttaataggtccttttttctatgatatgggtttttataattagttataatcataaataatcactaagaattcaggatatttttcaatagtatatgccaataaatataaaagtacatttctataacaaaatcatttttatgaaaataattccttgtttgaaacccaacacaaaaactaaaggatgcagagcaaactttgatgcttaaacttaaaatcatgaatatggtagaaggcacactaacggtttcattagtatcttcctaaatattgttagattctttggtacttaatcaataataaaatattggtgtatgttcgatattgtttctactgaaagagaattaagaaacacattacattggaaacacattaattttactaaaatatacatatatgctaataaaatcaagtgcctttttaaggatatgtgttgttatttattattgccttatactctccaattaatatttccttcaagttattacatacacatactctctctctatatatattaagctctatatattatagcttaatatataagtatgcataagtatataagcatacttatatccatatttctgaacgttttactattatctgtctataaataagttccagaaatattggtctttaatatagaagacacagcttatgtacgtgattgtaacagattattgaatattgcataggtgtatgtgaatgtgtgtgtgtatataatttgaaggaaaataatccaaatcttacttcttttttgctacatcttacatgactacaaaatatgaacctaaagtaagagaacaaattcatgcagaatataatatgaatctctgttgctcatgtttctctgtgtctaagtggtgattcagctgtgaacaggctggtctaaaatgtccactagagactttccagtgttaaaatggagagctaattatatcactatgatgcatgtttctggccaataaaatgttttaggtttatgtgggatcaataataaccaaaataaatttgtatagataaaagagatggcatttggtgggacattccttggactctaaacaaaaatgaaagaatagaactgtactttttcattttcttttggcattcactttatttcatgtatagtggctaattttgctactttgaataattcattagttttctatttggtgtgataacaaattgccactaacatggtggcttaaaacaacaaattattatcttataattctggagattggaagtttgatatgagtatctctgagctaaaatcaagttattggtagggctatgtttatttccagaggctctagagaagaattcatttctttgccttttccatcttctagagaccactcatattccttgtctcatagtctgctttcttcattttcaaaaccagcaacattgcatttctctgagccttctttcatagtcctatttctttctttgactctgctctgtctctcttctacttttaagaaagcttgtaatttcaccagctgtaaaatcctatttaatctccctattttaaactcagctgattaccaagcttaattccatctgcaacttttatccttaatctacataacctaccacattcacagacctggggattaggaaggagacatctctaggaaccattattctgcttaatgcaaggaatttttaagtttgttgttaagagacaaattaatctatagctgttacaccaatttacattctcaccaacagtgtgcaacagtttcaggctttctacctcctcaccaacacttgtctatttttttttcatcatagccatctaacaggtgtgaaatgatatctcattgtggtttttggtttctctgatgattagtgacactgagcattctattcatatacctgagcattctatttatatacctgttggccatttgtatattttctttggagaaatgtgtgttcaaatccttagtccaattttttattagtttattctttttttttttttttactattatgaacttctcatagaatttgaagattaactccttaacaaatatatggcttgcaaatattgtcacccattctgtagattgccttttcactctgttaattgcttcctctactgtaaagaagatttttaatttgttacaatcctacttgtgtatttttgtttctgttgcctatgtttttggtatcatattcgtgaaatcattgccaagaccgatggcatgaagattttctcctagcaattttacagttttaggtcatacgtttaagtctttaatgcattttgagttgatttttgtgtacgccataaaataagggtctaatttcattcttttgcatgttggtatccagttttcaacaccatttgttgaagaaactattttctcctaaattgtgtaaaactaccatatgatccagaaattccacttctgaggatttattcaacaggatttattcaaaagaattgaaattaggatcttgaagagatattaccagcattgttcataatagctatgatttggaaacaaataaatccccatcaacagatgaacagataaagaaagtatggtatatacatgaaatgggatactattcagcatttaaaaaggaaattctacaatacgtgacagcatggatgagcctagaggacattatgctaaataatagaagccagtcacagaaagacaaatcctgtgtgattccacttatatgagatatctaagtagtcaaaagcatggggtgaaagagtagaatgatgatggccaggccaggtgcagggaactgggaaggttctaatcagtgggtataaactttcagtcaggcaggatgaataagctctacagatttgctgtataacattgcacctgtggtcaacaataatgcgttgtccacttaaacttttgttaagaggctagatcatattaagtgttctttccaaaataaaataaaaatcctacttacagctattttcataagaatatcagttataattctacttctgtcaatagcctaacaataggctttatccatttatctatctgggttttaatatttatagtatagtttgtataaatccatataaacagatccaaaatgagaaatgttcatctatgccaatccatttagaaatttcagattttccctttctctttttaagctacatccaccattccaataataatcatttagattattagtcaaactgtccagaattcacttttaagcacacgcaattttgctatagtgaggaacattgatttatttcagaaaatttttgcttgttttttgttatttattttattgtatttatttatttttttcagacagagtctcggtctgttgcccaggctggagtgcagtggtatgatctcggttcactgcaaccaccgcctcccaggttcaagtgattctccagcctcagcctcccgagtagctggatttataggcacgtgctaccacacccagctaatttttgtattttttagtagagatgggattttgccatgttggccaggctggtctcaaactcctgacctcaagtgatacacccgccttggcatcccaaagtgctaggattacaggggtgagccaccgtgcctggcccagaaatcttttgattgtatagcagttgtgggggagattcttgaagccggttttagtctataggattagactactaaaagtaaaaataacatatgaatagactgggaatagtttaaaagggtgaagcctaaacaggtgttggcttcctttgcttgtaagtacctcaaagacatagactgtcttattcatctctgtatgcctgtgaaattacattgagtcaggtacatggtggatcttaataattgtgtgtttaataaataaaagcatatattaaaatatttgaatacattttaataaaaaattaaataataaaatattaggacctgtagttacttttaaaggtaaaagagtgcttaggttatatcttttaatatctactacttttacaactaaaactcctagaattttcaaaatcagccccaaatataaaataactttaatctgtaagtgggagataatcattttaattgttagcattcctttatagaatgttgtaaaataacatccttgatataaataaggggaaatgaggtcttaaaaataagcgtatgatattaaataataattactcaaatatttgttaattattaaacaaattaagaaagaggaatgctctgtttcaattaatttttaatttagtgcttctttatacagagtataacactatattttcctaagatactgttctgtgtgtttatagaatgttaatattacgattaataaaatatttgactctgtttcacttactttaaactctctcagtgcctattataatacctaacagcatctcagaaatgttttagaataaacaaagtgatgacagtgttaagttttccaagaaattttcatgtgtctgcacattacatggatatatttctttctcagtttcctctatttacttgagacttctagttaggatctggtcaattttttttatattgtctcaaatcaaattacatcatgaacaattggaagacgtcataaatcaaacagaagttaagcaaaaggatcctaaaaataatttttccaagtaaaatttttatttgttcatactacatgtacctttcctcatctgtcaagaaaaattaatgctatatatacaaaattgcttaaaaagtaatggtcaaatttgtgttcactaggtgtattaaggaatatcatggttcattaaatgaacttgaacattttataccagaaatgaataaaactgtcatttgctgttattctcagcaaatgagaagtacttacattttattatgattttggagttattcagctaagattgagattccatacttggtgtgtctgtgatattttaattgaaacttagatctttttgtccttaaaaatcctcctttgctgaggacacacacacacacacacacacacacacactctctctctctcttataaatttattttagtcaagtttatttatcaatagaaatatatttttgtattgatctatttagtatcctcaaaccattttagtcagtcttgggaaataacctacattttacatggagcctttcaaaattattcccaagacttgtttacatagaattcactcaataagtagaatcaagtcacttattgacaataagttccaggtactttgtgaattgttttaaaaattaagttgatttaattcccatagacatcctatgaggtgacattattgtacccatttcacaaatgaaaaacatggcttaagaaagtgaaatgatttacacaggattatatgtgtcttaaactgtagggccagaatttaaggctatattctgaggcccaggcccataagcctcaattatggtgcctaatatattaatgaatcaatatttaatttcagaaagagggctatgctttcttctttgatttggttgcacagtcctgtgaatccatccattttcactcatattaccccctagacatattgtaggaaacttttctttttgttttatatattttcagtttttaaacactgtattggcactgctgttctgtttggatccagaaatccattaatgatttctagttctctaatctgtgataatttactgccaatggaaatacagttattcatggtttcattgcggtcattgtccagacctctctccctccatctcttaacacatcggtggttccccactttcccctatttctttcctttataaaagctttttaacatatcagcatgatctgtaataaactttcttaacatgtaaaactgtttctattcttatctcacattgtttaaaatgtcagcagcatgcaatactgtcatgactctctctctgtttttagagtggtatattaagattcttgcctcaggtaaaatgttcctcttattcttacctccaaatagatgtttatctacttaagtacttttgagatgaaactgtggaggcatatttcaaatgaccaaacacatacttattggtgctttttattcccctcttacctcaaaagatttaatctgctgtaatacacataaatcatacatgtattgcattagaaaagaacctaatacttttatatattttatggctatgggtataaaaattataattgtgaacattagcatttcattttcacaaagcagctgccagtttatgatcccttaggattttattaaatttgtgagtagagttgaaagtcatcatgcttactcagatctattccctgtcatcatacatcaaaaacagcctttctaaaatgaaaccttcagtggcaaaagtatttaggaactaatctctaccctttcttctgttactgtcttcacttaccatatttttgcctccccctttctttttgtttctttttttctttaagcccccttttggccagaatatgccagaatatggctgcttcactctattctttattgttatatttgattttaagtaaattctagttaagattcttaacaatttatagttggacagcttttcccaagactacacagatctcaagaacaaaagacaaagataaggcttttaaagtgattctttttttctcttctcttccacccctgatctctcccccaaaacacttctgtgtacacagagaaagactaaaaatttcagaaggaggaaaggaactgtctaaaatttagttttcattagttttcttcccttcacttcctcatgcccagctgatggagaaagtccatcagctcataagcagataagcggacaaagtagtgagaattccatgtcggaagtagtcagtgaagctgttgctggggtctggcttgctgcaggtcatgtagtgtaaactatgaaatgaaagtaaggatctcaaagaattggcccaactgtgtcagcacttgccagtgcgtgtacagaaagagggattttgtaccctttttgtccatgagacacttccatcgtctttggtgtagtatatgcatgtccattataagtcttggttttacttattattgtagatgattatctctttatatacaaccataattcaatatgatccttgatatttctggtaatgcatagctaaatcattctttttaaaattatctgaggcagtggtgtatacatacattttcatatgtaacagaaaaatgctgtagtaaagtcagtttttgtgaatgtcttgattcttgggctgttttgaatcaaaattggtgtgaaaaaataattttaagaaaactattgcaataaaatactggatcctggacagatctgaatgatctctaattataaacagtacttccacagcacttccgagcaggagtagaattgtaacaaaaatgattgcttttaagtaaagacaaggggatcaaagaactaagaatgtttttccagcatacctgtctttccttcttaaagtgttctaaatccttgtttttctagagaagtggtacatattattgtgggaacaaaaattttattcagatattttattcataacatatgcaaattattaataatgtatagtttctttacataaatatttctatattttgcatatttgataatatatgtattagattataaattcctaagtccaaaaccagactgactatttttttaaagtaaattctaagcaaaacagagttctcaatacttttactaaggtaaacatagaccctacttaaaggtatcttatgaaatagggatttttttcttttttcttttttttttttgtactgagctaagcagcaggccaagaagatatttaattgaatcattaatcatagaacttgcaggatctgagtgactacagagccatgcaaataatgaggtccagctaccttataaaaaattatcctattttataattgaattatattgatactttatttttcttaagcatacctactccagtgttgccagtcataagatctagtgagaatatgttgttaaaaaagtctttgctcttatcaggattaatgaaaaattattattggtgaaaactgatattagttggaaacactgtattggtggctagatatatatagcttaccacattttcggaggtgaaataggaaaactagctctgtgtccataacaaagattccttctaccaacatgtttcaaaactatgagtctaaaaatttcagatggctaggtgtcaagtgatttgttttgattccatgggtatttagcaattttaacagaatgttctaagaatttcatttaaatatttatttgagtgatcagtgcatagcctgccactatcttcacagctggatgcaagcattgcagtaacctaagcaaaattgactagattttacagtcaccaatgaattaaattgtaaaacaagtctttgttgaaatcataaaagattcatgtgaaaataattgagtcatatctggtgttttatctccaacattaataagtacatattttcctttcaggagaaagttgaaataaaggaattatagagctatcaatgaaagaaaatacttttggtggttttaatttccacatatgctgattttttagctaaagggaaaactgcctgtacattgtacattatgttctcacttaacattgttgataggttcttggaaactgtgactttaagcaaagtgatgtaaaacaaaaccaatttttttctcatcaaaattataatgaaatgacaatattgaaggaaattacaatatttgaggccctgctgtacattgttttggttaaagtcacggttttcaagaaactattgaccttaagtgaggacattctgttcagtgtttgaaatgtacaaggtgatttcacaagcattttatcgtattatctaacttcatttccacaatgtctctgtaagtctctggggtagggattattatagctatttaacagttgaaaggactgaatctgaatacctttaactaattttgtttttaaccatctcccatgacttcccagactttttgaagggaatttacacaatttctcattgcaaaggcagtaaacttacccattcacttaacaacataatagatgaataaaagcagtgaatggacatccctgagataaccagtaaggagtaggtggcagatccaacactgcacacaacagtcacttgctcagtgacaagactaccttccttccccaccaaataccaatatgtcttatcccatcccacctaaaacatcgatatgcaaaatattttttcatcaaaatggacatgactgatatataacaaaactggaattaagctaactcctcaaattgcttttgaaatatagaggttagtaaaaagtaaatgtcaataacattggggtaaatttggagggaaatactactacagactgctggtggattcctaatgataagtagagatgcttagctgactttctgttttaatccgtatttcaaaaccgaacattatatgatgattaacatttttttaaatggtttatacctgcttgcacgggagggggaatcttgcaagataaaaacgaacttcttatgactcattaaatcagtaacactactataaatcataaacctgttaaaaataaattatttaatatagaaacagcaggtccagctgtttaaatatcatatagcatatggagcttagtaattggattcaaatgctgtctgttacatcatttatacttctgttagagtgttgtgcttctatagggaaggacaaagtagttcttgaattgctattatgctgaataattttcttttaatttcaggtgaccgtctcccaaattaatttctaattgtcgaattcagtgggtttcctctgaaaaagaatctaaaatgtatttgtgctgggtaatttcactgaatcatttatcatgtgctttatttggcttcggatttcagcctaacgtttacttcatattttatgtttgtattttgtttgtttgtcttttaatattgagcacttctaccttaaaacaaagttcacttaaaatataatcttgtcactctactaactcttttgaatatctgtggtaagaatgagatagagaggaatgggaaaaacagagcaaaattatttagtttccaaattattataataaaaaaagcaagtctccctagtgagagttgaaaggctgtatcctgatttatgatgtgggaagctatcaatggagccagaacaaagactagagttatattccaggatgttggtggcaagaaattcatatacagtagaatgtgtcccagtatgattatatttgttccctgaacctggcttcactagtacaacacttcattaaaatcacttgtgtttgtttggttttatttaaattcagacttgtgagccttaactcaaactttctcatatgacctggaaatctatatatttatctaatttcttgaagatattttttactagctcagtatcaccgtttagaaatcattacacaggtagtggggtaaagtggataaaacaagtcatctttgtgaggaagaaaaaagaagggggaaaatgccattgcttgagcctctataccataatgaacatgcactaggtatgaaacttacagaaatgcatcaggtcctcaaaactgatgttctatgaaattttgacaatgttatagagttcagttaacctctaagtggtatttggcttgcgttgtcacattcatttcttgacattcaactgctgtacgttgtgtcttgagatggcaggggagggtcatctgcaagtttcataatcaagctagaagggagaagccaggctcttttctctcacttcttccaccttggacaacttctcgggttcaacagcatctgaaccactttctgggctccagctccttctgggcaagcccagtgtttccagcttttgatgggtaaactcttgacacccctgtcttctccatttgtttctctaggtttgaggagagtgtgatttactatgcgattaatgtataggttgactcattgctgtttgatttcttggtttttctttcacctgtttaaccaactccctgggttgaattccctgaacttcaaacacttagaatggtttctgttttcttggatggatcttgactgatgtaatctcaaacatcagcttgatgtttccacagggatgtagtaaaacagatgaggtatgccagtctccttcacattaaatatcaaatgtgacagcctcagacaccctaatacagcctacagaaaattaaccatgaatccgttccttaccgaaggaaactgaaagaaaaagtactaggagaattgtttggaatcataaagattatcgaccatatcagagaacagaaatgcacaatacctcctgagaattttcactaacatcagaaatacatccaattaaacattgtatgaaagtatccagtataattttgctgactgaacagcagcagtacaaatattgaacagaaagaaaagaagggtattaattgaagatgttttgaaaaacctcactagtactgaaaaaaatagtttcataactttctgactctctgtccatagcataagaccagagaaaaatgaagccctcagttggggactcatgaatttcctgttccaatagttgcagtcttacctgttatgttctccaccaccctttcctgttaagttctgttatgttctccaccatcctttcctcttctttctgttgcattcgttgatgtaatccctcattatttctcaggccctataattattttagatcttacgcccttcttaataactttaactctttccagattagaaacaaacaccatgcaggttcaataacagtcatctcatttctccccaaagttccttaaagtgttgtctataagcactgcctccattttgtctcctttccctacatatatcacaactctctaaggcttctgccctaacactccccacaaactgttctattaaggtcaccagtgactctgccactgtatctagtagacattctcagcattcatattgagacagccaagtacaaagaggaccctgaagactggcccgtctactgggacaagtgcgcactggcgtagagcctcaggaagtttgcgccatttgcagcggggaagagcctggcgtctcctgttttggggtggttacctggggattcaatctttgagacgtgggcctgttaacaggaacctctctcgctctgctgagtttttttctttttgcccaataaattccattttactcacccttcaaagtgtctgggagcctaatctgtcctggccgtgtgacaaggaccctgtttttagctgagctaagaacaaagtcctataaaaatttttcatggcctttttacaggttttggtccctctttgtgatccctcatttgatttctggcacattcttttctcttggcttctataacaccatggcctactggtttctgtcttatttccctacccgcttcttacccatccccattcaggttcatgtgccttactcagccattgcgcgatgtatttcctcaggcttacccttaaaacctctttttcttttagctgcgtgttctctccttgaggtatcttatgcttcattaccatcttcctgtctttgaataccaaacgtctacttccaactctgacttcacctttgaggtccagactggaggtcacaaaggtatagaaaaccaaactttttcatgtaatgacttattttcctctgggcacatacccagtagtgggattgctgaatcaaatggtggttctacttttagttctttaaggaatcttcacactgttttccatagtgattgtactagtttatattcccacaagcagtgtagaagtgttcccttttcaccgcatccacaccaacatctattctttctttctttctttttttattatggccattcttgcaggagtaaggaacaatttgcaattgcaaaaatatggaaccagcccaaatgcccattaatcaattagcagataaagaaattgtggtatatataatatatatatagtatatataatatattatatatattacatatatgtaatatattacatattatatataatatatattatattacatattatatataatatataatatattacatattatatataatatataatatattacatattatatataatatataatatattacatattatatataatatatatattatatataacatatattttatatattatattttatatattatatattataaatatatgtattttatatattacatagtattccatcagatatattatataatatatattcattacatatattatatacaaataattgtatataatatataatatatataaaatatataaaaatttatatatataaaatatatatattatgtatatataatatatctgatggaatactactcagccataaaaaggaacaaattaatggcattcacagcaacctggatggaactggggaccattattctaagtgaagtaactcaggaatggaaaaccaaacatcctatgttctcactcacaagtgggagctaagctatgagattgcaaaggcataagaatacaatgatacaatgtactttggggactccggggaaagggtgacaggggttagggataaaagactacaaattgagttcagtgtgtactgcttgggtgatggatgcaccaaaatcttagaaatcaccactaaagaactgactcgtgtaaccaaataccacccgtttccccccaaacctatggaaataaaaatttaaaaaaaaaaaacagaaacaaaaacaagaaaactcaactttttacctcctccctgcactaatataagtttgcttcagtatttttcaaccaagtgagtggcttgtctcttcttccagtttcacatgacctaaaacgtggtctcaccctgtccctgatccagcattaagatctgcttatcacctattttcttactatgtatctaaggcattgcctgtgtgtgtcctgtattgtaactaaagcacacaaatttgtaccactataaattcaatgccctctctgtcctcttaccagacagcaatggaacgacgctaaagtccttaacatggccaaggaggcccacattgtctgtttctctcaagcttcaggatgcatgatttctcccccattctctgcccatctgtcacactacaggcatcagttccttgatcatgccagtgtttcttccatacacatctatccaagcatctctttctccctggactggtttactccttgcctatgttaaccccaaattatgcttagcgctatctccagtactacctcctcagggaagcagccctgttgttcttctgcccgggctagttattgtcgtgtgtgtgtgtgtgtgtgtgtgtgtgtgtgtgtgtgtgcttctcattgaaccatatcagtttccttcagggcactttttaggaatgatgtatttctgagtgggatcatttgtttatatctcaacctccaaagcctataacttgagtaaatagagtatttgattttgttcaaaatcttagccaagtgctttccaaaggatctggcacagaattgagtctcaataaatatttttagaataaaggaatgagtattagagttggaaaaaatctcagagacatgtaatacaatatcttactcaaagtttgtatcttaatgccagtgtcatgaggttcaagaaatacaagatatcttacctgatctgtcacaaagtactctcattagaccttgctcttcacaaggaaatttaccaccgtcttctgtgtccaactaaatggatacattagttacattattcccactgaacataccaggaagacagattgccacttcctttgttggaggttgaaaaattatgtactgtacatgatacaatcaatctaattttcaggcaatatttatatcttttaaatatgtaagacgttagggttttttccctctcccccagatttttcagtgtcaatattagtaaaacaagattctgaagagtaaatttaattaagttatatgggatgcttttaactgcctgatgtttaagcagaaatagatttccttcctcagtttgagcattgatcttgatatagggcggagtctgcattcccttcagtaggaactgccaataacacagactagactggtagaaatcccagtaatttacaaggcatgaaacaagggaatgttaacttagctggccactaatagttgtgaccaccggccttaatttcgtcatttgaaaaacaagggaattgttttgtaataaccaataattttaaacaacatatttttccattaagatataaattaatgaataaattatggtgtgttcattacatggaatactatacagcaaagaaaaggaaagagtgacagctaaaaatcctccaacacaatggatttctaatgctaacaaaacaagaaacaaaatcatacatatactataacctcattcataaaaaatctataatttaatatggcaaactaaattatttatggatgtataataaaatcaaaaggaaagcaggccaggtgcagcggctcacgtctgtaatctcagcactttgggaggctgaggcgggtggatcacttcaggtcaggagttcaagaccagcctggtcaacatggtgaaaccccatctctactaaaaatacaaaaaaattagctcagcatggtggtggatgcctgtaatcccagctatttgggaggctcaggcaggagaatcacttgaacccaggaggcagaggttgcagtgagccgagatagtgccactgcactccagcctgggcaacaagagtgaaactccatctcaaaataaaatttaaaaaaaggaaagcaaagtaataaaaaatacggtaaagttaataagagagtcatttctactagtgcaagggcaggagatttgataggaatggatacaatgggggcctctgaattgaaagatgcttacctgtatgttcactttatatttattatgttaaattatacacttttatttcatgtcctctcctgtttgcatattttattgatgatgagtgttgatttttaaagaaaaaattcatataatgttatactttcagtggatcttagcttaaatttaagaaagcgtaacattatgtaactctaaaaattgtttggtaattatttgctttggcatctgtgtatgttacctctgaagacatgtacgtatcatagacttcatgttctattatggtaaattttacttcctcaataaaagaggcccacttagctgaattccatcaagattcatggttggtttgacacataaaatagttgcttacacagtatttaaatacctttgaatttcataactaatattgaaatagttggtaaatctcatgtaaacattcgagttgacttttgtgttgtgatggcaggcgcctgttgtcccagctactcgggaggctgaggcaggagaatggcgtgaacccgggaggcggggcttgcagtgagcagagatggcgccactacactccagcctgggcgacagagcgagactccgtctcaaaaaaaaaaaaaaaaaagtttagagatgaggcaaaactggaacctgttccaagatgacacggggcacgggacgttcagctcttctcagctccgattctcccattacttcctctccctggcagtgtcagttacactagcattgtgttggagttcttggcatagattttattttgtttatatgtcttttattttgcttttacacacagggtgctctgatcgtttgttaactgtcttgtcccaattggcattttagttgggatcactacactatttctgtttgtgtcagttctcccactggtattgatcaagaaccttatttctctgcctttacagaaaaccatctctttgtacattttgtataaatcatctcatccaggaaatgagattagccatttttgaactgaaaaaataatccatttatatacagactgtcttttcaattgctgtagaaaataagagtattaaaaatttaagccttcttcaaaaaatttcttaaaatgtattgctagcatggcagatgtttctttctgaggaaatgttaaaaaaaaaaaacaaaaaaaacaatgttcaccaaagctacctgatttagtgagaagctttttgtcttccctgcagagatctgagctcaagtcttccattcagtttttaatcttacagcatttattctctttcaagactttccaaattgccaattcattggattttgtttatcaccttttccacaaaagcccatttgttcattgacagttgcattataggttaaatccaaagtaaggctgataaatgaatattcaaactggcccccggggttgtttttagtttgatagttctatcacatcaaccatatgtaaaatccatcttccagttaaatgtggctgccttttctgtgtcagagattatttattagtctgttgtctattagtcttgattaacaggaagtttttgatcaagcagggttttctcatcgctgattgcttatacatcaaacagtcttttgctatgaatttgacatattaatggttttacagcattgctatttatctgtttcatgttccttctataattggatgcaaaataaatgaagcaaagctgggcaaagatatcattttatgggatagtgttataacaattctacatttacagaaggtgctttgatgtctagttactggccaaaataaatagcatatttctgatcaagttatagcaaatattataaaataaattctcaaggcgctttcttgattcctcttatgtgctcattataagggtcatgcattataaaaacagaagttgatttcaagctgtttgaatcaaggcatgataagaaaattaacataagctttagttttgctgtgaaatagattttgcttcaaactttattttgttctccacacttaatatttaataacctttctactgagtttctgttgactcctccctcaacatggatgtcaaagtagtaactcacacttaacatctctcaaacacaactctttatttttccctgtatctgctcctactccagccttaaacatctctgtatattgtatgagtgtttatgcagttgctcagaacaagaattagttaacaaagatctgttatacttgtcttcattagttaactagtaccttcagtatataaccaccatccagtatttctctctaactcttcctatagtgatctagtacaattctttactccctccaacttaaaatactatagtagtctctgaagtaccttcctactccttccttacctttttgtagtcagtttttcaaggagcagtcaaaatggtattttttaaaaatgtaattcaattcatgccatttatttgctctaatcttccaatgatttcccattatgctcacaaataaccaaactctgtctctttcttctaaggacttttatattctgtctattgcctaactctctgactttgtcttctacctttttcatgatgtctgcgtgcacacacatgctcatacacacacacacacgtatgcgtgcacacacaccttgcttacttatttaccatctcactgattttcttgctattcctccaaaataccaagtgtatttctaccttagggcctttatacttgctgctccctgagactgtaaaactatttccctcagctattcaggagacttgctttcatactttattcaaggacctgttttacagtcacctctctaagaagtcttccctgactgctttatttaacatgaaccttgtaaacctcatcaccattatttctatatattgaccttgatttgttttcttaatagcatgtactatttcctgatattatagtatatatttatttgtttgatttgcatttaccccgctggaaggtaaactccctgagatatgggatttagattctttactaaattgctagggcctagaatagtgcctgactggcacagggggagtccttaataaatatgaattcagtaaatgactacataaatccctgaaacctataaaccaactatttaaaagctcacagtatgaaccattatcctgtgtgaaacttagatggcaaatataaatttatcctgccatagtggatttaagaaaccctcatttgcttatacacaggtgtttatattaattttgggcctttgaaaaactttggattttactctgagtaacatgggcagatactagaagattttgagcagatttcaggagaatcataggaccttccttatatctaaaaatgatcgttctggctgctttgataagaatagcctaatggtgaccgtgataagggtagatacagagaaacccacttaggttattgacagtattgaggtgaaatatgacggcagtggcactaagtgttagcagcagaggtggtggcatgtgattggcttatggatatatttaaaagatagtcatgacaggaatttctgttagatttcctataggatattagagaaagagaggaattaagggtcactttaaatctggaatgatggcattgacacccaggtgcgactactgtggtgtaacaagttttgggttatcagagatcggtactaaagttttcatttgtacattgagggagaaatattcattaggcacttggtgtataagattggagtttatgagcatgatctatgctagatagatagatagatagatagatagatagataggtagatagatagatcgatccctgtttgggtggggcatgggatgttcaactctgtatagtatagatctatgtagtatagatcatgctcataaactccagtcttatacaccaagtgcttaatgaatatttcctcctcaatgtacaataaactatatatattcctatattatatatactatatatattcattactatagtatagatcatgctcataaactcctgtcttatacaccaaatgcctgatgaatatttctccctcaatgtacaataaacactttagtacaaatctatatagatagatagatagatagatagatagatagatagatagatagtatatacatatatttgacatgtctttggcatatatgtattactcaataccttgaaaaagaatgggttaccaaatgagcgaatgcaaacagagaagtgaaaagaacacagtcaggaccccaggaagctctaacattaaaaagtagatgaaaaatggagaaacagactcattaaactgagaagaacgcatctaaggaggtggcagaaaaaccatgtgtgtgtgttttctttgaagtcaaatgaagaaaggatatcagaggaaagaatgattagctatgtgaaatcttgctggtaattcacttaaggagatgtttgaaattttctattaagcaagaaagaaataattggtgacttgatcagagcaatttaggaagtgtagtgggagtaaagccagactgcagtgggtttgggagagaaagacaagaggagcattggagcctgtggctctggtcattctgtctgaagattgttgccaaaattcggagtaagaattggaagaagctggataaagaaaagttgttattatgttttccgttttctcttttactgtgttttttaaaatagaaaaagtaacaggatgtttgtgtgccaatggaaattatcagtagagagtggaaaatgatggaacagagtagaagaggcagcaggacttctataacgttgggatcgggaattcagtaaaccctctcctcatcataacagcagtgtaactgttggaaattttacaataatgattagaaactccaacactcatttaatgtctctgtaaattgtgctaaaggcataagcaagtaaggaaatattagttcaagaaaatctactaagtttcactaagatcagcaaaagttggttgctgtattaggctgttggagctgccataacaaactaccacaggcagggtcgcttaaataatacaaattgttctcatatttctggagggtaaatgcatgagatcgaggtatgggtagattgatttctgatgcttcgctccttggctcacaatgaatggctgccttctggctataccttcacgtgtttttttttctatgtgtgtgcacatgtctgttcaaatttcctcttcttgaaataaaatcagtcatattggattaaggccaacccatatgaattcgttttaccttaattacctctttaaaggccttattttcaaatacagtcacattttgaggtctttgggttaggacttcaacacgtgagttttgaggaaaggcacagttcagcctgtaatatcgtttgaatcataacccactccacagctctgccaaggggactgattttatttgaaacagaacatggaaaactctgtgcttaaggatgttgacaaaaacaatgaggatgttggtggagagtaattaaaatgagcctcttagttccataatacaacataatcctcaaataacatcattttgttcaaaattgtttcattataacattgatgggggaaaaaaatcaattcctagccagggccacggtatgtgtggagtttgcactttctccccagctatgtgggttttcgccagtctctggtttcctctctcagcccaaagaggtgcacgttaagtgcatctgctaactaaacgttcccccatctgagtgactggggtgtgtgtgagtgtgcgccgcaatagaatggtgtcctaaccagggcaggttcccaccttgcaccctgagctgtagggagtggctcaaggcctggccaccagaaaagcagtaagccggttagaaaatgaatgaatgcatgaatacaaagtattgtaaaataaaaattcatgtagtctacgataattacacaaatgcacaaaaataaaccgggtggaatgaaggtgcccagtgagcccaccctatttctcctttggttttgaaacctgtggtgggagaaggtgctccttacaatttccactttgcaaacatttactcctttaacccactgctgctacaactgccattactcctgattcgccaaaaattggggaaataattctgtttttagtcatctttatcaaacgtatgtatagctcaaacctatttctgtgtttaacatttgaagtgtttggggtctttatttagaagtttggtgatgtttttgtgagcacaattatgctgcaggaatttaactcttatttatttatttattgagacaaagttttgcttttgttacccaggctgccgtgcaatggcaggacctcagctcactgcaacctccacctcctgggttcaagcaattctcctgcctcagcctcccgagtacctgggattacaggcatgtgccaccacacccggataattttttgtatttttaggagagacagggtttcaccatgttggccaggctggtcttgaactcctgacctcaggtgatccacccttctcggcctcccaaagtgctgagattacaggcatgagccaccacacccgactttaactcttatttatatgaattaaacaatagtaaaagtgatttcattgtacatcatttcacaaatgcaaaaagttgcatttttcaagaacctgtcaacaatgttaagtgagggcttactgtacaatcaaaatagcagaaaaccagaagagtctttgaggataacaattaaccctgaaggttgggaaggatgtgatcacgtactagtctaaaccacatcaggagtaatcagaacagaatgtgaggccgacttgaaagcatctcccaacctcacactgaccttgacgggcagaagactcacttgtacaaggtgcttgcatttaacttctgacaaaacactgaacaataatcaactttaacccaggggtgtcttataggaaaccaggcctaaaaataaagtcacactcatccctgacagtctagaaaactgcctgcccccctaaagctgtgtccattcaagtgattgttatgaactgagctgccaggtgttggagttgtggattaataccataagtctaagtaaaagtaatgattacgcctttattcatccactgctatggtgctagcaagaggccagaaagaaggtgccagctcccacagtgttccattcttcaacatgaaacaacactcgacgaaagtgagacattatcagcatatatggctggaatggtgtcactgctgaaggagtcttgtacaaaagccttctgtccttttgtgaatccaggggtcaagaagcagggattggggaagtggctaggagaggaaaagttctaagtactgaatcagagtggagaaagtgtcttcaaggttttcctcctccctctgataagggcgtctctacagaggcacctggagatgggcacccaataaatagtgctctgaatgaagcagctgggataggtatgcacaggtgcacaagaacacagctgactggggtcctgagtcctgatggcgcctccccttagagactgtgatgtgctggctgtgcaccaagcttagtatggggagggccacttccccccatgcagcctccaaggtaaagccttttgattccctatccgtggaacttaacaaccacatataggtttttggctacaagctggacttctcagtagtcagagaaccatcaagctactagctactgatccttgatgacaggtggggcaaaaagtatatgcgcttggaaccgtgatagcaccagggcctccaagacatacatccaaccgcaaaggataaaaatccaacttgctaatagggctccagcacaagctttcaccaataagtggaatgtgataactcaggggtgatccctgagttacctggatccctaagaggtaaaaacaaatggaaaaaaaaaatctgagcagcaacatgtttgagaagccacataccacggggaaaatagactttgcagaactagttcagccaaatcattaatcaaataagcaagtgactaagcagaagaaacactgagtgagtgaggggtaatcagatttgctgcaatgtattattttaaatgtttaattaaaacaattatgagatatgcgaaaacaggaaattgtgactcatgcgcaagaaaaaaatcaggcaataaaagctgccattgatgggtcccattggtgagcttagcagacaaagactttaaagtagcagctaattatgaatatgttcaaaacagttcaaagaacgaaaagagccataattgaaagagtaaaggaagtctaatgacaatgtctcatcaaatgcagaatatttgtaaacaatacaaattattaaaaagagccaaatggaaattctagagtggaaaatacaataaacagatatgaaaacttcagtagatgggctgtacatagatttgggtacacagatgaaagaatcaatgaacttgtaaatcaatccatgccaatcatataatctaaagaagacagagaagaaaaaactatgaaggaaaatgaacagaatatcgaagacgtgtgacagaacattaattacacaaatatacatttaatgagcgttaccaaaaggagaaaataaaaatagacagaaaaaatattgaagaaatagtggttgaaaacaaaggagcacatatgacagtcacatttatgggcccttgggaattgtaaatttcaattgggatgagttagtattgttgtgtgttattctccagccactttcagatacatggttccagttatgggatggagaaaaagcttgtttaaaccaggggtgaggctgtgccaagcaagcaggaaaatgtgaggagcaagggaagaaagggggtatagtatacaagagtgattgtaatgggccatggaaattggtaaggagaggatttctagatcatcaagccagtgaggaactgggaaaggtgatagtatcagtgaattggaagtcttcatgtgccacgtagatttgaggtgcctatcaatgagaggtattcattttattgttatatgtagatcacatagtcacagttctctgcagacattgcagttattggtcgtgacaagatctggggtttgctcttggaaggagtgactaaggtagatatcattagaacggaataatttagggagctaagaatatcgggtgttggaaaaatcatgtatatgtatacagacattgccatgagtcagatgttttaattgatagggtaggagtgaatcaggaaccaaaacttttgaagaatacatgtgaatgatcctagatgtgagtagctgacagcagtagtttcctttccagcagatgactgttgaatcttatagggtacatatgcaatttgaatccgataacttcatgttctctttttcttcattctgtgtgcttaaaatttgacttcttcttctggaataattatcagtgcataacaaaatgtgtcccctttgacttgaaccatggagagttgacagttatgtttagttcaatcccctttgctctcataagctccccaggtcctggcgttattcttcttagttctaccctgtacaacgtttcctgtaccagaaaatctatactttgtcacctattcttaacctgtatttgtatttccatcctgaatcattttagtgaccactagccaaagtatttaaccacatacaacagactattcttcataagaatacatctttttttaaggagtaaaactaacccacaggttaagtaaaatggttatgtaaataaggccctaagctgagcttctagaaacagccctgtactgagcagaactggactgccacacagcagctgcctctacatggattggggagccatagaatcagaagatgtcatcataggtgatgtctcaaaaactagtcaggatgttgtttaatctgaatgctggacagttgcctctgccaaagctaacgtatgtgttttactttgccaaatgacttggttctgaatagggatcttgcactacgatatctgattggcaaaacataaaaccgggcagcaagtgttctaggaattgtagttttttctgtctggctctggcatgccagaaagctgttagggtggatgttgagagtattacaccttatcaaccagcttttaatataatttgaaatatagtaagatgtttaaatgcactaacaaaatttgatcataccaaagacataacccatccagatgttgatgtattaattcctagtattttcctaagagagtttttaatagaaatttttctttgaatatgcctacttctggcaaaaaattaaaaccctggctttgtccaactttaaaaggttggtgaaaataattttatcatgatcactatcattagtgtatttatttggttaattaagcaccccatcttattctaaataggttcatatttctgaacctatttggaaatatatagcaagtcagagtgagaagaaataatctgctttattatagatgcatagttggtttagaaaatatagcttggatttcaaacaaactattcttgactttctttttccctccatagaacttgtaccccccaaaactgctaacagagcagttgaatgactgaatacttccctgcataaaatttagcccgttctgtttggtttacggtacggaaaaggcaagattcaagagtaaaatgtgtcgtgcttacaggcaagcaatttccaagacagagaatcaatgtgggtatatagaaggagaaagagaagcaatatatgaacctgtaagtttaggacattaaccctgaccatgagcaaatagatgtcagactcattatatcactatcacatcactcctaccaaggaagaagctaaacagtggtaaggagaagggagtaacttcattcctaaactttccctgggatattttatgggcttgctgaacacttggagagggagaggatgatttatcacactgtcatcaccaccacccccgtcatgatcatgattgtcaccatcaccatgggccacaaacatcgtcatttcaaacacttgtagagctgtctactatacatagaccactttcatggtacttaagatgcaaatgattttaaaaatgaaaaactgaggaggatttataattaatgtcactagagaagatgtattgttggaaagaataaagtttcaggaggggccaggaagtgatacaggagaactatggcaactgagataataaaagaaggcttcacggaggtagatcctatttgggtcttgggataaatattgatgctcagggtatattcctagtgcagatatgggggatgagaaaaattataatttgcctcattccagaggctatgaatattcagtttaaaatttcaccaatgcctgaaaccccgtctctactaaaaatacaaaataattagccgagcgtggcagcaggagcctgtagtccaagctactcaggaggctgaggcaggagaatggcttgaacccgggaggcggcagttgcagtgacccaagatcgcaccaccgcactccacactccagactgggcaacagagtgagactatatcaaacagaaaaaaaaaaattcactaatgtctcaagaaataagattgatcttttatgaaagaaaaatcacaattacctatctatgagtataacagtaggtgattacatttcctgaagtctcttctttaaatttagttttctttataccattgtgttcttctaaaaatatttcatcaatctattacaagttcaagaaagaacttttgtttgaaatgaatgtcatcttgtttttatattctccaagcaaactcctccatccaaagtccttacactgaatgtttttcttcctcatgttatattttgaaaactcagaagcatgttaggagtttcaattggatactatatgaagttttataattctaggcagtcctgaggatcaaaagaagattattccaccaaaggaaacaaatgttcttgtttctagttgggtcttctttcaagcgaataccgatttccaggaagaaaactcatttttatttcactctccccgccaaaacttttatcttcttactttggtaaagagtgcttccattattctgctgattagtcacacagttctatatcttattaaaaaatcctacaaatgtaaagaggttctgcttctcaagtatttgtaaataaaccatagagttaatgaagatagaattttacatcattggaaagaaaggacaaaaacacacttgtatcttacctctgagcagcaaatgacagcatgcagacttctgtctttataatgcattcgtgtatattttcgcagggattattttcttaaatgcctatatgataccattgaatgttttaaaatcactaatgttttaataaaatatttacaagtaatattcaaaagcacttttggggtctattcttgcctcattaaatgcagtagatttaagtgatttcacagaatttatttttcctccctagcacagagaattcaattttcaaataagaacacatagtgataccatagatgtgtgcaatatttcctcttgcctcttaccttttcttttgtctgtttagggaccctggtttgatatgaatccagaatgaagggaaagaaaagaaacccatactagtgactacatttacggcaagatggtttagatcatccctgatcattttttttataacaaaatagattgcaaaaacaacattaattaaatcatcttagatctgaattctcagttggatggcatgaaaacatagaccaacaccaaggagatgggttccagtaatgaaaaatgtacccagaatattaatgacaaatgtcttcctccatcaaattttttctcattcctattgactttctttttaaactatatatatatatttttttttccttatttctatgatcatccagtgagccttgtatctcccatatattctgacacataatgtgattacttttatcattattattattatcacagttacttctaacctttataaatccagcaagtcaatgaagggcgtgtattgcatatataggtattattttgcagtagttttattttaaaccctctaactcatatttaaactagtaagtttagtttctagttaatatttgttcagcaaacattaagaaatgacgtatttcctgtaatcccagaactttgggaggccaaggcaggcggatcatgaggtcaggagatcgagaccatcctggctaacatggtgaaactctgtctctactaaaaaaaaaaaaaaaaaaaaagaaaatacaaaaatttagccgggcgtggtggcatgcacctgtaatctcagcttctagggaggctaaggcagtagaatcgcttgaacctggaaggcagaggttggagtgagccgagatcatgccactgcactccagcctaggcaacagagcaagactccatctcaaaagaaaaaaaaagcggtattacattaattatttggaatataatagttcaacttatattctagaaacacagttgtatatagtgaaaaccttagacgatagataacattatactacaaaaataaagacatggagccaaataatcaaggttcagccttcttctcatatgtattgtttaaataataaaactcatctgacagatttgtggtaattactgaattatatgtaatatcattttcatattacaaataatagtgtatgttattcatacaacgttgtaacatatattatatgtaattatataaatttattttatattacatatattttattaactttgtattcaaaattgagatttgactatgctgtgttacaattcttaggtatttataacaatcttttgatacatcccaccaaacactgcagaggaactaaaatgaaaacaggttggagggcagagttttatggtgagaacacagaaagtcagccaggagggtgaagaggcttcttctgtgctaggattgtctccaggaacatctctgcaggaagccaacacatctatcgctaatatattttgtgtaagttttaaaaactcatagtgttcacttttacatggcagagtttctgttcaatacactgacttctatgattcttataccagtcatccatgaactttccagtgttgactctttaaacatttgatttcacaatattaatatattgcctgaacaaatgttcagaaatttttaaatgtgttttatcagattgtctttcatatatgacaccgagcagtcacaatggttttttctcaatttcatgaagttgaccaatggcttgtttataatgttgaccaaaaaataatcaaaaattccctatgtattgctggtccttaacagtttttccttaacaagaagacacaacaactcattgttagaataatcatgatttcagttgaaacatggcttatttggaacagatttattttaatatgagtaagataaattttctatctgtctttctcttagcatgtcaaattaaaaaggccatatggattttaagtaaatttggacagaaattttggtatagtctaaaataaatgagtcacagaaaagtcacggagggatagcttattaataatcaatgacttcaagagcaactaaaaatgaacattgattttcacctaacttgacagagtataattgggataatctgatcaaaactatatacctaatacatagctgattaaatatatctaaattagtaactccttgttattctacccaagtcattttctgtttaaatggctttatttttgcccttagtacatatcactatctgaccttatatagtttttaactttccttgaatccccaaagtcaggaacagagcctaatatttaatatgcattagatcaacctttgtcgaatgaataaatacagggagacagtaaaacaggcattggtaaaaatctgagctccagataaaaagacaccaggaaagcagaaattatagatgtttatgtaccattgagcttctttgcatattatcaattctgcttagcttttttcttggggaattattcatattgatgattaattgttcctttacaataggcagggtgggaaagatactctaaaatgcatcagactattagtattatgcaaattaatattttataatgttgtaaccatttaactgtctctgcgcctattgaatatagcagaaattataatttgggatgctagatgaaattagattgcaatgttaactaacttaattgtagtatgaccaaaacatgcataaaatggcagccagactctattttttatgatgaaagcgaagaggaaatgaagaaatctaaaaatgagattttttttagccacaaaatagtatgtctagaaaaatttaaaagaaaattcaaaagtagcttgcatttttgatacaaattgtctaggataagctctaagtggaaaggagaaaaagctggctctgaaactctttgtaagcagaaaacttgtcttcctggatcatggaaaatgatagaaaaaatacaaaagatatttaaataatgaaataactaagaaagaaacacaggatacccaatgaagacatgattctaagaggaaatgaggagagtgtactcatatgttcatatttacaatctttctgatttcttagcacatggtacatcattccaatgattaagtagagttcatcctcatgatattcagagattgttttaggtaaaacatatttgaattgtaacaacatatgtaattttgttttgttttgtcttgggataagacattttaaagcctagctcttctctatattttttttaaaaaaagcaataaggaatagcatatccagacaatttcagaccttacctatcaaagggtggctttcactgagtggttatatggggattatctacttttggaggaatgtaatacagacacatattttgataagaggcaacaggaaggagaaatcttgaatctgaacatgcaaaaagatgttgagatttgtttgagatcagtgccaagtccctgagtccagtaggcagaatgagagtattaatgtgtctggagacagcagtgggaagacaggagcaaagataaactattttaccatataatctgtaaagaataagacatttcacataaacaatttttacaatgtgtaatttgaaacctcaaacaggtgtttttcctgaagtgtaaatttgagtctgtataatagaatttgatcacttcttcacaaattggggcatcatttttcaatctgctttttacaaaccccagtgttccaaaagatattaatagatcaccctaagaaaacatagcttcaaggtgaaatggcttgaagaaatattgcacatgccgtttttctcttggagtatagcaatgcttaattggactctctgaagtatggcagaaaggaaatttgctgcactttatttaacttaatattttaaaaatacatttgataataaacctcattttttgtggaagccattttggaagatattaattttataaggagtacagtttgagagatgactttaaaagcatcataattaataattgcctatgtagtgcctcccaaactttattacacatatgactctttcagggaaccagctaaaatgcatattcagattcagtgtttgtctgaggaagagaggagagactgcatttcatttttttctttttttttttttttttttttgagacggagtctcgctctgtcaccaggctggagtgcagtggcaccatctcggctcactgcaatctctgcctcccgggttcaagtgattctcctgcctcagcctcctgagtagctggaactacaggcgcacaccaccacgcccagctaatttttgtatttctagtagaggcagggtttcaccatcttggccaggatggtctcgatctcttgaccttgtgatccatctgcctcagcctcccaaagtgccgggattacaggcatgagctactgcacccggacgagactgcatttctaaccagttgccatgtgatgcataggctgctggtccagaacccacaccttgagctgaccagctctgtttctttttgactcgtcagtatcacagagattattgagatttaaatagatatacattttgaccttagtggcttcagctgtttaggctgatagtgtgaaacacatcattagagtggaaatctacttcagctttgcctggcatcaggataacaaagtgaaggtaagacaaaagccagagcccctctcatataaaaattaacaagagtgagagaagaagaatctgttccacaactttctggaccaccctctagaccagacatatgaaggggtcagatgtggaaagagaacattgatggcaggactctttttttagagagctgatgcataagtccctagtttttatttgaggtaggagtgagggaatgcttttatagttccaaacctagtgagagcaaataaagtgcaaatgatcaattttgaaatatattccctgagggtgagagacacagagggcttgtgccacattcattcttgggaacactaaaacagaatgtgtattaggtctgatccatgcttggacttatgcataagtgacatcccattaaaattggcctgcactcctgaaatctaatagtgttagagatatgtgagtatctcccatagacctgtcatggaatgcatgggagagaaaagcaaacaagactgctttgggttatgtccactaaggttgcctgtagtgtgcccggggttggttccttctggtgggttcttggtctcaccgacttcaagaatgaagccatggaccttcgcagtgagtgttacagctcttaaaggtggcacagacccaaagagtgagcagcggcaagatttattgtgaagagcgaaagaacaaagtgtccacagcgtggaagggaacccgagcgggttgctgccactggctagggtggccagcttttatttccttatttgtccccgcccatgtcctgctggttggtccattttacagagcactgattggtccattttacagagtgttgattggttcatttacaatcctttagctaggcacagagtgctgattggtgagtttttacagagtgctgattggtgcatttacaatcctttagctagacacagagtgctgattggtgagtttttataatcttccagctagacagaaaagttttccaagtccccacttgagccaggaagtccagctggcttcacctctcagtaggacagagacatcagtagaaagagccaagttatacagcaagagattctcagaggtgaggaagttgcaaaggacaccccaaagggacacagatggctctacctgagtcaagggaactgtaggaagaaagagccctgtaggaaccctcaagggtcccgaaaagcaaaagataccaccttctctcctaaacacccctcctaggtttccagcttaaagcaggtctggaagaggaaacagaattttactgtaaatcatgtttgttcgtttttattatgatgatcttggactggacaaccggtttctgagtttaaatttaaactgtacttaaatttaaacttgtacttaaaatgactgtaggactcaattacctaaaactcaacacagaagctgtggttgtttcccagtccattcaggaacatgtgaaaatgaggcctgctgaataaagtttcaattcaggaatggtggaagagggaactaagttatattttgcttatgttaggcgtcaggcatgttcagcacatcagtcacagaagattcatacatatcagttatctcccaccgacgtcaaagttgacctctctctgtgaccagtgtctgtgctcttcacctttcgtctgctgtttctagtcagcagagggtctgagcacaaacgtttgggcccatgaaggtactgagccgaggcaagaactcttctcccttgcataaaacgttggaatttcaacccagagaatttatctttgtctgcaagattttttatttctttttttctctctcttccgttttagattttggtttgggtcgtctttctttctcttcctatatttgttttttgaaatgttacttagattgtttttattattattttgaaaattttatatacagatatatgaaaatatgtacaaaatacattgctatacgttaatgtatagcaataaagaagttgtatattactttgatatgtgttcattgccttatggaattaaaaaatagatttcatggccgggcgcggtggtttacacctgtaatccagcactttgggaggccgaggtgggcggatcacctgaggtcaggagattgagaccagcctggccaacatggtgaaaccccgtctctactaaaaatacaaaaaaattagccggttgtggtgggaggcgcctgtaatcccagctcctcgggaggctgagacaggagaatcacttgaacccgggaggcagaggttgcgatgagctgagatcgcgccactgcactccagcctgggcaagaagagtgaaattccatttcaaataaataaataaataaataaataaataaataaataaataagatttcacttatagaggcaggaatggagaagacaatataatagacatcttaaatataataaattactttggaggggtgtgtgtgtgtgtgtgtgtgtgtgtgtgtgtgtgtaggctcaaatgctgaatgaattctgactttgtttattaagcacacacacacacaaaataaacagagatacaggacaaagacatacttttgattcttctaaaaaaaagttatattcttgtttttcatagcctgacaaaagacaaggcagcttttgtctctgaaactctcacttcttcatgacttgaaatagtgtgcattctttctgattacccttaatatcagcaagcatttattgatcatttactgtgaatcagaaattgttctgagtattttatgtatattaatttacttagaactcatgcctcccaaatttctgatgcaggcattcttaaatgcaatttatatgaataaaatgaagcttacaggatgtcaatgagcccaagttataacccacattatagagactagtgaaaccagactttgaacccagtgagttacacaacaagacctgcacacttgacaaagtagaatataaatatttgctatctgcaaggagttgacattgtctgacaagtgaaatataatttttgtgaggctgtttttctctatttgcagtactattgcaaagatcatgctgcagttcttcccttgccagttatttacagtactgctatttaacatcacctcaatagataacattgaactatacaaaatccccaggattaaaggaaaatatgctttgactttatttctaattctttttggagaataaaaatgtgaactattctgagttttatgggtatcccatatatgtacataaagttaattttctgtctcaagagtaacagagatataaaaaggccaatcacaattttatgaataggaaatataagatctggggatttgatttctctattgttgtattctaaataacagcactatttctagggaatacttacatccttcctgacacagaacaactagcaactttcattagagaaaagtcaaaccagatgcagtgtgagtccctatatgttgcaagtaatgttaaaatagattccaaactggtgtcttgttttgatgaaaactctgaagacaatttggaggctgtttgtcagactctagagactgaggcacagatggagttctgaattaagtgactttgtattttgagatttgaaatgagctctagtcccaattgtatatttcagtgattatgggctaattggatgtggtaattgattattaaaggatttatactcttaaatgtttaaggtttattaattataaattcaaaattgctaacaaaattcaagatgtaaactttatcaatttatgtagaattgtgtgaaccatgttttgctttgtttggtaacacaatatttttcttttgaggattttctataaagccaaatagaagtccttgagatctcaaaagtttaaatattttaacttttctaatatgtaaagcaacaacatttactgcctattttccaatcataccaaacaattttgagttgaaatgcttgtttccttcccataggggaagaaccctgaatttataaactaaacaccttgcatgtcttttgcataaattaagataaagtaagcatatttaatttatcattgggtgtttgtgtatatttctaaaatcttaaagtagattaaataatatgcttcagaaaggaattatgtatctgtgatgcatcattttcaaagcatcgtttgcatgacttcaatcaatattattactttaaaatcagagcatttctgaatcccagatgcaatagtttaatagcattattgtagttcactgtttttactgtaccattagtttaaatttttttctaaatgatttattgatttatgttagctatcattaaaaataatcataaacttcttttaaatgtttaatagtttgtttcctattgctcccatacccaactactataaatttagtggcttaatatattatcttatagttctgcgggtcagaagtctgaaatggatcttatggggctaaaatgaaaggttgtcttccttctgtaggctccagaatctcttccctgccttattcagctgctagcaactgcctgctttcctcggctcctgacctcatcattcagaactctgtttccatcatctcaaccccttctcttttatacttttgcatttttctttcatttattaagacctccgggattacactgggctcaccctgataatccaggttaatctcctcatctcaaaatccttaatttaatcacaaccacaaagtcccttttgccatgtgaggtaacatactcacaggttttggagatttgaatgtgaaaatctttgggggagggggagcatgactctgtttaccacaatcgtgtttctttttccatttatatcatttgtagtataaatttttacctgtatatttggaagaaaatattctgtaccaagggtaatgagaattaatattttcttcaatgtcttttttctgtaactacatcacactaacatattttttaaatgggaaataaaaggtggtgatccaatgccatacaaattaaattggaataactcagtgtgtacattttgggttgtttgtttttgtttgcttatttctttgtttcatttttataggtttatatagttgtcaagacataaaggaaagcaatataatatgctacattatttttctgaaataatgacactgttatcaagttcatatcctctctccaacccagataaggaggaaaatatcaattcaaatatcataaaacagtctctagtttgattaacctcagttacctaatagaaacagatgcttttgctaaataccctgtaaagacctcttactccctcctgtaattgattaaaaattgaccatgaattctttcccatgcctctcattgagaggtggggtccattgccccttccctggaatctggactggctttatgactggctttttcaaataaaatggagtgcaatagaaatgatgccaattgattccatatctggatggcaatagatttgtgacttcctctttctccctcatagaagccatctaccatgtaagaagtccaattcttttgacagctccaggaagagaggaagctcaaggtagccaaactgagagaggccatatgaagtgacagaaatgtggaaaacaaaaaaacaaaaaacaaaaaacaaacaaaaaacacaaagacttcttaaagcttccagcctaaaacagaccggaatgccagaataccaaatccagctaagccttgcccaaattcctaacctgcagaatcaagaaaaactaaaatggttgttgtttaaaacccctaagttcaggggtaacttgttactcagcagtagataagcaaatactctttctctctttagtacattgaatttagtaatgtgctccaagcctcttgcttttttgtgatgcatccagaagtaggtttcaattttttttaatctattttgaaatgtcaatatgatacagcatctccctatggcacagggctatttctgtatctagacatgtatctcatcatagcctgctgaaagctctaagttggtttgtttaacatggatccagaatgatggtataatggtttgaattttattttttatctggaggctaatagtacccttacaagatatgaaatatggttgaagacttacagctcccaataacaaccttcgtatttttaaaacaaattttgtactctttatatctaacctgtaaagcagattgttttattggggtacagaggaaaagagaaaaaaaaaagcattgtatagctgtctcattcctttcctacacctctgaagttgcaggttagttctggacggaggcctgtagtctcataggtccttttgagaggggaaaatggcagacataattgaatgggatctcattgactccatcccagtcttctgactatgaattccagagacacatgaagaagattgaatctcagttgagtcctctgggatgattagaagacaaccactgttgtggttccaacagctaaattaacagagggtctttagattttttaaaaaatatatttttaatttttatttttttgtagagatggtctcactgtgttgcccatgctggtcttgaatttctagtctcaagcgatccacttgccttggcctcccgtagtggtggaattagaagtgtaagccactgtgtgtggccagaattttttaaaatcaataaactttattttagtagcatttttagtttgagagcaaaattgtgtggaacatacagagagtttccatacagcccatccctgcacatgcacaaccttgctcactatcaacatcccacaccagagtggtacattttttaaccaacatttacattttaaatctacgttgactcactgttatcactcaaagtctgtagtttacattagaattgggtatttatttacttatttatttatttttttgagatggagtgtggtggtgcgatcttagctcactgcaaccaccacctcctcggttcaagcaattctccctgcctcagcctcccatgtagctgggattacaggtgcccgccaccacagccagctaatttttgaatttttagtagagatggggttttgccaggttgcccaagctggtcttgagctcctgacctcaggtgatccaccctcctcagcctcccaaagtgctgggattactggcgtgaaccaccgcccttggccagaattgggtctttagatttatttccttacacaaagattggagcaaatgttaaggtctttcatcccaattagacaaccattgactctgagcctttgcaattgttttgcgctgtatcatggttttctaattatcttacctctcttcatttttgctcataaaaaacttgaattaccttgctctgttctcataaaactgtacattttatctaagaagacttgaccattaggatatgtggttgttactgaactgtactgtatactgctttttcctgtgcagatttagggagtaatcacagaggggttatttattacttggctgtagctgctcagaatatgttcatatctatatcatcttaaaatgtcttagatgagaagaccacaaatagtctcaacaatgcagcacacatctggagggtaattacccattatatagaagtaacaaaatttctcaaacaaatttgcacaaataaacaaaaagattcagagtcattgcagaaagatcatcagtgctgttagcacttggccaagaaatagatattcattgttgaatatcaatgaatatatatcagtatcaatcctgctgcccaaaggcaaccattatttatgttaaagacatacatatagccatctcttcttatatatacctataccctagaattattttatataaaatagaatatactagatatgcttttgtgtataatcttttaaattcactcaatagtatattattgagatctttccatgtcaatacctgatgtcatttataatgacggtaggatagttttcctttataagtatgtacctttatttagccaagattgacttttaagatgtttccatatttcattactataaatagtatttagaaaacttcatcctaattgtgatttgtttaccactgcagccagatataaaatacgttttcttagctgggagactcacttttgcatagaggtataagtataagtatatttttaggtgaagttcacataagttaaccatcctttccttggggttgcgctgctgtccaacgagtgcataatgagggctgtactgctaatgcctacgtaacatgcccacatcaactagaggtttgctttacgttggtgcaattattttaaaaaataaaaaaaaaacactttaaaaaatatttttaaagttcacttaagttgctcattttataaaatggagtttttcatatttatgttggatttcattactttattaatattataaatacatttgatatagagtgctgatatgatttttttcaggtctaatgtgtattcttcatttttgttatttattgctctttaaaagcatcaaagtcctatacaaagaagcttgcggtagtataatgagaaaatgggtggaaattatgtagatataaatacatgaattattgattaaaatgtagttattgtagtaatagtagatgccttttgtattgaatataattcattctacctttgaaatttgaaatacaaattaaaaatattttaacttatccaaaaattatttcatttatttttcctcatataaccatatacagtacaaaaatgaaggactttttaaaattcgatttcccattatttcacctttttgcctcttgataatctaagaggaatctcagagaaacgtatgttggtattcttctaaaatctctttaagcataagttaattagggctctcatcaacagcaaaacaagatatagaattctcagagttctttcttacttgataatgacacagaaaacagaagacatatatcaaaataacttgctaatacggctatgaaatagctatccaggatagtaggtctatgtagttttattgtgaatgaacggaagtcattcacctttatatcgaataaaaaggtgaagtgtaattacatacaatgcttgtcaaattgctgttgtcaattttgaaaaaggaattacaattgagaatagaaattattaaagaaaacagaaagagatatcattaccttaatacagcctaagttgtcaccaaccctacttaattattcagcatattctgaaaacctttaggaaatccatcatgtttagcctgttctttgcagctatccgtaggcaatagaagcaaaccacaaacttgaggctacttgtgtttaaattctaagacaatgactgcaaaacattaaagacacatcagttcctccccaggaattacttttggatttggagtatggtggtttgtatagacccctctttgtaacctgggtgctgttagataatacatagcactttattgttaatagaaaatggcagaacctattgctttagggataggttttctcttggaaatgagtggcaaatcacaattacataaaccaagagatgatataacgtatctataggttgcataataataatcatggcaagagaaacctattgcatttgcaagattagagctaattggttttgcagagtgcaataaatcagttttgaaaatgccaagtcaaatcaggtgtgctatgctattaactaatatgtggtttacaacaaaactagaaattgagttatagaatttgttttagacagctttatttgcaaagcacgtgaaaatgctaagaaatttagtgcatttacataggcagccatcttattcagtgataggaaagaagaattcaaacagtatgaaaaagtaatgccgtttctattttatgggaacgaaattattgaaatcaagttttaaaagttaataataattcccataagggattatactttaaatattatctagaaatattaaatagaaacataatttactcatgggcatgcagtatattctgctgtaaatggactctatgaacacagaacagtcatgctgtcttggggaatggaagacattggctgtgtccatgaagatatgtttgttccctgaagtttcatttttctatagctatctcttaggatccattactaaaactgaaagaatgagccagcaaataagtctgtgggcctcatccatttccatttatttccatattttgatatgctgcatatttaataaggaaaaaagtttttcttaagaaaataaaactgtaggctataagatctttttcatccctactattctattttgctaagaatagcaataatttaccactctgtttaactaacatgttttcaagtaatgacatccattaaacaatgcttgttttcttgttaagaaaatatagactttccaagctttcttatttttaaaagatcaagtaatgatgtcaaagaaagaaaaagattaaggtgattaggaaaggaaccactattaattttgcttgatttttttggggggaattagactgtcatcattccatatgtcattttgttattagctaataactactgattatataactattgataaggtgataaaggatagattttcatctataaaagacatattaatatactttatataaattatttagattgcttcctaagaaatactgttcttacattcatttgcattggtttattctgtttccaagtttatatttggttacttaaagctaacattgtgagattttccaaacactgctaaaaataaatcagagtgtttcctttacacaaagtttggctattagtggatgttgtcatcttttatgtagtaacaagaaattttcctaatctcgtaaaatagctactactatagaaagttcaagttttattctaatgaaactattattatctaagatatttcccttgaatttgacatgtgtatctgaacattaattgaatatgcataatggcagtaaatgtgtgggtgaatttggttttgtaaaatagtaaaataaacttttgggtttggggaataatgtggactatctaggtgcatattaatgtttttataatcaggtagtaagtctcaaatgctataatggtttgtgatctaattccgatctcatgttccaaggaaaattaaaatattttccttttattccttattgtttaagaacaatttatatgcagtgtaacattcagcaaacatttattgagcacctagtgggagcccctaattgctggagatacagttatgagtcagatcaaatcactgcccttgaagtttggggaggaagacaagaaaaatgatttttcgtaagggctttttaatatatagatctgcatatgaaggagagatagtaaaagagtggtctgttctactttcagaagcaaatcaggaaagactctgcaggagatatattcttgacttgctcctccttaccaaatggaaagtaacactgacttaaacagaatacaccaaatttgcattgttattcagatcctagcaacctggcaccaacagctaataaaataaaatttcaggttaggtttatgggtgaatatcatgaaaccaagtcccataaatcagataatcatgagattcactgcatttccaagaccagctgggtttacatcattattaataatcatgattaatactcttacttttatttcttactaacttaaaatgtcatggtgaagtattttttgaaatctcagagtataataggtcccactaaggaaaatgacaaactgattgtccaaatcaaaatcactctgggcctactgagaatggtatggtaaggataaaaatgagagtgaaaccttctgagaaagtatttgctcattattaatgaaggaaatatgtattatctactcctaccatgctttgggcccaagaaataaattactgaaaaaataaaccaagagagggttttgaaaattaacactgcagcagatttaaaataaataaataaataagaacttaaagctgaaatttgaaggtgagatcaaaatcaggtggttctcttttgagctataatgagccataaaaaggagttttcctgactagtaagctaaaatgcttaatgatatgacatgaaggagtttcgggtaccataaatgttagcataaaaagtttaatactttagagttcatgtaaaggcattattaatgaaaaatgatgctcttaggaattccatgtattaataaattgcttgaaataaatggcatctataatttttcatttacctgaaagtttttaatgtttttattatttacaagtgacacttttgttcaaattgtgattgttttaggtacataattaaatgaacaaatttggctgagagagagagagagctgccatttttaaaccagaagaagcatgctccagctttggaataaatatagctaagagttctttatcaccatttaatgtctcaaatttctaagtatagggacatagacacaaaggttttacaaaactacttcagcagtgctagagtaaaacatgtagctctatttatagccaaaagtttcactgatgccattttgccacttgtaatatattaggctattaataagaaacttataagatagcctgagatcatttctcactctaaatagtgtttttcaaatgtaagtgcatataagccacctgagagttttaaaaattaccaatatctgggtcgccccctagagtttctgatgtaattggtctggggtacaggctggacatttggatagtgcaaccaaggttgacaagcgctgttacaaagaaacttgaaacaggagaagcttagagattttaaaacctcagaggcggcctggcgcggtggctcacgcctgtaatcccagcactttgggaggcccaagcgggtggatcacaagggcagggtttcgagaccagcctgaccaacatggtgaaaccccatctctactaaaaatacaaaaattagctaggcgtggtgggggggcgcctgtaatcccagctactcaggaggctgaggcaggagaattgcttgaacctgggaggcagaggttgcagtgagccaagatcgcgccattgcactccagcctgggcgacagagcgagactccgtctcaaaaaaaaaaaacaaaacaaaactcagaggcaactgagttgcaataattatgacaaaataaatgatgcatactactcaaagatagaacatatcaggtagagaagatacctagaggagtgtttcttcaaatacgtgtttaccaccgatttaaataatcctttttttatgcagagagcatgaaaacaacaattaaagtaattcctatgaatacaacaatcagcataattctcaataaaaccaattgtattaatcataattttggttctgaaaattttgataatgcagaaagaagctctcagatcagtgttcttaaaaatcaagatagcagtttgagagcacctgaaaggtcagttaaattcgatcaaattctctttgatatgtggctgggatcattcacttttgctctactttttaaaaatgtattaaccaaatagttatgagtctatctatcaagtgttcaaattattttacatgtaatctccaatctccagaaaataaatgagactacaacaaatttaccccaatttctgcagagagcataaataattgctttcaagggatgcttgaatgaaattacttccctgactgcaggggttggggcttggtgaagatttgtcctttgtgagtaatgagaagagtatacttggatataaaaatagtaaagaaataattggttttttaaaaaccctaaattccatgtttagcaaagttaatgagtccctaaattcctaaagctgaatattagtgtgtaaatgagtactctaaaccaatagagaattaacttaaaattcatggctatttagctaaaacttcatatgttcttatcattctgtgtctcctagttttagatcgaacggatgttttgactcctaaaagactcaaaatttctgacaatgccctttattaataagttgcattttgaaaaatcatttaagcaaaaattaaatttacattttcaaaattgcatgttaggttaatttaccaaatcctttatctattttgtgtttccagtcatccagttttgtttgtgatatttaaatattcaaaaatatttgttgaaattacaaattttattaattgatttttgaggggactagggtaggttactttttatttaagttccatggtgttttgcatattcaaataattatattgtgaatagcctgaaagacagtagctatatgatcatttgagataatggtaacaatattcaactgttgaaaagatattattttaagtatgagctaaggagattgtactttatgtaactaggagatgattagaaaatctgttttaacagcatgattaaattgggaattctttttttgaagttttgtaaaagggaggcagaagtttaaggaaaaatgttggttaggtaaacttggatagttttagatctattagcgacagaatactcaagctcttgaaaataggaaaagttgctctcctcatgctaaaggacaagggctgccataagctaatcactgtatctttactcagatcctataaagtgatttatacagagaagggattcagtaaatctttactaaatgaattttagatgatggaatggaccattgtggctgaaggagagagtagtgaaaatggggatattaggaaaggaagtagatgatttgctcagattttgttaaattaggttttgatagaacaaacctgaaaaaaaaaaaaagaaaaaaaacagcctgcatgacttcttaaagtcctcagctcttaatagtgttccaatggcaattaactttcacgtgagttttgaagggaacattaaaaccatagcaaagcgcacattatattcgttgtttctgtgtagtgctgcttctttaccaggcaaataaatcctggtagacgtgcaagagcttgctcctaatacaaaataaacaaaatgtgttttactgagaaaattgcagacatatcaaagggtaatttgacagcaagggtatagaatactatcaagatattttcttctattttacatacatgtgtaattcttgcttgaatgcaagagggctgaataccagccttatttaatatattttgtgtcaacttctgtatacagattttttttcttgaggtgagaggagaggaaagaggagaacattaattccagatagctttaagcaaatgttagaaaggtgaacatttataggcttccaaatatcttttggctagctgacatttacaaacactgagctaggtaagctttttcccctagcaatattaaggctgtagccgcaagtaaaggatatatgaagtgaaatatgccattcaaacatagtaaagaagaagactgtttgtaaccactgttgctgaaaatcatgagaacaaagtctttcttgttattttaaacatcctataaaagcattgcaaaagtttatgtagctggttaaaatatttgggactatttgctccgtttccacacctcatgataaggtccaggcatttgttgagagtgaaattgcccatttaaatgaaggaacaatatgttttaaattacttagagtactctgttgaaacttaatgagaacagaaggcagtgttaataagaaaaatagtagttacaaagattgcttaagaatgcaagctgggtaccaactaattgtaattctttaattctggtatgcgtgcaacatcccttgtgtatgcaaacaaaatgtgtatttccaagctgtatgttttaggatcagagaatttcaaccaaatattaaattctcaaatagtatgcaaacaggtgtcaatcatcactttaacatgacagctggaggaaaaaattccaagcaacatgtgtaggtaattgtggttaatatttatctgtacataggaagatatttcagggatgtgtaagtatgcaaataactcttggatttctaattactgtatttatcaagttgtatatgctgtctaaattcagaaatgaaagcaattttaaaatagcatgcatataataaaggcaataatctgcccttctctctgtctctgcctgtgtctccatctcacacatgtatctgtgtatgtgtctatataccctcacttgtgaacatatattcataaccacatgtataaacacacagtataaaagcacatataaggacatataccaaaatattatcagtagttaattttaagacaagcatgatgggtcattttaattttctactttttacatgtctgttttgattgcaactctaaaaataagcctgtattactttgtaaagggaaagggagagagggagagagaaagatttgcctgttttggaaaatttttttaaaggaacaccacaggaaattagatcattcttaggtgcctgctgtttatatctaaaatggttttcaataatgggatagttctaatatcagtagagatatccattatcacatgtagattgaaccttgttgttgcaggatagaaatatttaaaactgtttaactgacttgaagaattgttcaagtttggaaaatatattcaaaaagaaaaactttccagttaattttatgaaattaacaaaatattgattctaaatgatatatttataaaattttattttataattgggtattggtagtgtaaggaaataaaatagacttttatgtgctcatattgtaaccggtgatcctgatagctatatttagttattagttctaatattttagtttagattttctacgtatgcaataatgtcattagcaaataatgaccagtgtagttctttcttgctaattcttacaaaaagtaagaattctcttacagttcttattgaactgactagagaatcttgtttctgatcccctaaggaaagctttccatatttccttattaattataatatttttgtaagattttatgattatctttcatcagattaaatattccattctattcctagtttgcatattaaaaaatattttctgtatccattgagataagattttctttcatattgttaatatagttaattacaataattgattttgtgatattaaaataatatttcattattgaaaaaacttaatttgtttttaatttattgtactttttaaaattaaggtataattcatacaacataatatttgtccttaaaaaggatgcaactcagtgcacaatataatattataagcataatataatataatatttcttttgttgcttgtaatttggtgtcatatctaagaaaccattgtttaatctaaggtcatgaagattttgcttacgttttcttctataagctttttacttctagatcttacatttaggttttcatcaactttgtgtgtaacataaggtcagaatccaacttcgtttatttgtatgcatatgtacagttgtcccaacactatttgttgataagactactatttccctattgaattttcttggcatcctttcaaaaatcaattgcttataaatatgaggtttatttattgatgctcaatattatttcattaaatttatatgtctatctctatgctaaaacaaacaacactgaattaatatagtttgatagaaaattttctgtttcaagattatttagactgttttgggtactttattatattagtttcctattgctgatgtaacatcttactataaagttatgcctaaaaatatcacagctttattatcataatgtgtgcgtgcatgtgtgtgtgtgtgtgtgtgtgtgtgtgtgtgtgtgtgtattccttgggattttctatatgcataaatatttctccatatacatctatatacaaatgctttatacctcatggcatctccatatagagatagttatatttctttctttttaatcttgaccccaggctaatatccagttgaataaaaggtggtactactattgaacatgccatagaatattaactttgtaaactgacttggagtctccctgggtgaattctaaccctctcatatataataatggcttcatttacaaaatgtataagatcatgactatcaaattatttcttcagccttgacttttatccagaactgccaaatctggatagaattcccatttaggattcccacaggcatgttcaaaatagtactttcttttgcccgtgagattctgccttatgtcttgaatttatactctaagtaaatgttgcaagcagaataaaagcccccaaagatggtcatgctttaatccttgagacctgaatatgctgtattacctgacaaaagagactttgtagttggaatcatgaatcatattaaaaggaggactgtatatgagcccaatctaatcactatgagcccttaaaagctgagaccatgctccagttgatttctgagagatggggcaggagggaaaggcagagatatttgaaatgttagcgctgctggagagggccacaaataaagcatgagaaggaacagagacagtctctaggagcaaaggctggccccagctgacagccagcaaggaaatggggactgcgatactacctacacaaggaactaagtgtggctaacaatctgaataaacttggaagcagacctttcctcagagcctccaataaaaaatgcaagagtgatggagtcattgcattactacctgaatacaacacactttacaagctacataaacttcatgctttcctctttttataaaagtcatctcctctgccgtgaaaactctccccattgttattaatctgcccgaaaatttatcttcatcctcaagtgcctactcaaatgttctattaaatgaggtcttcccagatgatcccagataattagcaccactttttaaaattagatttctagatactttcattactgtaatccccttttataggaaatttttgttgttgtatatctccttactaaactaacactttttttatttttgaatctgcatcaattgttgaatacatatagaacacactaaatatatacaagctaatgaagtaacacatgaatgcatctcggaccacttatcttaaaacatccatttttttctttcattctgtcaaatactttttctctgatatcctatacttttgttactattcattgattttatccttctatttatagttattttcttactgaggtgcaataactttctatgtattgtttagtttatcacatatcttgcaaaattttgtctggtttgcatactatctttttattttattgtgaaacacattatagaactttacagatgaaatgaaatctgttggccaggagtggtggctcacgcctgtaatcccagcactttgggaggctgaggcgggcggatcacgaggtcaggagatcaagaccatcctggccaacatggttaaaccctgtctctactaaaaatacaaaaattagccaggcgtggtggcatgcacctgtagtcccaactactcaggaggctgaggcaggagaattgcttgaacctgggaggcagaggctgcggtgaaccaagattgtgccactacaatccaatctgggcaacagagcgagactctgttgaaaaaaaattgtcaattatttttttctgtagtctcctttttaattttttgttacaaatatttattaaaaagtacaattcaaaagttagctggacaatcatatagattcttcttgaattttagtttttgaatacattcttcaagttcagataaactattcatctatattttcttccaaaattttttaaaagcaaaagatctcttgttctataagcaattattttaaggtatacataaaatgggaatctaacttcattttgttccaaatagttaaccagttaccctggttcctgcattatctgctgagtaaacttttcttatccctctaacttgaaataccaaaatatatcattaaaaagtcatttatatgtcaattcttccacttgtgcagccctactttattgtcattccaaaatgatgcttatccttctgctaaatttctttgagtatttctaatatttatccttccagataaaatttaattatttttaatcaaaggccaaaaatacatcattaaatttatatgttttttcaagagaaaagacacaattttttttatccaatgtgcctttaaatctctaacggaaataatatattttattcatatatatataacgaatttattataatatatataaatattatatatgtataaaatgtattattttatacatatatgtatataatgtattattttatacttacatgtgtatattattgtacatgtaaattttatatacataaatatgtatatattatttatatgtattgataggtatttatatccacatatgtatataaaataatacattttattcatatattttatttatatatataaaaatatataattatatataataaattcattttattgaatgaatgattaataaaatgatcattttattaatgaatgaataaaatgtatatataatgaatgaataaaatgtatatataaataaataaaatgtatatataaatatatttattttttaaagaatgtttggctaattttctgctaattttaattttattattattattattttttgagacagattctccctctgttgcccaggctggagtgcagtggtatgatctcggctcactgcaacctctgcctgctaggttcaagggattctcctgcctcaactttccaagtagctgggactacaggcgtgcaccaccatgcccagctaatttttgtatttttagtggagacggggtttcaccatattggccaggctggtctcgaactcctgaccttgtgatccacctacttcagcctccgaagtgctgggattacaggcgtgagccactgtgcctggccactaaatttttttttttttttttttttttatacagagtcttaccctcttgcccaggctggagtgcactggcatgatctcggctcatttcatcccccacctcccatgctcaagtggttctggtgcctcagcctcctgagtagttgagattacaggcatgtgctaccacacccagttaatttttttattttgtagtagaggtggggtttatgttggccaggctggtcttgaattcctgccctgaagcgatctgcccacctgggcctctcaaagtgctgggattacaggcatgaagcaccatgaccaaccaagagttaatgttacttttaaaataaatcaaaagagcaaaaattatctgacataaaccgacaaaagaaaacagcagtctactattaaacttaataaaatttaaggcaaaattattttatttgggattttggatttgcttgtgttttctcatcttacttaaacctacctctttttcatgactgtatttctcaccatcacttttccctctacaagctaactgctctagatttttaaaaggtcatggctcttctgtcttttttagtgtaaaaaaggggaaatttcctaattttcatatttcttgtgttaaattcttttcataagtacattatttttgaattctgaatattttgttaagttagatgattgttcaaaatcagtttgcttattcataactatagaaagatgtagatttaagccctgcttttgcaacagaaaagccagagggccatagcttgtcctagtttctaattgaacccaataagctttctttttctctcaactttatccaggaagcatcattttatatacagatttctgatccagtcttcagggtttccaaggcattaatcaagcatggctttactggacaaatgtagggccttctgtgtctttaatattggactttctatgtcatacagtcagtatctttggtctagttcttcgcagtgttcatatctcactggtttagatataattgcctgctgcaggatgatgactttcctacgtgaatcttcctgagtttcattattgatggtatacgatgtctaccatcaatggtataccatgtataccaagacaaatatttcttcactcttcttgaggtctctgtatactgcttggttcaaataatatggagttacccattataaactcatttacaatgaagtcagttgtagccctgtatggtttcgctgtgtccccacctaaatcgcatcttgaattgtggttaccataatccccacgtgttgtaggagggacccagtgggacgtaattgaatcatgggggctgttactcccatcctgctgttcttgtgatagtgagttctcatgagagctgatggttttatatgggtcttttccctctttgctctgcatttctccttcctgccatcatgtgaagaaacatgtgtttgcttccccttctgttccctttttttcctttatttatcgatttgagtgtcattcagttcaacgcgaattttgtgaacagctggtgtgtggtcagcccaaggctgaaacatcgtgagtgaatacattgaggacacaagttttgtgaacagtgggagcagaagccaaatcgctgtagatggaggagagagcaagagtggacaacctgcacgaagttgagctatgtaaacaatggggtaagaaaagtcaggggtgttagaggaagagaagtgaaagttggataccacagcttataatgagaataggaattggtaaaaatgtcaaggcaggataaataatatatgtttagagatttagtacaggagccatttgacttctctgctctttgagacagacgtgaattgatagagatacagggaaagtgtatttgaagtacaagaaacagcatgtatctagaaaaccaaaacacagagggtataagtgtgggggagctgtgaatattccaactttggccacaacattgggtagatatcatagttggccagtaatgaaaacttgtctaaaagtgtatgtttatgtcacactgtgataaagaagtatgtaattcattggtttattttaatcccagttcttgattttcctgaattattgagtatcgtgagacaatgacccatcttaagaagttctaaggaaggtaggctaatatgcaggaaggtatttgtaaccctcgaaactcattggagacacctcactaatgtatggtaaccagaataataggagggtaggaactaagccaaaaatcaaagtgattccttcgcacatcgctacctgacttcttcagctttgcttaaactctgccatctgctggtgcagcagcaacttcctcctaatagtgtatgttcacactgagtattggcacatagtttctgcatcatataggattaaatttcctgtttattttttatttttgctttgtattgtattgtactttggttcacttatttgcgtttagtccagatcatgattctcataggttataaaaattttgtgcatatgcctgttttgaaatttttttcttatttgtatatccacagaatgcttgaaagattcctttacccaatgccaaaaagaatccacttaacacattctgctgaggcctttatattagtacatgttaactttaagtgggaatgttccaacatgtgacatactgtatgtgacgaaaaaatgttcttagaaagattctcatctcaagcaaaatttatactggagacactgtctgcaatatcaaagacttcactattttcaactcacagtttactaaagaggataattagagaggtactctaacattagcaacaaaacagcatttgaagttcatgacacttgataacggaacctctgtatttcttagtctctagcaccatttcatagattgtactaagttatcagaggagatgagacatatatttgacccaattctaaaaatttaatataatcaatatttacctataaggtacgttaattgtattaatacatgtcaagtctcaagataaattctgaataaaaatttttcagttaagtattgcaaatatttttatcattaaatttttaatacataagagattatctgtgtaacatattaaaatgtatgtcatatcatgacaaaagatttctctattggaacatcttttatttaactggcttattattatttctggttggtgagtttaaaagattgcaatctttaattttatttagctaagtgatttgttgcattttaaaatcagtagataatatatgtatcatcttagtcttaatttataaatatatgacatttcaataaaattcttgaagccaatcaataaaattaattaagctttaaattctaggctatctgaagctaattgattattgtatttctttattattcttgaagggaaaagcagacagttttgtatcaagatgctgattttctaaagtgagaaaaattaattttaaaacttaaattgtgtgttcaatatctgtgtgagatcagataaaccatgtgtcttagagagggaaagtttcgaaagtataatttttttttttttttgagacggagtctcgctctgtggcccaggctggagtgcagtggcgctatcactgcaagctccgcctcccgggttcacgccattctcctgcctcaacctcccgagtagctgggactacaggcgcccaccaccatgcctggcttattttattttttattttttgtatttttagtagagacggggtttcaccgtgttagccaggatggtctcgatctcttgaccacctgcctcggcctcccaaagtgctgggattacaggcgtgagccaccgcgcctggcgaaagtataattttcatagtttcttatttatctgtattttcctatatgatttttgttgaattgttttaaatttattttacattaattgccaaatatctgaattcatgagccacaggttgaagaccactgaagaatataaataaataaaattggtagctcattgttttgcaataacttgtgaggactaagctcagatttttttttttttatcttgcccaaattcctacttaaggagtctggggagtcatcccctacaaaccatgaattctcatcagatggattttttttttaccctatatagcatgacttactttgcagtctgactctggcatgacattatgtgacaaagaagaaagtaaaaaaagtttaccccaaaagcaagtttctttgaaatggtcctgcaaagctgtcctttgttgggggatatatgcatctgtaaagaatctctattaacatagctagatctttttcttccaggccctcccaatcctgaagaaattaagtaaaattctagcaccttttaaaggcctgaataggaaatatttgttatctattatctctaagggcagccactataagacttcagaagaaccttggtatccacaatcttttagcttaacctgaacatgccctttcctttgatcccaggtcttcagacaaactcaaccaattgtcaattggaaaatgtttaaatttacctatagcctgaaagccccaccccctgctttgaattgccccgcctttctgaaccaaaccaatgtatttcttaaatgtatttgattgatgtctcatgcctccctaaaatgtataaaaccaagctgtaccccaaccaccttgggcacatgttctcaggacctcctgagggctgtgtcatgtgccacggtcactcatatatggctcagaataagtctcttaaaatattttaccgagtttgactcttcatcaacacctgttctattgaatgaactggatttccactgttaatattaccctaatgtaaaaagtagtgaggtaacagactttttgtcagccttgtacttacagagtagatgactctgtgatctgagccctaattcctaacaggggatgctttggaatgaataaatgcagaggtaccttgaactggaggttggccccgtttcatggtagcattttcccagaatacatgtctccataataaaaagagttcctgaatggcagatgaaggtatccagtcataaagccaagagataagccacccattccagaattgctgcttcctccttgatctgcaatgatcaagtggcaactgtgagtcaacaggttgtacggtgcacagaagggatgatctggctgagtgcagaaagtctgcaaatgtgtggataagagagcaaaggaagaagtcctaaattgaggagaaactgtcctttaaggacaggaaaaggaaaatgagcaagaagaatagacgactttgaaaagaaatgaagctggaaatctaacatcatagcctaatccctaaataccccacagatattagaagaatgccaagcattgctgaacttgatagacgtagatatagatagctaggtagatacagaggttgagatagataatagataggcagatagatagatatacatacatacatacaggcatacgtagatacataggtagctacatagatacatagatgtattgaattgtacacatacacatgtgtatacatcatatatacctaagtatgagagagacaagtgagataccaaattataattagctaaagaccatttacaataccctgtacaaagagaaatatctaaagtgtttttggataattaattccatattctttagcaattcatccaatttccctctggaagagattcaggacaaagacatttcacgtcattttacagtgagtctcaaaaagcagtaaaacacctttattctgagcgccattttaaacttttaagcaagttgatgctactgcgactcttattcctgtcaccagagaagcaattcagaagacttgttaatatttcagaagttgcttaaacttcctgtaaagtgataggcctgacctcctggggttaatgtgagaatcatagctgttaatacacgtaaaatacctagaacaatgcttgacatagaataaatgctatgtaagtgttagccatgattagtattttcatcaatcaaaaatgcctctgttctgtctcacactcttttttcttaaagtgctctgtcatttctttatctttaatcatacttgtcagtcttgctccaatatctctcttttatatttttattccttcatacactgcttccaataccttcctacccaaacagaaaactgcttctctcctttaagaatacccactagtagtccctagaaagattattcttcagacacttaccataacgtggggaggggttagcattcacctctttgcatgctgccatttttaaaactacactatctccgtcccgttatgttcaggataacactattcataatttaccctttcttcactgggcctcatgccatcatgtccacctttttgtcaatacacaaacacctgtgattttccttgagacctcagagctctgtgcagtgtcatccagttccctggcctcactctttcctaactgctgtgagtcattgactaccacttctttctcaggatgttacttcttttttttaatttttcttttttttcgagatggaatttcactcttgttgcccaggctggagtgcagtggcatgatcttggctcactgcaacctccgccttctggtttcaagcaattctcctgcctcagtctccttagtagttgggattacaggcacccgccaccatgccaagctaatttttgtatttttagtagagatgaggtttcaccatgttggccaggctggtctcgaactcctgacctcatgatccgcccacctcggcctcccaatgtcttgtgattacaggcgtaagccaccatgcccagccaggatctcacttcttgagtcagatcccacatccactcatcacctagtgctctcccttctaaaatctttacttccatcatgtcacttaaattacaaattgctggcatttctttacattaattgagtatcttggcatgtggctcgcagtatttgtcataatacgtacatctgctatcatcgtgtgatttaaatgctcacagagtggattaactcagtgtctgccatgccaggctccttctttccttacttcgacaacacctgcttctaaatcttaaggatgtctgcacctgtggtgttctggctcatataaattctcccaggtaatcatctcttgctgttatcttcctcagtcttttccaggttagaccgcagtgtataacatttaattaatcagttcttgccattcatttctttgcagtagcaattgagcttacattcccatgaacaagccctaaacacaagacattccaaccttcctcacctgcctctcgcttgcctttccttcaatgctgcatctcccggtcagtgtgccacctctaacttccttacagaaaatgctcttgaagaggttgtttgtatttattgtatgcaagtctttgtattatagtcacctactgctatcctttcattttacaattcgtctataattgtgtttactaccaccagtgaccactgggttgtttaattcatgggtattttccacatgggctacctgatttgcctgcagaattggaggctattaactaaacctctttttaaaaccctttctaacttggtttctatgatacaactctcccctatctttctacctgcttctcagacagatatttatcaggctcttttatttttttctttctccctgcaccatcgttctccacaggtctgctctcattctattttctctccaaccacatcctcttcttggatggtcccattcacgtccatagcaacaattcctacctgagtgctgatggcttccaagcaggtgctcccgccttttgctcagctccagacatgtgtatagaattgtttgccataaccttgacttgaatatactacttaattctcacactcgaactaccacaaaacaaaatgtcttagttttccaaatcttctccctttttgaatttattttctgaatgaatcactccacaatccaaccttattatgattttctacatccatcatatcacttatatttgaacaattctttgtcttctgtcacccattttcatctcaggttttcatgctcatcaccacggctgtgatctggactttatcttcatcattaatcttctggctgctatacttacacaagttctatctctttcatctcatagaataatgttcttaaaatataattctcatggatgctctcttgctaaaaattgttgttactgtctctttttaatatggcctgtgatatttgtagtataaaatacaaagaagtttctaaccacttgtcctggctcatccacccacagatacccatcctacacacattcttctaatcacatcagtcttcctgctgtgccccatggcccatgctcttgctcccttcacttaaatcacagcgcttgagcacaacttatctttgcaggaaaatttcatctctgcccttgactgtgcagtggtgggatgagcacttattttaacatacttttgaattgctctgttttttctttacatagaaccctctatatgcctctctattttattttgtctatctcacccactggtatatgtctttcaactttttattttattttatttttttgagatggagtttcgctcttgtctcccaggctggagtggagtggcacgatcactgcaacttccgcctcccgggttcgagtgattctcccacctcagtcttatgagtagctgggattacaggcacgcagcaccatacctggctaaattttctagtttcaataagaatggggcttcaccatgttggccaggctggtctcgaactcctgacctcaagtgatccgcctgccttggactcccaaagtgctgggattacagatttgagccaccgcgcctgacctgtgtctttcatcttgttcgcagaacatagcaaaggctaagacataataactgttgaataatgatgaataaatggattttaaagaggcaattaggaagatcagattttttttttattttacaaaaatacgtgaatttgattgtactctgaggaccctttactagtgccagatgaggatggtctgttcaaataatttcttctacacttccatgctctcaggtagaggaaagaagattaaaaataaaatatttccttatatccctacacagaatatcgatattttatatgtgattccctttgttccatataccaaagcataaagtataattcagtgtgacacatataagaaagtatataagagccaaattccctcatccatttgtttgctgatgaaattaacccattttaacaaaatggtttttgtgcatagcaaaagattaaatgtctcaggaagtatataatgcgtatattgtgttacaaattaatttagcctgtgacatgaacataatagtgtaaaatagaaaatatatgaaagtagacatataaacaccaatccaagaaagttataaatagatagaaaatcaaggcccagataaggaggaatgtgagtgagtatttagtgccaaagaaccttggtagtaattatagtgttaagatgagtttcctagtagctatgttaaaatgaagatagcatcatttaagcatttctcaccttaattaaaggggagtttgtctgtgaaggaaatcatttcctagtactgaattatgatataagtgccgttgctgagacattatatatatatgggccattgaattatgatactcttcaacaatatttttgtattaggcaacaaaatggatttcatatgactatttgttgtactgttcttttattaaaagaagtagggcacaaccccaaaacttaatttggggaaagaaattctgttggggactaaggcaatatagttcaagtttgtagcctcctcgtgatttcatttgaccaaggctaaaatttataatacccagaggagtgacagccttcaagtgattttctgtaagtattaaagttgaggtgtgtattaaatgtccacttctgtttggtgacactttaagattttctagttattttgaagactcataacattctacgaagaaaattccttagcaaaaaaatagttttctcaaaataaatatattgctcacaattttaatgcctcagcattaaagctaaaaaggaaaagggtattatctgccctaagctatttgtaattgataaataagagtttaaatttttctctacagagttttattattgagccattattcaattatgagaaagagggaagtgaaatatctgccaaatacttctgatatgtcagatatactaccaggttattttacatattttatatcattgaatgtcagaattaaacttgtgaaaatcatagctagctaaaagtagatatttaatttttgtggacttgttgaaacccagtacagagatgtgtctacctgggatcatgaaatcaaatattcagaagaaatatatttttcatacgtattctgaaatcagtggctgaaaccacaagaaataagtgaacagagcttataaatactcatttattgagtttattcccttaggttcacatcacggagatgcttaaaatacttaagctagagttatatttaaagtactgctatatatagatacaatacaacttattttacagagattccctttgggggacaagaattattaatgtatgtgtttatcctgagctccctctttctgtttgctaatggggattctagctttgtctgctcaatttcttccccattgctcttctctgaaaagacactgctggtgtccagcagtgacattctctttcatatctccacatcagtacaatggtaagaggaaatcagaaccaaaaaggcagtgggggagtggtaggtaaagattgagaagatgcatttgagtaaggtctaggtgacctttcttccagaaaagaaaaaaacatatatagagtcaggaggtgattaaaaattttaaccagaaggatttaaagaaagagaggtatggatgaaagaatataaagatgtgtgcatcatgtatacatatgtaacaaacctgcacattgtgcacatgtaccttagaacttaaagtataatttaaaaaaagatccgtacattatattttatgtttttattaccaaaatacaaatagactcttgaggtatttttacatcatgtttcattataatagaatgatttacattcctctgggtatatacccagtaatgggattgctgggccaaatggcatttctgcttctaggtcttttaggaattgccacactgtcttccacaatggttgaactaatttacattcccaccaacagtataaaagccttcctattgtgtctgttttttgcttcactattcacaatagcaaagacatggaatcaacccaaatgaccatcaatgatagactggataaagaaaatgtggtacatatactccatggaatactacatagtcataaaaaggaatgagatcatgtcctttgcagggacatggatggagctggaagccattatcctcagcaaactaacacaggaacagaaaaccaaacacagcatgttctcacttataagtgggagctgaataatgagaacacatggacacagggagaggaccaaaacacactgggacctatccggtgggctggaggggaagggagagcatcaggataaatagctagtgaacaggggccttgacaccgaggtgacaggttgataggtgtaacaaaccaccatggcacacgtttacctatgtaacaaacctgcacgtcctgcacatgtatcccagaacttaattttttttaaatataacatatcagtttttttaaatcagagtgttgtcttgctatatcacgtgggtcacatctttataggcattatgtattctaataaaatggcaagagaaaaaatatttaaacagttcaggctagaggtaaaatggaagagttgaggctggtcttggccaagagtcagttgagtctgggctctggccctacctggccatgtttatggataagtttcttaacttcttttcttcaaaatataaccaggctaagagcagcctgatgggagtccgactgagcagggtttgaatcctagctttgccagttagcatgttgagatgtgaggtaagttacttaattcaagccccatgtcctcatctgtaaatgcagacaacattatctaccttcagattgttgtcaggattaatataatttatgtaaattattttacccaacatttggtatatatttgtatacagtaattggaatatctttggtacaagataaatgttacaaaacatgagtgttttccttgtcattggtgtggtaccttgcattttcaagttgtgttaatccattcacattactataagaaaacacgttagacaggataatttagacaattataaaacagaaatatattcctcacagttctggagggtggttgtttgagatgagatgtcagcagatttgatatctggcaagagcttgctctctacttcatagatggcgacttctgtgtgtccttacatggtggaaggggctagggaattttgggaggcctcttttataaaggcactaatcccattcatgagagctctgccagtcatattccaaagccttcatctcttaatactattgcactggagattaagtttcaacacatgaattttagaaacacaaacatttagaccatagcacgagtcgatatgtttctcttttgtttagatttgctgataaagagagaaattgagagacagattgagattcagtaaagggtaaagttactgaagttgcaaaaatatattcaagaacattataagggaaatgtatagggcattacagcaagtaaaatgtaatatggatactgtgaatgatttctaaaaatttaagtttaccaaaaatatattgtgaagacttgaactgtttgaaacatttagtccttgtagatcatgagtggaagaacagactctctaagtagtgaagggaaatagagcaacatttttggcaccaggggagtggttttgtggtagacaatttttttcacagacctggtggtggtggggatggtttcagaatgatttgagccccttacatttattgtgcactttatttctattattattactttgtaacatataatgaaacagttatacagctgatcataatgtagaatcagtgggagccctgagcttgttttcctgcaactaggtgttcccatctggggggtgatgggagacagtgacagattatcaggcattagattatcataaggagcacacaacctagatccctcgcatgctcagttgacagtagggttcatactcctatgagaatctgatgctgctgctgatctgacaggaggaggagctcagggggtaacaagagccatgaggagcagccataaatacagatgaagcttcgctcactcagccgccactcaccccgtgctttgcagtcttgttcctaacagccacggactagtatgggtttggagacccctgaaatatccagcaagccttttaaatgagtgaattattccattccaacctctggaatataaaaggtaaatagtctctcaggaattcacactgtgtggccttctgcattaaaggagtcacctaagttatctggaaattcatgtacaagggtcagatgttgctggcattgtcctaaccctgcagagctgctcccaaatcaatccttcaccacctccttgagattcatgtcttgagaccctaatttccttcattttttcaaagatgtctattttccaggaggacacatcttcatttttaaggaaaactctggctacaggccatcagatgtttttccccctgccaacactctgggtgacattagcgcatttatgcaaaatacattcaacacactggcctcataccttttgatctcatcttcaataacatgtatttctactccaatttaagcacccacattcattgcctcatcaggaatgatgacatcttctgtagctattcacattgtatttttgaattccagtggccctctcacctttgacttcaatacttgattcttttagttctttaaaatttttattttctcttcacacattatttgatctcctgtagaacacttttttcttccacttttgcctcacttatttaccaaacctgtctctctctctcttttttttttctttctttcttttgagatggagtcttgctctgttccctaggctggagtgcagtggagcaatcttggctcaccacaacctccacctcccaggttcaagcgattctcctgcctcagcctcccaagtagctgggattacaggcacctgccaacatgcctggctaatttttgtatttttagtagggatggggtttcaccatgttggccaggctggtcttgaactcctgacctcaggtgatctacccaccttggcctcccaaagtgctgggattacaagtgtgagccaccacacccagccaaccaaatatctcttaagcacctcaagtgctttacaacagggaatgccagaatacaccaattccaagccaaatccacacaggagtgaaaaattatgtttagataaatgcaactgttcaaacacatgctttcaaaaacaattcttccttagtgctgagggccatcttgatactttgttaaacaggatctatcaagagacagaatagagagattcagggagagtgtgatgctttctttaatgccctgatcctgagttagatgtatcagcaatgtgtctcagagctttttataaacctcctgtttccacatctaccaccttctatcacactggattctttacatagtttcttccacaatactgtaaacgttaagaatgtcaaatcaagattgaatctgattttctccattgcatttatattacagcaaagtacctggtacatggtttatatttaataaatatttatcatctaagtggattagttaccctccattatcttcccaaataaatgccaatttcaaaaaaataccaaattttgccaactctctattcaaactcacatcttttgttttcaggaaatgacatattctctttaatgaaaataaggacataaagtatcatttacctttatgtagccagtcccaccctcctataaacttatctataattgggtgatgagtgatccttcctcttaactaaataaaatttttcacttgtagaattgatctagctcatacctttcattatatcttgtatctttccccatttgttattgtgtctcatatctctgccttcagcccttcccacttctctcttattttacctgtaaacatgactgaggcaaaatgattgaggtagaatgacataagaaaaaatagggtaattttagaatgtcattccaatgtgagagaactccagtgggccattttatcttctaaaattaccttctttttgttatgctattctctagcttccaactactttttttttttttaaagagatgggggtctcgctacattgaccaggctggtcttcaaatcctggcctcaagtgatcctcccatctaggcctcccaaagtcctgggattacaggtgtgagccaccacagccgggccccaactacaatcttgccgtcccttttctaattctcttcttttgaaaggagttttcaatttgctactttactttctcatatcccactcatgcatcaacccaatgtacagtagcttctatcctaactactctaccgaagctgctcttccataccgttccactcctttcactcaaagtaccccatatttttgaagaacggtgtcattcatgatacaatgttctctagtaagcagatctggagatggggatctatactagggagtgcccttggaataatatctctgaaaaggagaagaaggaagctggattgggggacgggggaaaagctgggctgaaaagaagtcctggaccacagctttggcccatctcacagggcactttgaagataaaatggcccactggagttctctcacattggaatgacatgactgagtccttaggggccccaagtcccctcctcacctctttcacctgcctccttgcctcacctcaatcagtcattggctatgggccacacctgggatggacatgactttgggcagggggaagctctgcagctgaggttatgtctgaaggggctcacagctgagtcctgtccactgacacagctctcagggaggacctgggtattgcgtctctgtgtatatatatcacatatatgagtaatgatattagaggttttataattttaccttttttctccgttttatctttaatcttcactgtatttcagtcatggtcttcaggcttcaaagtgacctttaagagtcagcaaagaatatacagctttttaaacattgagaataaaacaagaacaatgtgatagcatagtgcaatggtgccacagaaataaacaataaaaaagaatttaaagagagaaccaggagtcaatttcataaatgccaccattacattacttaggttaagcttttgaatttatctagaaaaatgtcactggccaagacattaacatttatagaggaatggagaagtacgaaattaaagttcctaagaatcaagtccggaaaaatagaaaatgtgtattggctattgttctcagtttggcaaataaaatttaaaaataggcctggtacagtggctcaagcctgtaatcccagcactttgggaggccgaggcgggccgatcacgaggtcaggagatggagactatcctggctaacacggtgagaccctgtctctactaaaaatacaaaaaattagccaggcattgtggcgggcggctgtagtcccagctactcaggaggctgaggcaggagaatggcgtgaacctgggaggcagagcttgcagtgagcccagattgggccactgcactccagcctgggcaaccatgcaagactctctctcaaaaaaataaataaataagcaaacccagaattggttaatttcaaataacatttctagtatttcccacacggtttttttacatattttaaattcactaatatagcattacattttaaaaaggcatattttaatatcttatcttgaaatcataagatgtatttgttcaaccaaatcttacagtaaagcagtataaaaaatataaattctacagtgtgatagaaatgcaaactatttgacgttcaatttaatcattttttcaggaacctaaatattatttattaattattactttaactatttaagattagttacaatgaaaagaatattgccttagagatcttccattaattattcagttcccagcctctgattcctttataaacttctaaattcttcagagataaatgtacttggctcaaatttaatcatgttacaatgcaggttctgtatcaacttagtttttgtagacactatatggtataagaagacaatgtttaattttatgtcaatatcttgcataaacttgttcaattaattcattcaataaacagtcattgagttcgtatcatgtcccaggcactgttaaaaacattcatcttatgtggtgaaaaagtatgtatggaagtacctgcttttatatgaaaagtactgatgttttttctaaaacttgaagtatagtctctgatttgcctatctaaagagtgaaaaatttcatttttactttctgcagaaattcagtttcttgttgttttatcatcatacgtacaacttttattgaaatatttctctagaggcataaaatatattgccatttttgaaaaccagatattaggggtctcatagtgctgtaggctgaatgatggtgacccccaaaattcaactgttgaaatgtaacacccaatatgatgatatttgcaggtggggccttagagggaggggattagatcatgatggtagagccctcatgaatgggattagtagacttataaaagagtccccagagagactcctgcccctttcaacatgtggggcacagggaagagatggcaattcatgaatcaagaagcaggtcctcaccacgtcttatggcactttgatctaggacttcccaccctccagaactgtggacaacaaatttctattgcttagaatccaccaatttatgatattttgttaaagctgtttaaatagattaagacacctaggatgggaaacccgttaatattgtaatacagagatgagctttctcttcctctaactacttttaaagtctacgacaattagaaaatgatgttttgtgtagctgtattttgatttaaaattatgtgcctcaattaatgatgaactaacttgattttgtgcctgagttttaataagtgtgatatgtttgaatcaatgtgaattattttatcagttcaaaatatccaaaaaatttttgtctggttaagatcatgtgcatctccatgatgggattagtgttcttataggaaaagaaagtgagaccatagctctctgtctttctcttttttgtgccatgtgaagatatagtcagaaggcaggagcctgtagtctaaaaaggcagctttcacgagggactgaatctgctggcaccttgttttggacttcccagcctccagaattgcgagaaataaatgtctgtttaagacagcagtctctggtattctgttacagcagcttgagctgcctaagacaccatgacaatataaaaattttaacaagactagcctgggcaccataagaaggccccatctttaaaactaatgcaaataataataataacaacaaactaaaacatttggaatttttaagtgataattttctcattagatacagaatcagttacttaaaaagatacagatcccaaactctattatttttaatatttcttttaaaagttcatcattttgaggattaagattttctaatacatccatatatacacacatgcatatattcatacaaataactatagatattcattttatcaatgatttattttgacttatttatttaaaaatattaaatttattttataaatgaacaacgcatttattataccattttaattccaactactagctactatatgctataatataccagtccctgctggctttgaactacttggaattctaagaagtagagtaacatagtacaaacctatagacaatatgataaatgtaccacgaatgacacaaaatattttctgcatgtcacatacggagtcattctgtattttgtcaatatccttagttaattcaaaagttcccaatgcacaaatcaatcaagaatttcacccccccacagtgaaaaaaaaaaaaaaaaacaatgtgaaagcagtcaggttttagtcactgtaaatcacaatttcaattctaccctgtccagagaaagatatttacgttcttcccattccaaatacatacaggccatgagttaacaatctttcattttcctaaaacaccaacagatttgcttttttactttcatttgtagtttatagtactcacaattaagtggatctaaataaatatatttgaggtatatatctataatatctatctatctagctagctatgtggattaaaggtcaatgctattgtctatgcattagccactcccatttatgagaattttctaaacttgttgctatatatctcttaaatggtgtcagttggccaaatttatttcctgaaaaacagctgagcagccaacaatgaaaatgaagctctctgcatacctcttatgcatactgcatacaccttaggctctctgcatgcctctcaggcacttatgcttacatatatttgtatctcattacatagtgacacactcctaaaataaagtaaatcatgagttattttctagacaaatttgataaggcttttatttgataacaatttaaaattatgccaccagatgcctatacttcgacttataaaatgtattatgttctgtatgggcaaaaagaaagtgtagaagttgagcagctacctggtaaaattacctaaatccacaatgccactggacaacattgaagtagatatttaaataagtgaaggtaatcaagcagttgagttcactaataaaattatatttggaatcttatatcattcccagattaatatatacaatgtatatcaaatgtcattgctatggaaacttaagtttttacacatgaggttaaatttttataaagaaattttttctccagaattgactttatgaaacttgacatcctctgtttctggcatgtattaagaaaatgtcaacccaatgtcaaaggataattaatttttttaaaggagaggacaataatggttctcatacaaatgtaaaatgaatatatgttcatgattttatttaactgattaataaataagagtgccataggatgttttgactggttcaaaggagaatacaaagagcagagaatatataggcagacattcatgctgaaatgaatttgcttaataaaggcaaaattagccaatatccctagggtgatggtcaaataaatctacactggataatttgcattttcatggacaggaattatttgcaatttacacagttgtgaaacaggtaaaacaaacaaaaagcaaaaggctcagaaaccccatacaatcagctaaactaacatttagttttccattgaaaatgtttactaatttttgagaccatttcaaagtttttcttaatttttctctactctagaaaagtctataaattatttccagtgaatattaaaggcctttttctttgttgaattagtattttgaaaaatttatgaaaggagacagaacagaaaagcagtcaccaagtttatcagttaagtcggtattattacaaatcccaattgagaagtatttttaagtatatttttctttccaagacaaatatacattaaacagtcctaatgtttgtatcttttatgttacatatatatgtatagatgtgcaagtatatgtatatctacatgtatataaaaatacacgaactcacatagttatatcagagaattatttatgcaaatgtgttggattttctttttgtgaagctatgttatcaagttattcttagttttacagaaaataaaacaactctagatctttgtatcataaaataaatatctgtttacaaatatcagtgttttctttttaatacttctaatgtactctattggaggtaatggtatatgaaaccctgtaagtgcaattctacttcattagttaattcagatgaaacacaagtttttaagacccagtgtatgccaacaattgagaaagtcattaaagtagacaaagatgggtagagcctgggctttggctatgaatgttagaaaatgaatcactgagagtaaaacatgtttaaaagattaaaataacaaaaattggtttgaaattaatttcagctattggccatcaattggttagaaagaataagaatgagtcaaagcttttttctcttcatttaattcaaatatgtcataaaaatagtaaattttagatgattataagttgattgtgtcaaattggttgaatgacatgtcattgaaattaacctttacctcataatgctatcatttgagttttaattaatattggggtcaaaaaactgattttcattagatactgtttttaatgatcaattattacgccaatgatttatataacggggaacttcaattcaatgtttggtagctgtttgatttttaggacattatatatttgaatgtacactgattatcctaaagttgtaaatatttaagaaacttttcggccgggcacggtggctcacgcctgttttcccagcactttgtgaggccgaggtgggtggatcacgaagtcagtagattgagaccattctggctaacacggtgaaaccatgtctctactaaaaatacaaaaacaaaattagccaggtgtggtggcgcacacctgtagtcccagctactcaggtggctgaggcgggaaaatggcgttgaacctgggaggcggagcttgcagtgagccgaaatcgtaccactgcactccagcctgggcgaaagagcaagactccgtctcaaaaaaaaaaaaaaaaaaaaaaaaatagtctaaaataaagatacatttatattattttcaaaaaagaaaatctaaattgactccctaatcaaagaaactgtaaacagaatgtaacaaactatatattgcttggcccccaaacatttcaaagtcacctttccttttaatatacatgttctaatattataaacagtgatctcagaaaaatcctaatttgtcttttttgtatattttcagcagattgtgctgtttcaaattctgttattttattccaattcttttgttcacatattgctttttttgccagcgtttttcatattttaaatatattactatattgtatatagtaatattgtgtttccatttctctctcttcgtgttttattttgttccataacctttggcttgtcctttttattccatattcccatttgtaaatgtagttttcaaagatgcttttcttatttacacaaacacaagacttttgacccaaaatattctgaattcaatcaaagtcaaagctcaaacatttcttaaaaatgagatttttctgagttgggaaccagagtaatctattgcctgatgcaatttgagaatagaacttgtgccaactctctgtgcattatcaatagaagaaataggataagatagaggcaaggaatatacattcacagagcaggaaaaattgctgagggactcatataaattgggcttattaaaataaacttaccaagttatagtaccaattctccttttttcgttcagtccataatagagttctcattgctttcaattcttttttcttataatagttttcctaaatatttaattaatttattattttttagatggtgtctctcttcgtcatccaggctggagtgtagtggcacgatcttggctcactgcaacctccgcctcgtgggttcaagcaattctcctgtctcagcctcccttgtagctgggactacaggtgcacgccaccactcctggctaatttttgtattttgtttctgtttttgtttttgtttttttgagacagagtctccctctgtcgcccaggctggagtgcaacggaaccatctcggctcactgcaacctccacctcctgggttcaagcgattctactgcctcggcctcctgagtagctgggattataggcgtgcgccaccatgcccggctaattttggcatttttagtagagacggggtttcaccacgttggtcaggctggtctcgaattcctgacctcgtgatctgcccgcatcagcctcccaaagtgctaggattacaggcgtgagccactgaacccactcctaaatctattatttaaaaatccacctgtgcaattggtattcacagaactctcccatatatgttattattttattctcataactctctatgacaagtgtggatacattattgatgtagaaaattagattacagagataaagtgactttcccaaggtcatgaggcatgtaggtggcacatgttgggaccacaacctagctatccagatttttcttctactctgtgtttcactgtaccatctcagaaaccttcagctcagtcaccacatgtcagatgggtaatgaccgtctttggaaaagcaaaatttcattacttactagcagtttgtatcaatgacatacagctttggagcacctgagatatatagtttttatttcttccccatcattggccctagttgccgactccactaactctcccccttagggttttcctataactatctctgccattcatgcaatgacttcttgccaaatattcagatttgtttattcagttactagctggacttacccatttggaagtctggatgtaactcttattcaacatgtcttaaatggaaatccctcattggttttctcccaagctatttgtgattggcagcataattctccctccctggaagctgtgtatatataggttacatggtgccatggtatgaatgtattcaaattcatgtgttaaagcttaatctctattatagtggtatggtagtgagaggtggtacattttgggaagtgattaaggcacaagggttccactctcatgaatggatcagaagcttataaaagggctaatggaaatagcttagaccctttattgctgttcctttctgctatatgaggacaaagcactcactcttcctgctctctaaggacacagcaagaagacctttaacagacaccatgttggtatgttgttcttggcttcccagtcttcagaactgtggtatacagtggcatttaaaaaactaatacagagtctagtatctgaaagtaagggtctgttgtaacaaatcttaaaaatgtgcaagaggctttggattttggtgataggccaaggatggaagaactttgaggagcatgacataataaacctagatggtctgaaaagagtgtttgtagaaacatggatatgtatgaatttgctagtaaagagtcaagaggaagtgagaagcatgatagagaaaaactaaagcacctaaacaattccaaaactatcaggaatagactgtcttagacgtatgaatgttcaaggatatgctggtgaggtctcagaaggaaataagaaacattttatgggaaactggggaaagaggattcttgttacatagtggcagaaagtttagcagaattgttatccactgttatgcggaaaggagaacacataaattgtacatttagctgaagaggtttcctagaaaactgttgaaggtccagccttgttttctcttgctgcttctagtaaaatgcaggaaaaaagaggtaaactgagagaagaattgttaaacaaggatgaaacaagtgcttgattgagaaattctcatctatattgcaaaagacattgaaataaatgctgccaagaacgtgtactctgaaaaagctgaggttataattagacaatcttttgctaataccagaggaagatcaaaatgtcaaagtattctgttacacagaagcctatatgaagggattaagtgtgttactcatagacgtcttacatcatctcagcggaaactaaaaatagagataagattatgtaagaaatatctgtggacaagcctttgctctactggagagaagcgagaagcccatgatataaaagggagacacacaatattctttgagaatgttatatcaactgagatactgccagcttggaataaaaggaacaaaatgaaagaatgccatcaggtttccaaaattctacagagaggaaacaggctgattaaacttctcaactgtaaatgcatgctatatttcatgaaaaatgaatgatgatctggaaggtagagcattgagcccagagggactagacttaaacccacagaatgaagcccaaacccacagaggattattctcagattgaaacctagtggagtttgcctgtctggattatgagattgcttgacacctttaagtcttttattctttcctttgcaccttttttatttttagtgtttaaacttttattttaggttcagggatacatgtgcaggtttgttatatagggaaactcatgtcaccagggtttgttgtacagattattttgtcaccctggtactaagcctagtatgcaatagttattttttctgatcctctccctcacacactccaccctcttgtaggctccagtgtcccattggtcccctctatgcgtccatgtgttctcatcattcagctcccacttataagtgagagcatgcagtatttggttttctgttactgcgttagtttgttaaagataatggccttcagctccttccatattcctgcaaaatgcacgatcttgtttttgttatgacctttgcacctttgtaaccagaatatctataattattatctcagacctgtcctaatttctatttcaggagtaatttgggatttttgagctgatcaaaatgtactttgagttgatgctgcaatgtgaacagaccatttaaggaattgaaatagaattaaggtatttcatatgtgacacgaataggtatcattggaggttccatagaagtttgtaaaaggcagaaaaaatgcccccccacacaaagatattcatgtttgaatctctggaacttggatatgccaagttagcaaaggggaattcagctttcagatgaaattaaggtggttaaacagctgactttaatatagcaacattagtctatcttatccaggtgagtccaacgtaatcacaagggtctttaaaagtagaaaagggagacagctgtgtgatgcttccttagagccgccacaaaacaatagttgtgcttaaacgttgatctccacccagtgagacagatattggacacctaaccttcagaaatgtaagctaatactttactattaaaccactaaacttctggtaacttgttatagcagaaacatgaaactaagactttgttcttgcctttttttttttttgtcatctaattttaccatatctctattcacctattcccttacctacaatcctggagatcattcttacttcccttctctctgttagaccctgcgtctaattgattattgagtgttaactgagttctgaaattttcccaagacaagtttttttcccctccacaccaactatcacatttttaggtaagtttcattatttttaaccagagtttcccaatattcttgaaactacttccatcttgcctctcaaaatatttgcatgcccttcagtgatttgccatcacctatcctagagaataatgtccaggctccttaaaattatgtgtaaagctatccgtacatggctcctgctacccactccagcatcacctaccttgcagttagggctaaggtaatattgagcaatctttgtgcccttgacatatcacgctctttagtgtctttctttgctcttgctgtccttgtttctgcaatgttcctattccttctttacactttttaaatacttttacactcctaatgtccaatctttcccaagattctgtcccttcattgccagatggaactgtgtttttgctttgtgccctcttgttttcttgatcctctttatctggatgtttaataaaataaaccatgattatctatttgtaggttggtaaaagtcagagtgcctgatgcatagatgaatatagtatcaactgtttactgaattaaactgaattaagctgcttttcccttgtcttggactcagcctaaggtgaccctcccctccccaataagtcatgcccttgtataattttctgtccttgtgttcagacagaacccatgacttgtttgtagctaatataatatgtcaaggtaaagggatattgtaggtgtgattaagatcccaattcagcttagctggagttaatcaaagaagattaacctgtacaggcctgatttaatcatggtgaaatccttaaagctgaggtcctccttgagccaaaagatcctcgtgctgaccataaagaagcaaacagctgtgtcgtgaaatgcctatggagagaaccatgtggcaaggaactctggcatcctctatgacctgagcgtaaactcctgccaacagtcagcaaaaagccaggaataaaaactacattaaaaaaataaaaagtatccaggtgcagtggctcacgcctgtaatcccagcactttgggaggccgaggtgggtggatcacaagatcaggagttcaagaccaacctgtccaagatggtgaaaccctgtctctcctaaaaatacaaaaattagccaggcgtggtggcaggtgcccataatcccagctatttgagaggctgaggcagagaattgctttaacctgggaggcagaggttgccgtgagccgagatcacagcactgcactccagcctgagcgacagagtgagacctcatctcaaaaaaatttaaaaagttaaatttagatgaaataaggtcaaaagaatagttaaatattgcactaggtacttcacagggatacctacaggattgacatcttgttaaaatcgaaactaaaaattaaaactacaatacttatgtagcaagtttcaggatttttcatgtttattatcctcttgtaattagttttctttgaattgattgctcatattctcatgtcctgggtgacatgtatttttggatcacacattgctacttgaattggcattttatatccttgaaatacaaggatattgtagtccactgtcatctttttggaagaattctgttaggggagactaaagatgccaagaccaaggagttagaaactataattgaaagtcaggttgtgctatagcattaaagttaattctccaaaaacataggcatggtccatcatgccactcaaggaatctttattactatgtcatgctccacttacagacatacataataatcttgggctacagtcacatgtatcatatctagctatcaaaatgcaaagtgaatgttagacaggatatagtaaaataatatctcttgaaatatatctatcccctagagattctaccaaaaatgggtggttgtttggcaacttaaaacttccatggacattaataataatagtcttatcctttacagtacatccagttctcagtacacacctattcagtgaagggaaagcaatagcttattaaaacatcaaatgagaaacatatgaattaacgaatttgaaatgaaatatcttaccacattccctcttatttttctttttttttccatgttgcttttaattttttgcctgggaggggaattaaaattttactacttaatatgcaaagctaccaataagatgctcaatttcaaaatgatattttattttccaatgaaaggtgactaatacagggcttagcaaccccattccttggggatataattagctagcttgtttacacatagcctgttgagcttgtaagtgtctatacacagattatgtcagttaccacggactggccatgtccacagtggattcccaatgtgtttttatgaatatattcactatttccagggctatccctggctatcatttaattaggatgcaaacaaattggaggaaatgaatttaaatttgaatttctctgcaattaggatgaaagaatttaaacatgagtgacttacagtttacaacatcaaattaatttatgcacactacctcaagtcatttgtagcaagaatatgcaaaatcaataattacagcctagatgatgcccttgctcctaggggataaagtgacctgttccaaaaagtcaacctgttgtttaacagttttccttttaagattgaataacatttacacaccttggagaaaatcctgacttcttttagtttctcctctggcatgtgatgaagactatataattttaaagggaaaaataaatcaacaactttaaaatattcaaggcaaaattccagtgccaaagtgcaatgcatgtgagtgctctggatactgtcaacagccagtgattttgttgtacctatgggacatccagcaggcagaatttgcaagctgagtattaagggtctggagaatggagcagataaggtttacatacttggcattcataagtgtgtatttaatgattgatatcatataaatagatgaattttccttaagaaaacaaacagtataattgaaggacatgggtgaactcagaaaaatacaaattctttggaacagagagggagatacaatataagaggggtggggaataaagtgggaaacaagagcatatgtcagaaaaacaaagatctagagttttaaaggagctcaagttaacatattaaatactatagggttatcaaagatatgttacttttcaggccttgatgattagtgtgtatttttcactttcttagcgtagtcttagcagactggccaagctgagtttaggtaccagacgaccaagaagaaaattgaggagtggaagtaagtagcagttggtttttcttttcaaaatctgacctatgattgtagttgaggaaggactgtatctagaatgtgactcagaataagacaatgtttctcctaagatataagccttttcctaaaatgagaggaagcaacattagagaagtagaggttgaaaatataggaaggggttataattggtggttcagaaatcctaaggaaagtataaggatgggctttcatagcacagtgggaaggattcatttaggtaatagaagggacacattttcctctaaaagaatctataagtaaagaactgtatatatgtagatgttagtgtagggttgtgtcatgaacttcacatggtctgtacctcagcactttctctttcttgtaaaggataaagccaaggcatcttcgtggattgaggtgtacaggtttgttgatgaggttgttgtttgtttgttttaggggagaagcaggatctctgtcaccaaggctggaaagcagtgacaccagcaaggctcactgtagcctcaacctcccaggctcaagcctcccacctcagcttcctgaggagctgggatgacagaagtgttaccacacctggctgttttttctttcttcagtttttgtagagacagggtgtcctatgttgcccacactgttttcgaactcctgggctcaagtgatcctcttgcctcagcctcccaaagttctggaattataggtgtgagccaccacatcctgcttgtgaagttttttttaatgatcaacctgggggaaaaaggttgtagaaacagtgaggaggtttgacaaaggaaaacgaggaattacatataatagattgctggagattgctgagaacataactgaggctgaaaacaattttgaaccctgtcaaaattatgttattttagcataattacaaattatgttattaaatacaggcttattgattttattttgcttttcttatataactccatagaagcatatatacatggtattctaaatatttatctcacttcttttaaacaaacatacttaaattgtggcttatctcaaaaatgtttctcttcctgaaagatcaatgtagcactgaaatctttgattcttttttccttcagttttttgcaatgctggtaaatagctatttttggagaacccaaggaccagagtatttcccctagaaactagagaaatttccaaaattactgtgaaacctctttatctgaaaatgtgcatgtgtgtgcacaagaatccttaaaggccctgcaacaataactctctcggcatttagcaagcatttctgagtgtgtgttgggtcacattttcaacattcctaaggcagtttacaacccttagccataacttcttgctttgagcctcgaggtcagccagcaaagagagattacgattctcttaggtttttttcagaagtgcacatagcactgctggtgcatgagttgcgattcccaggaacgtagtggggcttttcaaagccccacatggacatctcattcctcagaattcctttcaaggtcaactttttgtttgccctgaccattattaccactttatagagctgaaatattaaaccatgattactgattgtttttggcaaataccccgggggaaaaaggctatttgcattgagagagctataaatcaggtcaaactcacagcctgtaagtaggggttttgagggaactgccaggttaaacaatgaaaatactgagaatggagcttttgggaggctccaaacccattctgcttcatccacgtatcccaatgaatggctgctaagctgtgagtttttactgtgattttggggtttgttttgaaggctaccagggagcaggggtacagtatagatcaaattgtcacaaatcttactacagtcagcattctttcttgaagaaatgctcttcaaattgtaattcttttatttccagagttctaaaacttaattttgacaatttttcccagtattctctttgctttcaggaataagtggattttgagaggtcttttatctttccggaaatcctaacaacttgaatatgttttaaaattatattctcaagaggctctctatgtaagtaggtcagatacatgccccatttattagaggagaatcctgagagatcatagatgacattgttacaagttactttatggtaggtatcatctgagaatctagtcttagttgtcagcctttcttctgctgatgggtagagtgctaaaagggaaaggtgaaagtttgaaattgtacctgaagagttaagagaaaaaggggttaatgagttacttatagatctttgtgcctcagaggtccttactgagagttttaatccagatctttgtgcctcagaggtccttactgagagttttaatccaaacggtttggtaaatttggggtgacaggtataacatggcttaggcttaaagtgttctggaatccatcaagatctttgcagtgatgtcatagatgacaaccccatcatcttctaaaacatggacatgttgagaaatagtgtttttgttcagtcattgaactgatccaaacttctgtgttcatatttttatagacctcatgattgttaaggtataaagaagcatcagaagctttgtttttgtttttaagtacaaaggagttaggatattcctaactttttaattgattttttttttcctgcaaggaaaaaaaatgatcattaaaataattcactttgatgtgaggaagagcttcttgtcttagaggcactggtgaggggaattcacaactatgcgttgttttaattggattacatcctcagagcttgagttttgagctctgaatctacaatctattttgcaagtaatcaatggtatttatttaaatgctcttggtaaagataatgtgaatagagacgtctacttatttctagcataaaattgtttaataagcaaaataatagagcactgcaaattaactattaacaaatgaaatctttaactttcacactttcatttgatatttaccgaatattttcaggactagttcatgtgtaatttagttcaacttttgtttaaaataggaaagtgaagcttgaaaataagcactctcttaaatattttagaataccagatacttttcatctttcatggaatcatattctttgtattttagaatcaaggtatgttcttacttggtgtttaatcaaggaaatacctaaatcaagaaccattccaaatggctgtgtattaagtgagatggtttactgatgtcaacaaaagtgaaaaaaattatattgaagtataaattatatatattaatcttaattgctcaacatatatttacaaatacattttttgtgcatatttgtattttgtacctatatataaaacaaaaattatcttttgtacaaatatttgtaagatctggcacatttttagcaccccagaaaaatctttttcgggctctcaatgctgagaaaaagaaggcagtctcacctgttaccatatattaatattgcctaccttggtcttcatataaatggaagaatacagtatttatgttttctttttctggcttatttcacttaaacttacatttgtgaaatctatttgttatgtaccagtgattcattccttttcattttgtgtagcaccctgtttaattatggagcttttcaatccattttatgctgatggacattcaggtgtttctgttgaaactgtttgtcataagttatctatgtgtttaaatttagaagataatgataattatttttccaaaatggttgtatcaacttaataactcatttaaatatgtgaggatctcctaaaaatctaaaaaagatggacccccaatttcaaagaataaataaaaaggtaaagcacttaaacaggcagtatatgcacatttgtaaaaataaaagattgagttaaattttgaaaaatataagaatctcatttgagctacatgtatgaaaatatttattttaattatatgacacatagattttggatatgatgagtgctgaactgagggttttcacttgataagccttaaaaattgaacttttcactcacgaaacatgcttaagacaattttatatatgaattgaatcataaaaattgtcttagagttcaataaaatgtttaaagtaccttataggctgaggaaaacaatggaagagttaacaaggatacaaagcgtaaaagagaagaataagagttcacataaaatcgaatgaaaaggtaccatcttctgcaactctttaggtaattgttcatgtgtgctaattttcatgagttgtagcacattgtttttggccaaggcttccattcgctctatggatacgccaaaaatttcctatttcagatcttctagtctccaactctgaagataaaaatcattaaaacctctgactctgatattgaatgcctgcataaaaatttccttccatcaccttgcaacagatgacttgctcatacacctttctgactcaccatcacgggttctctccttcctttgagactacagtaattctttttgtatttcatgttatgtgcaaactttactttcaaaggggtttttacctatattaatgtatttacatcattcacttaatatattttcctatctgtaaaattggtttagatatcttggattaggatagaacacaatttttctcacttttataagttttttttagttgggccgtttttcagttggtgacagtgtcagaaatgaattaaaattaagtgaagaataggtaaacagaaggatgcccttatgacttaccaactttgcttagttttttcaagttcaacaagacccttctctcccttcaaggaagatgattcctaggcatgtttgttatttttatcaaaacagctgagttttttttttcattcaaattggcagtatacctggtaaatacaaattatttctgagctcatgtatatttttaggacagtttcttgtgatatgcctaggttataatattaaggaacatcgacttttctcagtgttggggcacttgaaagagttcttaataaccctgcagacttacttccagaataatgtaaggccactttttaaaaaactgtgcatattactctgagaaattaatatgcacttccttgagtttctttagtcttagacttgatagttgtaattgtcaataattgaagacagaatattctagaaaatattattttttgcctttctctgaaatatttgttgctctgtatggattattttatagattaaaaaacagaaaatatatttcaggtcctacagtgtaccccatatatgtgagcattaaagcttagagataaaggcactgtacagaataaaatgtaacacattgaccaaatggtttaatcaacttcattgctcaagctctacctcattactagaaatgctgctctaaaccattttctcttttcagaaaaacccagtatcaccagagactcaccacaaaatgcctgagcagatttgttctctaaattgcctaaatccatccaatactaatttgtccaaattgctctttttctccataagaaagtttcaccctcttaacctattatataatcttccctccaatttcaaagtaagagagaagtctcctttttccagagctaattcctgcatctgacctgtgtattccaacccagccactttgttccattagtcatcctttcctttgtcatagctgttacctcttatgctctgttgccttgttctttacatattttcttgaaattccttcattctaaaactccacatcaacaataattatacatagcagtaaagaatattataatttattatgtcaactgcgtgatgggtaataaaagggtacttatgaaaaatatccttagaggacttatgattttctagatacctcttgttttcacatgtatcgacagtaatttaattctgaaaaccatacttcaagtaatgcattattatctttcccattagacattattaaaattaatgccctgcgaaatcattaggctcattcccatatagaaaggagcctgcagggctgggattttaccctaggcctttgagctccagtgtcttatcatgtcagcccttccatgcaatgaagaacttagaatattctacaatcactgtctttgctttgtcaccacataaactgtaaatcaccacaaaataattttaatttctagcattcaactaaaatttgtttcctcacatgtgatcagagactctcatgttgactattcgcaatcctattctagacaaatttcctgtggtagtaaatactcaactaaatctatatgtagaaacatatttctactttggatctcctcttgaacttttttctctcatcctactctgtttctattgtcctttaatagcatcatacttgtcagtatcaccaggccacttctagacctgccaagattacctgttcaacattaattatcaatagtgtaatagccatcgtatgtaaattactcctaatgtacatctctactatgaaatataaaaaattcttccttagttcatcttttccacatggtttctcaaacagaccctcataatcacagctctcaaatgtttatcttgctgccttgctgttttcttgtagcgccttctatgtatgtatcaatatgttggtttttttttttttttttttttttgagacagggtcttagtgtgtcacccaggctggagtgcagtggcacaatctcggctcactgcagtcttgaactcctgggctcaggcaaacttcccatctcagcctcctaagtagctgggactacaggcactcaccaccacacccagttcctttttattttttttgtgcagatggggttttgccatgttgcccaggctggtctgaaactcctgaactcaagtcatctgcctactttggcctcccaaagtgccaggattataggcagaagcaactgtacatgtctccatcaacacatctatcatcagatctttgtaatctctcactgtctcactgaaactgttgtggtcttactctattcaaactctttccttcaattgcccctcagttgaaaatcctctcatgaatgatttcttccgttaggcttttagtgactatctaaaattctttttgatgaaaaatgactatgaaaatttagattcaacaaaataccagacttatagaagccagggttatagaatgatgagacactaaaacaatgacaggtttaatttgagtatcattatctaccttctgatcatcttaaattttgtatatgtcttccccattaccgtagtctttcaggactcttaaggtaagaataatctgaaaattatttcttaaacctattaaatgctgattttgttgattaatcaataaaaataatatttgagctagatatcttctatggtactctttgattctttcatttgatttatctgatcaatcactataagatagtgtatgtggcttatactatgttgtatattatgaatatacattgaattagtttagaactagtccctatacctaagaaacttacaaaacagtggcagatgcagaataaggaagcagagaaatgataaatataatatatccagtagaaaaaataaaagatacataggtatatgaaaaatttatttaggtggcagtatccatataatgaggtgatcagcaaagagagactactctagttatatgaatgggaaaagctgcagactgacatctttcgatcgtttcagatgagatttgaagaatagggaaaaacacaggattggctctatcttacattcagcacacaagctatcaccacctccaaatacatgcaaatagagacacagactaaacaccaggtagtggaagggaatttttactcattttcatcttaagcagttctgcttccctatgctgagacttctggaatttgaatgcaagaccttattaactacctgacaagaaaggtctactcaaaaatcagactgatcatgttttgctaaaaatctgaaatggcccttctgcagcttccatgaattattctatcatggcatatttaagggtattcagtcattggcagatgggcagctatttcctttccactagaaatgcataagtaaaactttctctaaaggaaaaaaaaaaagacccacagatatcttttaaacattcagaatttaaagaggaaaattggtacttgccatttagtagtttgtaatttaaatgacaagggtcaataatttatctgtgttaattggaaccaagcaatagtagtctcattttagttctctaaggctacagggataattgaaggataagaaaattgtagacttgacctcaatattctaactaataattcactgtctcctcatgtttgtaaatgtattttatccaaataaggagaggaaagtttctgaggctgctgataaccttttgctgtcatatgtccattcagatttaaacattttctttcgatgtcctgattctaggaaaaggaatctttcctaaagaatcatcatgataatatatgtccatttacacaattagtcaaaaacttgtatgtatcacctgttgcatgttgggtactggactaatcattgaataaaatatacctgccttgaagagctccctttccaactggcaaaatgtttcacttggaattatttggctgcaacatgtaatagaaagccaaatatggtggctttaataaataaggggtcaggattggcaatatagttctaatatagaggcttcatgatatcacaaaactagcacttccttccttttcactctgccatcctttacatgtgtctgtctttctgatcatcacaacatggcagcttcatctacctacattccttttatgatccagagaaggtaggaaaaagtcaaaggcaaatggcatacaacagctgagatttctctttactcatacccatgccaagtagaatttgggtcacatctctttggcacaagtctatcagcccatatgaccctctctctgtaggtaccagaaagcctgggaaatcaagatgtgatccaggcacattgctgctgcaaatgaaacaagattctgtaaattggagaataagtaattgggaaattacttatttatacttattttcttgaataacatcagttagcaactagatgtttcttcttgatagacttattttgccctctgccccacaaaaaaaaaatgaaacatcaacaatgctatcgcataagtgctatagcaaggtgctacacaaactttggaaatacaaagagaaatacagagggcaagaacttcaaataacttttccaaaaaaaaggtgataactttgatgagttgtaaaaaactagcaaattttcaggtaggcaacaatggggaataactaatccacgaaaaaggattatgaagaaatgcatcaacataaagaatcttgtccagccaacaaaatccaagaatacctttgtcattaaagggaaaactattttgaagggaggatgataaaagtttatatgaatgcaatgctaagtaccttgaaatttatttttaaaaccatagtagataatttaaggatttcatcctgaagaaattcatgattagatggataagaaacaatgagactaaaagctgtaaaattaatccaggagagaaatcaatgaaggcaatagcctaaatttgaataagaggtttctaaggaagaaaaataagttagtgttacacaaagagtttgagtggaaggtaacaattttgttgaaagaaacaattagttttctctgaagagcatccaggggttcaaagagttagagaatttagaaatgaaaagagtaagctagaaatcttgactgcggagacatcagcctataaggcataactgaagtaataattatcgataaggtaactcagaacatatgaaaaaataaaaatataccagatagaagattgaagataatattaaagagatggatgaggaatcgtatagtaaggaagtagattaagaagtgatggtcaaagaaacagaaaatctaagtggaagtagtctcttgataactaatggaaaagataattcttggagaacaagaagaaagggtttaagagtgtcaaatgctaaattctgtaagacctgcttagaaactgctcatcgaatttgaatattgcataatcattggtgagcttagagaaagaaattcagtcaagctacaagagaaggcaaatgatagtggattatgatttaaaaaagcagaagtggatattttgtggaaacatggaggaaaaattgggaaagaaagcaggtgatatgtagatgttgatcataggattgtaacagtcatttgtgtccatgtgcatgtatgtacaagtgtgtgtgtatatatatgtatgtgttgtgaaaaatctgagcatagtataggttgaaaagccagtagggaaatgttttatattcaagtatagaaagtataattaagactattcctgatagctaaggagaaaggagaagggtttttacatgaaagcatttatgcctatttacataaaaggtgccgcaaaactgatttcacactgattatttgctaatattcctttcacaaccaaaatattaagtttattaccatcattttgtgtattcaaaactaaattgatgaaacatcaactgataagtgtataatgaccagcattttgtcattatgaaatggcaacatggtacctttttaaatttccatttcaaataattttacttctcttttcttttttgtggatatctttactctttccaggaagtagtgatagatacatgaaagaaaagaatttttttgtctccattttaaataatgatatttaattgtcaatgtatgttttgacatgaatacaatcttacagttacaaagtcttgtgtgttatctaccatcaaggtttgctcaaattttaactcttgtttttaatttgtattcaaagggaaaataagtgtctacatatattctgtataactgttacaacaaattctctaaagaatatatatttgtggatatctttataaacagcactaaagctaatgtctctttgttgactaagcatgtttcaggcttgactttcctctgtcagtcaattagtctgacttatcctccatatgataagcttagacatttgtcttcacacaacatatacaatttaatatagggtaatagatttaagaacttttatcttgtgacctggcatacttttgaacccaattattttaatgtgaaatgttagggacatattaagagaccctccagaaataccatatacaagaaatcataaatgaaatatctaccatggtatcaaactctaaaatataactcctgggcatgtcattttttttttcactgctacatttgtccagagaaataaaggttattcttgaggagaccaaagtaagacactttaaataagtataaagaagaattaacaaaaaaaacaaaaaaaagccacttgcccaaagaaagaataaatgagcaagagagcaagatgggttatctttgagagaacatttggtatcattgttgctttacttctaaggagtgcataaaaactaaaggtaatgtgaaaaacaactcttccttcaaaatgtttagtatcgggttatatggaaaagctataaacttgtttttgtggggttttcaatttcagtatagatcattggtctgctcctttatgtcaagtagccatttactggaaaacaaatgtttccaaatataatggtaagatttcataattttttcctacctcaaacataaagagtatagaaacagagccttctcctccagctctttgtccttctttgacatgtgcacagcaacacagaggaattcatggcagggcctcatttcccaccccacgtgtgattccccagggccagcgccttcacacttgcatgagtgtgcacacacacaggcacacacacatactcacatgcagaacgttacttcagaccttcacaggaccttctttttctttccctggctctgacttccacaccaagagtggaagcattaatctgttccactctacctttccttattcatctctgcctgacagtgttttcccgggataagagggaagccacgactggaatttataccaattagatgaatggcggcaaataaattgctcctagagtaatcagaagattaaaggggaaaaccctacaatgctgtgagtaatccattgtgataaatgagagagaactgacatgtcattacagaagaattaaatttatcctccctccgtttctgtcccattccctgattaggtatacctggccacacagatacactcccagtttacagagatagagactatatagatataaagatagccttccataaagccaatgtagtatgcccttatataaatgtatattctcctacataagctaaccaggtttccttgaggttaatgaattagaagtggttgagtagacagcagggtaatggggagtatttttcaaaatgaaacacacttatctaccaatacgttcttgagttttaagataatgatccgagttctgtttctgagagaagaggtcacatggctgtttcaaatatatttcttttgaaagtagttttattctgattcatttctattacttgctaaagtatatatattttccacagaatttgattagtactgatgttatttttagaataaaaggacattcataaatatttttagaaagcccattagaagtgtttgaattattatgtgatttatataggataaaatccatgttttggttgtacacgtctgtaagtttggataaatgcatagtcatgtaaccaccaccaaaattaaaatttaaaacaattctggccaggtgtggtggctcacccttgtaatcccaacacttcgggaggccgaggtgggtagattatgaggtcaagagatcgagaccattctggccaacatggagaaagcgcatctctactaaaaatacaaaattatctgggcatgggggtgcatgcctatagtctcagctactgggaaggttgaagcaggagagttgcttgaacacgggaggcggaggttgcagtgagctgaggttggccactgcactccaacctggcaacagaatgagactccatctcaaaactgttccacaccctcaaattttccctcatcctatccctttctagtcaaactctcctctaatgcctgaaaaccatcaacttcctctcagtccctatagcaactcaatttctagaatgaccttcaaaggaagtcatccagcaagcagcgtctggagtctggcatctttctcatggtatttcaggtagatccacgttgttgtgtgtatcagttgttactgtgacatattgaaattcatttatccattcgccagtttgagggcatttaggattttccaggctatgggctgattgtggtgcaccccccacccccaccgcaaaattcctatgttgaagtcctaaattccagtactcataatgttactatatttggagatagtctttgtggtggtaattaaggttaaataaggtcatcagagtgggccctaatcctatatgtcttgtgttcttacaagaagaggagatagctgggcatggttgctcacgcctgtaatcctagcactttgggaggctgagatgggagaatcccttgagcccagacattcaagaccaggctgggcaacatagcaggaaactatctctacaaaaaaatcagaaaaaaaataagtgtggtggcacacacagtggtctcaactacttggagggctgaagtgggagaccacttgagcacaacaggtcaaggctgcagtgagccatgattgtaccactgaatccagcctgggtgacagagcgagaccctgtctcaaaaaacaaacaaacaaacaaacaaaaaaaaaaaaacagtgcaggcacttatgggggggattgggaactcatgaagacaaatagaagaggccatctataagtcaaggaaagaggcctcagaataaaaccaactctgccaacaccttgatcttgaacttctagcctccagagaaaataaacttctgttgtttaagcctcccggtttgtgattctttgtcatggcagccatagcaaactaatataccgtgtttgtttattaataaaagctgctgtacgcatttgtgtacaagttgtcaaaagacaagttttcattttgggagcaaaaatacctaggaatgggattgtcatataaacaatgtatgctaaacatcaacataggctgtctaaagattgtcaaaagtgactgtgtgacttggcatcattcccactaacataccagaaagttcagttgttctgcattcacatctgtacttggtattgtcataactttctccattatgacagtatgtagtggtatctcattgtaattttaatttgtactttctgatgactaattatgctaagcatctttgttgtgtgcttatctattatcaatattttgtaattgaaatatgtttaattttttgctcattttttgttgggttgatggtttctttattaagttttgggaatattacatattcggaatacagtttctttatcagatgtgtgatttgcaaatattttttctagtttatgggttgtctattctctaaacagcatctttcgtagagcaaaaatttttaatttggatgaagctcaatttatttttttaacagattgctgtttttgcatgtgagaacactttgactaatcctaaggtcacaaactttctttcctgtgtttctttctaaaagtttatagttatcattgaagtacttctggtgtgctatgtaaaatatcagctgagattcatttcttggtatacagatgtccaatagttctagcaccatttgttggaaatggcattatgttgcctttgcacctttttcaaaaatcagttaactatatttgtgtaattttatttctgaattttctattctgttccattctgtttcttttatcttttctccagtaacatgttgtcttattagagatgctaaaaaataactgttaaatcacatagtttgattcctccaccttgggtctttttaaaaattgcttttgttaatcttaatttttctgccttgccctacacattttagaattaatttgttgatatttaccaagaaatccttgtggcatttgatttgctcttaattttggtacttaattagtgtatttgggaagaatcgacatctcaagaatattgagttttcaacttcatgaataccatgtatctctccttctattaatgttataatttttatcaatgttttgtagctgttaaaataccaattgtgcacatatttttgtaaattcataaacactttattttttgtcattctaaaagataatttttgtatgtttccatttctaaacgttctttggtaatatatagaaatattgagtttgtatacaaccaccttactaaactcacatattgagcattttaataggttattttggatatttttatgtggactgttatgttgtctgaaaatagaaacaggtttgtttcttcctttctgatgtggatgttgctgatgtttattaccacattactgatctggctaggaccatcagtattataaagttgaatataagtggtagaagagctaacttcttgccttggacccagttttgaaattaatcagagagtcgccattaagtgtaatttagtggcagttttggtttttttgtttgtttgtttgttttgtagatgccctgtatcaggttaagttcccttcttttctaattttgctgagagtttttataaagaatagatgttgaattttgtcaaatgcttttgctgcatctactgaatgacgtttgtttttcatctacctaatcatattgaaagttatatctgttgagctttgaatgttgaaccagccttgcattcgtggtataaatcacttgtttgtaaagtattttttaaaatattgctagatttgatttcttaatatttttatatatgttcttaaagggatatcggtttatactttccatttctctttaaagagaaatgatgatgagagagattctctctctcgaagttctaagtgcctgtgcattgctgccactacacagctagtatcatgacagcagcttcagaactagagctggcttccaggtagagctgagtgggaaaacgaaaaacaaaaggattatttctctatatatgatccatcttacagaggccacattcctggttctctagctagaaaaagtagaaattttgcacaccatgggttagaaaaaaaagcccattaaacccacccctgttacagatcactattggtattttgattttgctttcaatccatctgttattgctcacttttaagagtccttggtagttgctttttatgtccagagtttcaatttcaatcagtaggagaaataggccttggtgagcatgctttgtcttggctggtgccataagtctatactcaaatatttttaaataatttttagttgaataacaagttggacctgtgctcagctttctcattgttttcctaaaagtagaagaaaaggttttaaatactttaaccactaaataatttaaagcaggttgaaaagaaactccttctttttgcctattgtgtattagtctgttcttacactgctaataaagacatactcaagactgggtaatttataaaggaaataggtttaactgactcatagttccacttggctggggaggcctcacaatcatggcagaaggcaaatgagcaaagtcatgtcttacatggcggcaggcaagagagagcatttgtgcaggggaactcccctttataaaaccatcagctctcatgagacttattcactgtcatgggaacagcatggggaagaccagccccaatgagtcaattacctcccactgtgtccctgccacaacatgtgggaattatgggagctaaatatcaaaatgagatttgggtgggaacacagtcaaatcatatcacctatatacattcacattaggattttagtttttttttttttttttttttttttggagacagagtcttgctctttcacccaagctggagtgcagtggcgcgatctcggctcactgcaggctccgccccccggggttcacaccattctcctgcctcagcctcccacgtagctgggactacaaggcgcccgccacctcgcctggctaattttttttttttttttttttttttttgtatttttagtagagacggggtttcaccatgttagccaggatggtctcgatctcctgacctcgtgatccgcccgcttcggcctcccaaagtgctgggagaattttagttttaaaactagctctttgttactatctgaattaatttttccacaattttgtaaggaaaaataatgcctcctttgaatttcatgtgtagatgagttttttagttttgtgtcattttgtccaataaattctgaaaatatttgtattaagtgtattctctctgcacaactatacatataagagcgctcaatagaaagaataaagaggaaaaagcactgggtctatatttatacaaaacaagctaccagcatagcccactaggagtggtcatgatataatcaggaatgttatattcacaggttgtagatctgcatatgagaagagggtttgcagataacagattctataaaagttgcctaatcagacagtaaatgcaggtgttgaagtactgaacaaaaataaactgctttaattactcataagagggaagtacaagtcattattccatccgctaatttacagactgtaagataccctttaaaagcagcagtaagtaaactcttgataaaatttactctatgacaaatcaactgcctttcttcctttgaagaagtgcctttctttttaatgactatctttgtgttttgagatgaggtctctgtcacccaggttggagttcagtggcatgatcaatcactgtagcctcgatcttcagctcaagtaatcctcctgcttcagcctcctgggtagctgggactacaggtgtgcaccatcatgcctggctattttttaaaatttttttgtagagatggggtctcactatgttagccaagctggtctcaaacttctggactcaagcactcctgccactcaaagtgctaggattacaggtgcgagccaccaagcccagcctaatgactatttttgaaaaaagaaacacattactctcccttgttaatcacttttatgtacaaaaatgtgttttaatgttgatctgtttagtatatcattttctttctacataaataacacatttatacatatgtatgtatggatatatttgtaatgttaaaattgtgtttaagtgatgtttactaaacaggataaaatttcatttggaaaattgagatgtgaaattttatctagttaatctgtagtcctttcccttatggtgtccagctctatgcagctctgcctccagattatgtaaatatcaattcatattcaaatgaatttgaaatttagctttcaacatttgccttttcaattcttcttgaaattattgtggtaatattatttcctatccactagcatactttttaatcccaacagcaaagtttctgaaaagaccactagttcttcaattgaacacagttactgacacctcactattcaacaggaggatagagatgcccacagcccctctccttcaaccacatacgtccaagtaaaactggtatttttttcttttaaaaaatatagacataattattttccatattattgaatacatttctattgtaacctcagttccactcttcagaatcctttgttcgattttcttctggttgatctgatccactcacacttctctactagttgctccagagccaatgggcttagtcacagggtggggagtcacatttgtgggggttgggtgaaagttctggttcaggtctgcatctctgttcaccatcatttatgatgatgctgtaactcacttctgctctttgagaagtcacacaaacaattgctgaattaatctgtcaggtctaactgtcattcagctatgtctcaccgagcctcttctggacaaatccgtgctgttctcaagaatacttaggtgattttatcctttgtggaaaggctacaggcaatagatgcgatagggagaagtatgtggaagactgacccccatagctgttcccatatgcaacttttgaatcttcttcatttctgcttctcttcccagttcttatccatggtgatttttggaaaaactgcctctacattggcattgtgtgtactcagagtggagggtctcttcttcttagccagactatcaggacaattctattcaccttcagacttccaaatgtcattacatcttcttagtgcctgacctccttttctctcattcacaggatattcatggctccttttaaatgggatagtggccaagtgaagagtttgtcttttctgaaaagattgctgaaatgtgaggaaagtgccaaatttatttgcttataaaattttaaaagagaaaaaaattaggattggaatgaacgtaaggatattttcatccaattacctcattcgattgtaataatcaaggtcagaagaaataaacttcagtctttgctagaagcaacttgcgacaaatcacacatctacagactctgccattcatccagtgacagcagcaatgttccaaacatcacatggtataccgaaatatagcaattaaaatagttttacagatgcagatcaagcagtaattactttgcccaggaatcttaaaaagaaattgtatgtggagagcaggaagcttaggcaatttagggtgccttttgtctttgcagtgacaatttaccttgggctctcagtgacgtttttatgggttttaaaacacagcgcttttttttttttaactttttttttaatctgctggcccttttgcttttagcagccatagacttcttggcctcaaaggctcagatgtccgaaacttctgaagagatactgccttcagctgcttctcagtagcagcgaggtgtgaacacgtagctccgattacgcttctgcttgcttcagcctgctggtgcttaattaggtgcttatcctaacgccttagaacatactttctgtagatggtttaattccaaccatcatatatgctttttctcagtgtttctccagcttctcaaaacttccctgtaaatgaggccttgtaggcagttttcttgctataacctcaccttccattcagcacagaaacagcatccattgctgttacgcaatggataaaattgtgtaataatggttatggtttcatacctttaatgttagtggcagactttcctcctggcctataggtcagtctttttttttttttttttttttttttttaacatttttagccatctaattttattccttacattcattcttaaagaagcaaaaaccttttttatctttctcttcagaatggttaaaatatactggcaacaaaaaaaagcaatttttacaaatgatttaaagcatgcaaatcatttgcttactatttttcacactaaacatacaaagaatatagacattatgtatgttccaatcacattgatcctgcagaaaataactattctttgatactggttttcctttgatcacaaatagatgtgagggcaaaatgccctgtcttatcacttatttataaataactgatggccaaaatggataattgtcatgatagaagttattgacactggctgggtggggtggcttatgcttgtaatcctagcactttgggaggccaagaaaggcaggatcacctgaggtcaggagtttgaaaccagcctggccaacatgtctaaaccctgtctctactttaaaaaaaaaaaactatttggttttggtggcgggcacgtgtaattccagttactttgggaggctgaagcaggaaagaaacttgcagcctggaaaacattcacaagattgttatatgacatttataacaggagtacttcctatatcaacttactagaattttggagactgactttaaaatatgataataaaaaagaaaaggcagggaattgaactttcttctcatgtttattacaaattttacagggagccagagtctcatttatgtcaccttagattattttacaagtttggacttgcaaaaatgtggcaaagtttgaatgcctgatacctttttttggaaagcagctagaatatgtaatgcactgaccttttggtgttcattttgattggttaatgattacgcctttacagctccgtcagattgtaaacaaggggacaaaactgaatatataaggtcagagaagtgtagtgacaaaatttatgaatgccctatacatttcctatgaataaaaaatgattaaaattcatatttgccttttaaatacatacataagaaacagatattaaaaattaattcaaagcatacattaccaaatatattcttaattttgtattgaataaaccttatttaggtgtacctttttctacgaagatgtcttcattaaactattttccaaattatttttaaagatgaatagcattgagtttgcatatagttacgatagtactgaaaagtcctcaaaatttaggttttcgttttcagctttgtttctcttttctagtgaataatgacttaataaataatcatttaacaaaatcgaaatctcaaaggtacatataaacaatataaataaccatccttactacagttaactttgtgcttttcttttaaaaaaaaaaagcatccaaataaagacagacatattcatgtaataaaatcttagcaatccctgcaataatctgccagaattatcagccctcccatcttaactccggacagaatgaaaaaaaaaaaaaaaaaaaaaaaaactagttctctcatattattctttgagctccaactaggaaaaattactgaaaacagccagatgttacaactgttttgagcagggaagtcacaccgtgcaggaggactccatggtagaaactgtttaaaaaaggttctttttacttgaaattacacaagaaagcagaaaatgacattgcaaaaaggaaaaaaagtataggcaggaacattgttaacagaagccaggtgacaatgagaagtaaagagtagaaagcaagcaacacttttgaccattgagaatgaggaaagtggaaattgaatggctcatggataaaaatagtcacccacatgttaataacatatgtgttctgcagagtcagacttctgcatacacagagagcatctctactgcatgcatgaattgtgtgtgagtttgctgataatgaagagagacaagctgctgcatcaactaatatactctgggagtgaagagcaggataaaaaaaaactgtagagaccactactctaggtcatttaagtattttaaggagagaaaaataacataatagaagaaagtaataattatctgtaatggtgggatgggtggcttctgacacagctctcatgtttctgattccacctcccggtatcttgtgttatctccccttctggagtatgagctagacctggtgccttgctgctaagagacagaattcaacaaaagtaatgcagcgttccttccttcgttaggtaacaaggaactatgtcttgcctcttgctcaccacccccaactcttgctggcattccctcttgccctctcgcttgcttgctttgataaagggagttgccatgttgtatgatgctttctggagaggcccatgtgacaaggaaccaacggagtctatagcacaacacctggcttaaaactaaagccaacaactgtgtgagtgaatttggaaataaataattccctgtctagccttaagatgacttcagacttttaaaagagtgagagtcagaggccacagctaatccacatctggattcccaccaacaaaaattgaaacaataaatgtgtgttttaaaatgctaagtttgggggtgatatattacatataaataaataataaagatggtttggcatggagataatgacagaaaagaattagactattttaatagtccaatgaagaggtatgaaagatctgaatttcagttgaagcaacgtgaatgatgtaaaagataaatgtgagattctataagattttataggatctaccaatatcgggagtaggaggaggacagagatgggagagagaaagggagggggaaagagaaaaggagagggaaaagaggtaaatgaacaagatgtttagttcaagtcagtgggaaaatcattggtagagttgtattatttaagcattgatttaacaattactttctgagcatctgtgatgtgtaagacactatgttatctgtactagacactgagatgaaccctcaaaatggtgatgccctcaaaatggtatagtgcaaagtagtatcatgtgaaaatttatctaatgtagaaattcatccaattagcatttgaggaaagatatatgtgagttgagttggactttggatagtaacatgtaaagattagcattagaaaggaaacatttgttttttggtttttttttttttttttttttttttttttttttttttttttttttttttgagatgagtctcactttgttgccccggctggagtgcagtggcacaatcttagctcactgcaacctccacctcctgggttggagtgattctcctgcctcagcctcctgagtagctgggattataggcacgtgccaccacacccagctaatttttgtatttttagtagagacagggttttgccgtgttggtcaggctggtcttgaactcctgaccttgcgatccacccgccttggactcccaaagtgctgggattacaggcatgagccaccgcacctggccaaaatatttcatcagaaatataaagtcaatagtttattttcactagattgcaggtgtatgaaaaagacaactggaaaatttctatcaattctcagcctaaatttaacatcttattctttagtgatatcacagtacaagtaaatagatgtcttgcacataggacaaattatttaagtttgttgaagtagtgagatgattgattttatttttaagtaataagtaatgtgggaaaatctgcaatcagtaagatttatgtggatccaggctcaacaaactgctgctgatgggccgaatctagtctgcagcttatacgtgtaaacaaagttttattgggacacagccatgctcattcattatgtaatgtctatggctttgacagagactgtgctacctgcaaagccaaaaatatttactatctggccctggacaggaaatgtttgtcaatctctggtctccatcataaaatggatttgagtagagagaaaaaaactcattaaaacatgtagggtgttaggtccttaaaccagtaggatactaacaatagaaatggaaaggaaaagttggagtgtgtgtgtgtgtgtgtatgtatgcatgtgtgtgcatttgtgtgtatgtgataactgcttaaatgcagggtacaatatagaagaggaggcagtcgtgcttagatggctctgaattgacagtttcctccatcaatatttaagtgcaattttggaggaatatgcttttccactcaacccttaagtcaagtggtttaatcagctggtcatatttttttttcctaatggttagaaaggataaactactcagaaggaaaagtagtattgattgagaaagaattataatggaagggggggtgattgcatacttctaggaaagtttgaggaaacagcgaaaaaccagtgtgttactgaacacttggatgaaagcgtgaatgaaagcaggtgagagcagccttaaaaggaagctagtttgaaccaaaagtaaacactgtttttcatagtgcctcatatatatatgtgtatatatatatgtgtgtatatatgtatatatgtgtatatatatgtgtatgtgtatatatatatatcaaaagatgctgatacttaatgtataaattagaatattagcttttttaaagtatgaattgaacttatacagggtaaaaaaaaaatccaatgatttaaaataatcaggttccttttgttgtttaaattccctactgatagaactaaatagggttcccctaaacagggttcaaggagtagaaacatacataatggtactcaggattcaatcgattaaatattaatattccttgaattagcagagcagaactaagcatccgaacaccagatacaggtctggaatagcagatacatctaagtaggtttcagctgtctaagggcacatgcctagtacagggacatgaacaaaatgctgggtaaacagggataaaagctctatgagggatgtttaacattgaaatgtataaagtttttatttaaccacgaagttttctatattggctaagattttataatgataatgaattattcatgtgaaaattaacttttttttgtattttcaaagaaaaaagcacaaatacacccatagaacagtgtgaaatactatctttcacaatgtacaccaggccaggaaattattgggttgatttgagtcaacaaaatttcactttgcgatgaaataagacaatcctggagggaccagggtttccatttgcctgggctccttctgatggcatctttactctccaggtgaagggatgtttctgagatcaatcttcctctcctttgatatttaccttcttttaaaacctactgaatattgacttactcagcttttccctattcttcgggtttcctctgggtcctttgataatagatgctggtatccctgtctgtcattcactcctatatggttctcagggtttgttgttcctccctctgctaacctgagccctacaggccaaagtaaattactctcccagcaccttttatagagagtggttcatagtagttttcctgacactttcaccagtgacacctatgttattacacatttctctccaagaacatctctaaagcctttatgatttacacatttgagttaccttagaccaactgaccaaaacacaagatatgctgtcacattttaagctgcttcctcagaatatgttggttgaaatctactgcctttcccttgtcctgggtttctaaagacctgtagggtagtttctcaataacatatcttaataatatctcagaatgattgttataccaacaagacatttttacttcattactctgtcagagaactcggtctcattagcaaaacctgtttagaacagccatcttaaatccttgttggaccaattgcaggcatgcttttaatttaagaagtaatcctggccgggtgtggtggcttatgcctgtaatcccagcactttgggaagcagaagcagctggatcacaaggtcaggagatcgagactatcctggccaacatggtgaaaccccatctctactaaaaatacaaaaattagctgtgcgtggtggtgtgcacctgcagtcccagctattcaggaggctgaggcagaagaattgcttgaacttgggaggcagaggttgcagtgagccaacattgtgccactgcactccagcctgggtgacagagtgagactccatttcaaaataaaaataaaagtaaaataaaatcttcaagaataccaaagcaactgggagccaaactcattgcaagggagagagcctgcctcaaaaacatggccaacccccttgttcaacacatttctaagattttgaagctgaatagggtgaaatgctaaaggcctaagctcaatacccctgaaatttaatctccaacagaattttgagactaatgagattaaatctgagactaattttgagactaatgactaatgaagtagttccagcaagctctcaatcaaaacctcaaaaggatcatacttcagaaacagagataagccaaagatggcagagtcttactgaaactaaacctcaatcctgactacttcaatctctgattgtattgataatgactttctcccaaccctatcttctcattagagaaaagtgggaatacattctaaaactaacattatcagaatacttcattattcttttatatagtgtccagcatgatacgaaaaatgtctagatatgtgaagtggcaacaattttattaacaatcaacaaaacacatgtgcacaataagcacagctccacagattcacagttcagaattaagcggacaaatttagaataaccattgctaatataataaaagtagacaaactggatgaaatggagattgtagcaaagatttaaatctataaaaaatcatagacattctaaaacagaaatacaataattgaacttatgtcactgaataggtttgcttttgaataagtgtggtaaaacaacctgaaaagagattcatagaaataatgtaaattgatctgtagaaataatctcaactgatgagattgaataaagcagaacaaaacaagaaagacatgaggcacagtcaaaacatctactataactgaattggacataaagacaagtgagagagaatagagaataagcaatatcagaagagccgttggtcaaaaattttgtaaaattgataaagaatattaacctacttgcaagaaagttaacaaaacctaaggaacataatacaaataaaaccttacctgactagattataagctgctgaactaaaacaaaagcctcaaaagtaagtaaaagagcacagataagtattccaagaaaaactctggaagctggagacaatgaaatggcattttaacatgctgaggggcaaatttgccagtctaaaatttaataaccagtgaaaaacacaaaagtgagacacagtaaaatatatttagacaagtaattgttgagagaatgtttgcctaggagacccgaactacagaaatactaaggaaagttcttcggactaagaaaaaattatcccagctagaagcatgcaattagaggaagcaatgatgttaactgaaaaaaaaaaaaagtcttaaaatattggcacaagaagttctaaaaatctgagtaagttctgtatctgttatagaaactatatgattaacacattttacaaacacacacacacacaattccaaccacatgtggattagctggtgaattcttaccaaaacttaaggaactaattggactaggcttacacaagcattttcaggaaataatacaaaagaaagaacacttaattttttgtgggaagccagtaatcattgacacaaaaatctgaaagatgttgtaagaaaagtaatttataaggaatattcgccatgcaaataaacatgagaagtaaggataaatataattaacttgtcttttagaaagtttaaatgttgtataaaatatatgacaacaaagagtgggagtagccaaatagtgtttaactgtcctaaggtccttatattgttggagaagtggaaaaagtgctaattaaggtagtccacaatagtctagaataaataatggattatgtagataaagtactgaaaaggaattacaagtattttaataagatgaaaaataaataattattctaaaaatggcaaaaaataagaaaaagatagtaaaaaaacagaaacagaagattaaatccagaattaataaagaactcttaaaaatcaatttgaaaaattcagaaaatctattttttaatggactaatgacttgaataggcactttattagcagatatttaaaaacctaaaagcctaagaaaatcattaattgctcagaaatgcaaattaaaacggccttaaacaccactatatacccactaaatacccaaaattaaaatgaccgataatatcaagggtttcagaaggtgtggaataactaccactcttatagactgttatgtgaatgtaaatctgaaaaaccatattgaaaatttgtttggcgatatctactaaagttaaatgtatatgtaccttttgacccagcaattccactcctggatgtatatattcaagatcattgagtacttcagtctatgtcagtctatcaaaagatatgtataagatattcaattagcgttatttatagtagcccaaaattagaaacaggtgaatcatctaataacacagttatatatttataaaatggaatacccctattaaaattataaagtatgaactataggtatatataagaatctcataaatgtttaaaacctaatgttgaataaaatcagtcatatgcaggagcatgtatactgcatgatactatttttatgaagctcattaatagcctattaacattattaatggaatgaatctatgtaaacagaggtcagtataggagttacctttttttgggttgtggttattgactgagatggcaagaaggtttatggggtatttctaagatgattttttttatctaagtttttccatgtatatgaacctatgtgaaaattcaataaggagtatacttaagatctgtatactctgttacgtgtaaattatatattaatatttaaaagaagaaaaataagtagattaataaagcacattttgcctatctatgacccaccattatacacttaagtatatacccaacagatataactgggaattttttacaccaaaagacttttattacaatattatttttatatccatacactcaaaacagttcaattgtccaccaagggcagaatgtaaacatattttattggatcattgatataatagaataaaatacagcaattaaagaaccgttgctacatctgtgatgtcacaaatatgcttgtattcatataaatttcctcaggaaaaaatgaagctatggtagaggaagtcaaaagagtgttatatttggtggaagaaaattaatgaggcataaaagaggcttctgaggtgctcttgtttatgatggtcacatgactgagactatattgaaagattgtgaaaatcgtacatgtatgatttatgcactttttagtctataacaatgtattcatttgtgggagctattctccagggtaccacaaactgggttgcttaaaacaccaaaaatttattgtgtcacagtttgggaagcttgaagtctgaaaacaagatgtagtcaaggtagtttcctccagaaggatatgagggaggctgtctgtgtttcctgaatctcttgcaggttctggtggtttgctggaaatcactggtatacctgagtttacaggtgtgtccgcccagtctctgactacacgtggcatattctttgtgtctccgtatagtcttccctctgtgcgtattcctctgtgttcaattttcccctttttataagaatactagtaatattggattagggcccaccctaatgattccatttaaacttgattacctctgtaaagaccctatttctaaagtcacattctgaagtattgggggttaggacattagcatatattttggggaaaaacatatttcaacccataacatataattcaatttttaaaatcccaaaattagcctaaaatggaatgaaattgaaataaatatcacagaggcctgcaatatggcttgattatataatacctatttctaaagcaaatgttacaatggcttgagacatattagaattgaaaatttttgagctataagacacataagaaattttaagctcctcatttttttttggatgagacatttattagtctcaacaagattgattttcttttaaggtcacacatttaaatagttaacaggagaaatattgaccagaatcgtagtcaaatacccacctaccccctttccaagacaactaaggtttcaaatggcacccatttttctcaaattatttctagaatatttagcaaaagaggctttcaatttggcatatctttgtctacaattttgtagtttatgtaaagaaaggtagcttaagggaatttcattttaaaggtgagaatcagaatgacatttgtgaagctatgatgctgtgccatctggcgtacacgagggtgtcgtactaaatgggatcagaatgagctccttttggaaggaaacctttaatagactgggaaactttaggggaaacttccctttttaatagagcatttgaaaatgaattctgcatagctggctaatgaaggaaatccagatttgttgccaaaaccaagttttaaaggaatttgcaatccttcacagttcattcaaggaggcaatggaaattttgatgaagaaagtttttaaaatctttcttaaaaggagcccttactttggcattgtatcatgattaaagtcttcctccctccctctctcccttctatgctttttgtttcttttctatctttcaatgacatcagtctcatggagataaatggttaaaagacaatgattacaacacacagagttgagtgacacaaatcttgttgtagtgttagaaatacatcagtacattggggtcataaagcgaaaaggcaagggaaaaaaatctaagttaagaacagaaaatgctgattcccgcagtccatgtagaaaatacatgtttttttctgtccgtggagataactgagattagttagtattgtcaattctgtgccttctgactgagccaggtgaggcaaaatttagcagatgagttgagggacgaaaactattaccttggcaatatagacattaatactgtctacattgcttactgggaaatgcatgcaaaattaatacactcttggtagtatgggttggcttcacttctgtagagtgtggttaatagaatgctgattcaacaggcaatgtagaattgtctaaaattcatcttcaatgagttcatggcatattttggaatttattcacttgtttgcctcaggaacagtagctgttcagttttgttctgtctttgattttgaaaattaggttactgtgctctgtagtgtttggaagatgacatggcataaccaggcaaacagctaggcattttctcacagtgaattaccagtgcccttacttgtcatgatacccacaacaggcaaaggcagtttcctgaggcaatccaggccacgaagaactgtacatttggggaaaacatatcttcaaatatatacgttaaaatgtaaaaagtgttagtttgtattacttttgtggatatttaaacattccctatgcatataaagacctagttaaagagatgaaggcttttggcatgttcaataagcaactccttgatgagaaaccacactataaatataataaataggacttaataaaattgaaaaataatgagattagttactgttgaactatttttgcttagaatgcccctggatttcagtcatagaaattcacttgtacctgggtcagttacaagttcttatttgtgatggtttctgttccattggcaattacaattttgataagttgaataaaatatctttctaaaagggagttcttatattggcaatgtatcatgatgaaagttttcttgcctctttctctccctcccacatatacattttcgtgtcagtatatgtatatgtgatttgtgccattcgtgtgtgtgtgggcaaatgaaagtggcatcaagaaaatcttacatttaaaaaaattggggtagtataattcttatgcatcacatactgcataatgtttgactattaagaaatttgcgtcacacatctaattatttcattaaacatgttagaggcaattaatttacttataccctccatttccttttcccccctctctggttctcctgctgcagggtcattatacattgcttactcacaaaatgtccttgtttttttcccttactcctgtcattgatcttctgaatctttccagtgaacttaacatggatgttttgatagaaagctctgacattaactctggagttgttttgcaaggcaggttgtttgctttttcacaaatttttttcaggtccttgaagtgttttcatatagatgtttcacaagagccatttcagaattgagaacatttggcgtgtactcttcctcttttggtcccacgatttttctgagtcctacttgaggttatgttttctcccctgtttcaattgtaatatttcacttactcgttagtttttagtttgaactctcctgggaggtctaatgtagagtttggacaacgacacaaattcataataaacctacccagtcaattttggtatgagggcttagaaggtggaactggccacattttgaaccggaggtaaggatcaggaatggtaatggagagacatacaggattttcttatgggaaaaagaacaaataacctctgggcagtattagagccaagagagtgataagccttttctaacttcaatattctgtgtacaaattcacaagacttttataaattgccagactgcattgcataaaccaaatgccaacagagcagtgacctttcaaattactggcacaacaggagccgagatcagaaagttcaaactttaaaagcaaacactgacaagaaatccgacagaaatgacttcggtgtctggtcaacttaacataacatgacacattgtaaagcgcgttcggctttttaggtagaattgtctataaaggtttaactgctttagaaaatataaatgtgaagatttgtggtatttgggtttatgtacacggtatttctacatttgaaagagacagtagaaaagtttggtataagatttgtaaaatatgtttgtaatcatgctaatggaagaggtgagagttgggtggagtggcgtgtagatggaaacatagtttggggattggggaaagggaattatgctctaaatagtgagtcatgttatataaagtctgttttgtgtctcaattgaaatatgttgtagagataaatttaaaatagatcatgatggattttgaatctgatttctaattttaaaatattacgagcttttgttgctttcctatttcatacacatttccttatgggtttcacttagtctccatgaaattgcagatgccaattaccttttaacaaaattaaattcacatatatttataattgcatgtatatatccataattttttattctatacatgatatattatttaaagatggtttatcaatcacaaaataaaaagtataatttttctataccttcagttttctggtttgaattttttctggcaacactaattttcacctacctatactcattatagtataaaagtgtacaagtgcatattttaccatgtttacatttgaatgggtgactagaggtacatctatgatgactaatactttctaaacacatatttacttctcatatatctgtgtaaatgatcgtaagaggaagggaaaaatggagatgtatcattatgtatactgtcttaaagcatattcatctgctctcatgtttggagatatttgaatatgatgaatgtttctctttcaccactaacaggttgtatgtgtgagccagatcttattgcaagtgtttgaaaggctatagcaaatatgggatattgccagacagttagtaaaaagcaaactgattctattgagaaattaattcaccagctgaaagaagtacatttgcttaagagtcatcagatattctacccaccagactcatctccaagatagcatccctaatgagcttcctaaaccaactaaacataagcaggaagcatcagtcatcaaaactatttttggctaatcagctgactgcacaaactgcatggcattgaggaaaggaagcacgttccgaaagttgtttttttttttcatcctgtcctcactttgttggtttctcagttttacggatgcagtgtcatgcgcagaaccctgtaaatgagcatagttcgttcaagtatataaagtgctttcccatgtattattattcagtagaataaattgaatttaacaagcttaagtgatttgcctaaaggcacacaattaatgtgtggctggaattcaaaattgtgtcttttcctctgttctaattgttctataactacaggtgtagtgattgactttgtacccaccatgacagggaataagttcaaaacttgaaacactgtttattttataattaggtagacgcaaatgacagagtcaaggcagagtggggagccagttaatgttactcccatatgggttctctcctccaatacaggattggggtagcagtgtcagctcctactggttataacgatcttaatgataaagttaactaaccataactgaatactcataatgtgctagcatttttcataatgtatctcaaataatactcacaaaaccttccaaataaatattacctttttgttgtctttgttttattttgtttcattttgtttgagacagtttcactctgctgcccaggctttagtgcagtgatgcaatcatggttcactgcattgtccacctcctgggcttaagcaatcctcccacctcgcctcccaagaagctgagacggcaggcatgccctaccactcccagctccagataaatattcgtattccatttactaatgcagaaaatgtgtggcccagagaagtaatgtcaagtttgttggggttttaagttttaaaaaattattttatcaaaccctaatgtaaactatggattctgggtgatggtgacgtgtcagtttaggttcacctattataaaaaatgcatcattctggtgcaggatgttgacagtgggggaagctgtgtgtgtgttgggagtagggagtctatgggaactcttctactttccactcaattttgctgtgaacctaaaactactctaaaaaatgaagtttattaatcaagaaaatcatcttgtatgaatatatgggacagctattcatgtatgtggtaaaaatgagagatttgttaaagtatgtggcaggagtgtgtctaatacgattgatattcatgtgtcacttataaaaactggcttcttggccaggcgcagtggctcacacctataatcccagcactttgggatgccaaggtgggcagatcactaggccaagagatcgaaatcatcctggcaaaaaatggtgaagccctgtctctactaaaaatacaaaaattacctgggcgtggtggtgtgcacctgttgtcccagctactcggtaggctgacacaggagaattgcttgaacccgggaggcggaggttgcagtgagccgagatcacaccgctgcgctccaggctgggtgacagagccagactccatctcaaaaaaataaaaaataaaaaataaaaaaaaataaaaataaaaataaaaatactggcttcattatcaatctgtagattcatttcatttgtgtatgttcgcttaagggtgcatatatggaaaccctttgttgttattaaaggtttgttgggaagggctcctctttggtggaaactatgtctatttcttgaaagcgatttaagagtaagatgtgaaataataacacttgccccgaggatggagccaacacagcacagagcataggggagttatttgatgctgtctctgagggattggaggagaggaatataaacagcctatcccttgagaaagaataggggaggacttccttacctgatatctcagatcatgaagctacagttctgtccctgctgcaggggaaaaaaaaaataacagactttttgcaaaaatccatttttgaaaatattcctatattccagatttataatgaagcatttttgtacatattaaaaagggtaattagaacatttttctctggtttatagtaactaggatggcaacacaaatatatgttggaagtatttcttggtatgattcttcaacattaaattgttttaaaaacttagaagtctccaggtactcaggaataaggtcattttaaattattccttattggcgataagaaaaataattaagcaagaccacaaaactaaatgtttacactgtctctcctgtttcctgattttcaggttattttttatcccaattttattttgctgtatagtcatatatttcatttttgaaataaagtatgtaatcacttcttaagaaccaaggctatgccttctcttttgatacggatgtttatctttcaaaatacgtgttatggctgggcgcagtggctcacgcctgtaatcccagcactttgggaggccgaggcgggtggatcatgaggtcaggagatcgagaccatcctggctaacatggtgaaaccccgtgtctactaaaaatacaaaaaattagccagacatggtggcatgcgcctgcagtcccagctacttgggaggcttaggcaggacaattgcttgaacctgggaggcagaggttgcagtgagccaagactgcgccattgctttccagcctgggtgacagagtgagattccgtctcaaaaaaaaaaaaaaaaaaagtgttatatttagaatatactgaattaatttcatgggatgaataaatgaatcagttcatctgccagtcaataagtgtaaaaccaaagtttttctagaacatcagggtctttgatgattttcagagaagagaaaacactattccattagatatagagggcattgaaggcagggtaagcttaaattatttccaagttcaaataaataaatcaaaatagatgtatttagcgtctacaatgtggtaagtactctagtcatgatggaaggtgatggaaagcaggttgaattcttacctttgagaaatttattactaatcagaaagatatgacacgttcaagaaagtggattaagtgcaagtaaacgatgcagagttaaaattatcacagaaatatgtgcgggatggaaaaagaggtatttgagtttgaatttgaaaattaagtagataaaataagaaaatgaaagggtgtattctatgtgaaggaaaaacagcagttggaagtgagaagaatgtaaaagaagcataagcaaaattctagacataaagtcatacaatttctggaagaacagattgatggttctgcagtagaagctgggtagcggggagctgtgtttagatacaatttacaagcaaaacaaaataatacataatatggaaccttgacttctgggccaaatttgaacttttttcttggcgtcatttctaaaagcatgtcagtggatgttcagtgagggaagaggggtaattttcttaggtacatttagaaattgtgagacaaatctcatatagacaagattgcctcctgcaaaatttctcatgagggtttagttctaggaaattaagaagcggccatggtatgcatttctcaaacatttttccacattttatcactctttctgtgacccatctttttggattgataactctcctctagacacatgtcatgttgggaaccagtggttttgacagtaaagaatcacagagagcagtaaggctgaaaaatgacacggtgaaagtactgattttaagaaaataatatggtggtagtgggtaggagagactaatggcccctgtaatgagggagctgggaagataaactgtaatgacacacgaatagtggagatgagcagttttattttaagacagaaagtggtagagttcatctcacttccagttgctgcttagaggtgaactacagagaaaaacaagggctacagataaggacttgagtgtaatttgtatacaagtcagagctcaatctgttaggatgaattccaagaaagagactaagaagtaggggatttatattattaattgaaacacttccatgtggatgttggaggaggcaagagagaggaagtgaggagaaagataagcaaacttttaagaagaaatcaggatagtgtagttaaagaaaatttgaataaagatcttattgtgaaaagcccattgtttttgttgattacaaatttactggaaatttctgcaaatcaagttttattacaatatgagagtgaaagtgtacattgtggatgtatgataattgaaaagcgagaaaatgaaaatgatcaggcagagcctccatgcaaaggaaagggagatattgaccctacaagagggctagggtagtactggggactgagaatcacgaatcgggtgggatcctggatatatctgaatcacgcaattatatttcttgctcagagacttggaaatatagtgagaggggttattaagaggtaaataaactgaaaaggtttttctgagagcttgtttccaagggtaccatcttctcaggaaggtggtatcttacagaaatgatgacctctcattctgagaaacatgctagagaatcaaaagctttcaaacacaattgccaagcagtaaatgtggcccatttgagggttagagagtgtattcatgtattcattttctcttcctgcatagcaaattactacacatgtagcagctcaagacaacatccatttactgctcactattccacagatgagaagtctgggtgggctcactgctcagggtctcacaaggctgaaagcaggttgtcagcctagcttgactcagtttgggagctgagggggagaatctgctcccaagctcgtctaggttgttgagagaactcagttgtaggaatgaagacttcaattccttgctggctgcaaggcaggtcactctcagctccaagaggccactagtggtacagttccttgccataggacctttgataggccctatcacatcatccaagctcacaccctcaagggcagcagcatgggcccctgcatgcaagctcctcaccctcacatctcatgcttggaatgtctaacttctggtgatagtcagaggaaactttgggggacagtgggagggatagcattaggagaaatacctaatataaatgacaagttgatgggtgcagcaaacgaacatggtacatgtatagctatgtatcaaacctgcacgttgtgcacatgtaccctagaacttaaagtataatttttaaaaaagggaaaaaaatcatgtggttgcattattccaagcagatcatctccctttttgtaaattcaaaatcaactgattaatggcatcagttacattgcaaaattccttttgtcatgtaagttggtaggcacgactgacatcatattcacagccccaggggttaaggtggaaaatcttggtgtccattttgctgttctccttagcacgaatagttaaaatatagttttgtgtagttttatttcttaaaaatttgagttcatgtgcctcagacatttcctagaatgtcactgaagtgatggaggaaaaaaatggagaaaacagaataaatgttttttaagtcctccattatatttaacaataattacaaataaatgaataattctgacaatatatccaatcactttcaaccaaaatcaatttcttaaaatagtaagtttggttttaaaaatcaattatctttctgtttgtgtttttgagttcatttacctggctggatcctcataacatatacactgttggtggtgttaatgagagtccatctgtgttcttgccacgatcccagtaaaatattggaataattcttagggaagtaaagggaaaataaagttgatacgggaaaatgttggaaaagaatgtcgaggtcaaaagaaagcagcatatcaccagagagttaggcttttgttgtacttgtctgataatactttgaaaaattataaatcatataattgcatttttaactaattctttcaattaatgtgttctggatatttaaacaatattgtactagaatatataatagaatagataataatcaaaatgtattaatgtttaatgtgctggcatattaaatatttgcaaagtgctttgcatatgtttttctcacaatatgagcaatggtccaggtgtattattgtccctattatagatttgaggaaactgatttattcagtaacttactcaataccccatgtctcgtggttggtatatgtcagaatccaagattcacatcgaagtatgttggacctcagaatccaagccctttatgattatactaaatagataacaaatgggatatttcacaataacaaatgataactggtgttactttatttaccattcatcattatttatcatttatataatggtataaaataataccatttatcctttcctttttagatttgactttttatgtgtttatttcctatctgtgtttcttcattgctgtactatcccttccctttacagggagtagtatacacatcagtatattaaacacagtagaaaagtttgtctaacttaatatttgctgagttcacttgatcttgaaagaagacttctttttaatttaatgccacctattgactttgtttgcaaaatgctgataaaaataagaatttaaaaattactgtcaaattgttttagtatttttgttagaaaactaatgtttcagaattggtaacctaaaatttgtactgtttaattttaaaagtttgtgaatttcacaatccagttacttaatctaagtgtttgtaacatgataaacatatttatgttagatatcctgaggctatttgactctctgttcttcagtataaaatgctgtctttgagttgtgtgtttaattattgtctgctaattgataatattatttggaaagtcacagaagtaacaaccctaagtctttcataaagtgctgtgaaaatttaaatgaccactaagtggtcagcagttgtacatttttttcataatatactagtaccctctagtgctcacacttggccatgtgctctccaaaaccaccttagaggggtaaatgtaacatactgcattggactatcttaatcaggcttagttttaagtgaaatattctatttataacatcacctttctgaaaagacattcagaaatttccaatgttgttcaaaagtattactggaactcctgtgctgtaggggaaaatgtctattccatctgttttgctcattaaaataaatgaaatacttgagaatcaagaactgagaagtcattaaatttcttaaatgatttgtagaaatggatgtaggacctaagtcttttgtcccaaggttcagtatgtgccatatgcattggactgtgtatttgatccaagaaagtttaaatgaaactataaatgtatatgtctaaaattctggatttctttagacagaatcattttctggaagagtcgtacttcttcagaaatacggagtgtgggtttacaaaacagcacaaaattatcagccaatatactacagagggagtactagaatttgatttaccatatttaaacattatttgttcagaaacaaaggatcctctagacaaactgccataagcaaagaaggtgtaatttcatttgcttcccaaagaatcatccaaaccattgccacagaactaatacatagagtgtagctctttataggtgtaagactttgcccgctatttattactatttcagttgtttcatttttcttaaagacttgacttggtgtctacaccaaaagagtggatccacataacaaaataattctaaataagttttctgaatagaattcttatgttattcaaatttgctattagtaaaggcctttctttatgtacaattagttgttacagggtagatcacccaaacctgacaagtgggaacttcttcagctgggcagtggtggaggcatggttgaacaagtcagtggggactgtgatgatgaagatggttgcgggggatcaggaagtggagaagtcaagaggacactgaagatcacagactgtaagtgtatgattctaacaccacttttttaaaacaatgattttgaaatataattaaagatattgttatggatgtaaagaaataatgacaattcaaaaacaagcaagaggaattggaaatggaaatgaatctatttttggttttttaggacatacattcttggtggttttgtttatttttaactaatgacttctaatgaaatgatagttttctgtgaaaaaaaactagtaaacaatcaccagttctgagaaggtttgaaagtggaataactcttaaggcataatggatactaattgtatattgatacataacgtgaaaccaggatgggtaagtactacgtaataatcaaattgtgcaattaaaaaattacatcattatataagaaagtttttactttattgcacttctatcatagtcaaattgcatagaaattggtatatggttattgatcatgaaaactacttggatttaatgcttatgaatttccccttccaaaaaaaaaaactcactaaacattgattttgattgtatggatttgaaaccatttcagaactcatcgctaccacaaaggatagaattttcaaataacaacaaaaaattaccaaatagatttcccttcctgattatcacatacaagataaggaatataggttctccacactccattgttatctgcatgcatttgttcatatgggcaaaacaacaaaagtgaccaactgagaaataatgtaaatgttgatgtacctagaatagctggtttcaactattcatgtaatcttgattataccaaaggcaggggtcaccttctggaaaggtgcagtcatatgtagaggttggtctgatagcttccctcaaaaccacacagagctgctttgcacctattagacatgccttttggtgggagaagaattcatttactttataattctctcattgtgaattaaaagcacgataaatgcttccaaaatcaattcctcattccttctaagatctggttttacaagccaaatatattggtttaaaaaatggaagccaaaagaggtgcaaaattaaaaaggcagttaacataatgaaatgttttctcattagacacagtaatacattttatttaacatggaaaataaatagatgagaattggtgcacttgagcagcctttgaacaaaaggccacaaaattcttagtgctagttaaatatattctattcttacagaatgcgataaagatgtgttcttatgagtattaatatagcttatcagattggtttctcctttttttctttctttggttaagtcaaatataattaaagatattattatggatgtaagaaaataaagacaatgtatttgggaattagcaagagaatttggaaatgaaaatgactgtttcatttatttagggcatgtattcttagtggttttgtttatttttgactaataacttttgatgaaaattatagttttctgtgaaaaaaatactagtgaattatcaccagttctgagaatgataaaggttttattttattattttttaatttccttaggttttggggaaaacaggtaatgtttggttacatgagtaagttctttagtggtgatttgtgagatttgggtacatccatcatctgagcagtatacatcgtactcaatttgtagtcttttttctgtcaccctcctcccactgtttcccccaatcccccaaagtccattgtatcattcttatgcctttgcatcctcatagcttaggtcccactatgaatgagaaaatacaatgtttggtttcctgttcctgagttacttcacttggaataacggtctccaatttcatctaggttgctgtgaataccattagttcattccctttatggctgaatagtattccatgatatatatatataccacagtttctttatccactcattgattgatgggcatttgggctgattccatatcttttcatgagaattataaaggtttgaaagtggaataactcttagggcataatggatataaattgtatattgataaatgacgtgacgtgaagccaggatgagtaagtactactaagtcatgaaattgtgtcattaaaaagatactatgtcattatataagaaagtttttactttattacatttttatcatggtcaaatagcaaattataatttatgtgaggtgaaagaaaatgaaaaagggttttcactagaaacaattttttttttactaaaagctaaaatatcttccactgtatttaggaattataacacttatccatcagggcagtatttaataatctttcattttcatcctatctggagtatttatttgtactataattgcatggccatctaaatattagtattttagaacataaagttattacaaagtaaagcatttttttgtgtgtgagtgtgtgtgcatatgtgtgtataaatagtatatttataggaagttttttacttcatgaagttatttacaagttcaagaacttgttatatattagtacgtcactcttttttgtttgtttcacaaaggaggtagaggcagtgaagcatattcaactactaatagttttcttcacaaaactatacttgacaagttgacaaaaatttttacttcaaaacctgggtttcaattactgctgaaatggacaggcatggtacaagcagctacccatcagaatttgggcgatttaagagagatgatttttcagcaactccaggcaagcattttctgaaaatccacatctgctctaagtgggttgcctcttatgtttctacgagtttatagctgttgcctttcaatttttaataagtggttagaaaaccactgcgggatagcatgctgaagtaaagagggacgaggaaaggagcgaagtgtaggtcacatttctatttttataaagcactctagtattttgcccgttttggcccagtttgaatatattggtaaagcaagttaaggcatagttttagatggtcttaatgacttcaaaatattgtgatctaaaaagtttaacaaggtgtcatctgtgttaagaacttgaaatgcaccactatttcttcattacgctttcatttattctttggaaaatatgacataaatagcacacagttcatttgttaccataaaaagtctgactaaatttaaagttatatatgtgtatatatctacatataactatatatagttgtgagtattaatactaatattgtatctttgaaatttcatgattctgccctatttatgcaaatgaaaaaagttggtaaatattttgctaattattacttgaactgattttctgtgtctgtttttgttcatgtttatatcagatgacagaggggtctctatatttcaatatgcaaagttttaccaccaaaatatttgcgtaccttttaggtgtcattttgtcttcatcaccaatgttatcaacttatttaaccatcttactgctttctaaataatttctatttgtaatcccacctatacattataattaaatgttaactaatgtttctcaaagaaagaagccatctatactatgtaattttcactcttaagtaactgatttcagtagaatggcttaaaaatcccattaggaaaatttgtccacatttttattatatgtatttggttcatttacatagatatagatagttcactagtaacctggggttgcaggattggaatggctttgaacttaaaagtcgcctcaccccttgcctgacacctgccattctttcacagtagctaactgatgaaggttctaaacacaactggaaaaaataattctcttcttttggccatgcagaacgaatctaatattaaaatctatacttcttgaaatatctgactatacttcttaggtctctaaatctggatagcttcaaatgttgaaaagcagaactactaaaaacaacttgtagcaaaattattctacatataattttgaaaatttgtggtggcattgtttacaattcttatgtgatcttatgatttaaatcacaataattacttataaaaagtaagtaatacataatccatgatcaaattcattttggcaagctggttcacagtggtaatcgagggaaaatgcatctgatcacaactagaaccagataccagacacttttaaaaagtaaggtggttttcaatctttggatttattttgctgggcttctcctcatcattccacattctaaatatttgaggattccagaattcagttctcaaaccttttatcatgtctattgacaactagcccttttcccacagactccttactgaatcgtaattatgaaaataataaggttccctgcctctgatagcactatccagttcataaagcatttcccagtgtaataccttaggaggtaggaggtaggcttattggaacagaaagtatctgacttaaatatgattaatttagaaatagtaggataatacattgcaatattaaattgctagatctagaatttttggttgattagagtaaaataaatagaactattgtttgtgttgtgttttggttttctcacatggtaactttgtatctgcctctaacaaatgtatccatgtcagcgtactaagaatgacctaggaaagagaatagtatattctgtgcacagagcaaaatgaaaattacactttactagccgctgaagaataagggaaggtgatttatttagtaatgcaagattgtagagtgagcaaaagttcttggcttcctcatatttattttcaccataaatcaccttcacttcaaaagtctcaggtaggtgtggaagttaaggagaccttaaaaagatgttactttctttccagaactaggaaaactatgtatttattcatattgcagatactattttataaaatgttatgtagtctcattgatttttttcctatcaatatgagttcaaacacatatgcctataagatttgaatgccattatactatatgattatactttaaaatatgtttattgattatgcatattctttctaaaattaaagtttcaccaaatttaatcaaaataaaatatattcagcttactttgtaaactgttgaaaaataacccattaatattttttcaaatataagaaaaatttactgaaaataactattttttcaataaggcttatcatttatccattcatactaaaaataatctttggaaggttcattagattaaaacctttgcaagacattgaaagtaatcttgagtaatgattgcacactttgatctacactttacaagtacctaattctaaaggtcagataaaaccctgcatgataaaaccatagaaaaattcacaaataaacacttgcaaatccagtttaatgttcaaaattgtaaatactttgaaattaccatctagtgcagttttggtagtactgatgaaaattatactaaagagaaatgaaatatatgtctaagataaacatagtttaatatgtgatcactatgaatatttttctgattatacatttccattttggtttctaaataattgatactcatcctgactgcctgctattttgttaacaatattgtataatggaatgtagatacctaatgaatcatataaaatcatctttcattcttttgaaaagttatgtattaatatatttaaatagtagaattgaagtaaaaggtttgtccttgaatgcctaagtgattattttcattgcattggcttagactgatgttaaatcactgaggtgaagagggatgacttattaattaaggcttagaggagccctcctagcttgcatttcagatcactcagctgttctgtaatatgtcataactaaatctatcccacgccagagaacataaaatgagaagttgtggtcttttttgaacaacacaatgctaagtgtaactatatgatcaatagaggaagtaaaaaaaaaaaaaaattcaagcaaatattatcaggtaaattttctcatgacttagccaaagtcatatagctatcaacaaaaccagaaacaaacccattcttatctaggtctatttttgatgtcattttgttgtgaataaacagagtggctattgaaatggcgatattctgtctcgggattgataaagtgcatctggtagaaagaaattaggtatatcttcgggtctttaatgacttcagtccctctaactgtgtggaagtagtcattttcttattattgaacagaaaattgagagcttactaagtagaaataatttttaaaaagagtatttgagctgatcccagagcctctcaaactttctcatacatataaattacctgggactctgcttacaaagtagagtataatacaggaaatctgagggtggagcatttcttacccgcctacagatgatgttactattccttggtccataggaccacattatgaagagcaaaaatgtacacttttttattacagtctttatttgtatctctaaaatactctctattaaagcatgatgaaattttttaaaacaccgtatattagcattataagaaggcatcatatgattaaggacatttggaactgtaacacttaggccagtaatggtggctgattctgtatgaactttggtatcagtctctgattatttttagcatgaggtttacttcttaacaccaaagtagaaccacttccatccttttgcagggcctgacgctctcaggttatactttctttaaggatacttctattttgaaatagtacctctggtatctcagcagaaatgtttcacatttatcaactcttccatttggtgatgaacacagaagaaatactgtgcacaatcccctatatcacattatatgccaagagagatcaatcagagttttatgtgagctcagagaaagaaaagaaactatccaaatggggagcttaaaaaatacttcatagaggagacagagaaagggcaatctggaaaagcaaccaatatttgcctgcaatatttatgagacagtggtatttgagaggatggacttataatttggtttcagcaactgacaatagggatgagaaggtttcctgggaggagcaaacatcatgaacagaacaaggggtgtgtttacagaggaacagaattatttaaattacttgaaaaaaatattggaaagctaaaaatgtgaattaaaaatgttacaattgattttttgaatacacaagtggagtttgtatttaatttgctgggcaaagaggaatgattaaagctcttctatgtggtcattttgtttgtgcattcatttttaccagcaatatagtgaactacttaagattaaaaaatacacacaataaaattagtatatcttgaacaagtaacttctctcctaccttgtacaagttctgtgcctagatttccttaagacctgaataaaagcaggactcttcaagtgatttttttgtgaagattaagtggtttaatccatagtcagcattccaagagtgtctacccaactcacacctgtccattgaaataaaagtattggataaaatatgtaaaaggtagttttttaaaaatgcttctataaattagtaataaaggaatgtttgataaaattgggctaacatggtgaaaccctggctctactaaaaaaatacaaaaaattagccgggtgtcgtggcgggcgcctgtagccccagctactcaggagactgaggcaggagaatggtgtgaacccgggaggccgagcttgcagtgagcccagatcgcaccactgcattccagcctgggcgacagagtgagactccatctcaaaaaaaaaaaaaaaaaaattgggcaaagtacaggcagaggcacagatagtggtagatacagttatacacacacataatttaaggaaaataatatagttgtacctaaccctccaccgagtccaagaaatacaacatttccatggccctataggcccctctctgaacacatttcactgaacagagagtttgcctatcctgaccataacttttataaaaaatacagttttaaccaacagtatgtgcatgcttaaataatacttgttttttctggtttttgaattttatatgaatcaaatcatacagtctctcttgtcttgttactccttttgttaaacagtgtggttttgaggcttatccatgctgatggatataggtgtactcatttaatttctcttttgctttctttcttttttttgagactgagtctctgtcacctaggctggagtgcagtggcgcaatctcagctcactgcaacttccgcctcctgggttcaattctcatgcctcagcctccagagtagctaggattacaggcatgtgctaccacacccagctaatttttgggttttttgtacttttagtagagacagggtttcaccgtgttggctaggctggtttcaaactcctgacctcaagtgatccacctgcctcagcctcccaaagtgctgggattacaagcatgagccaccatacccagccttcatttccttttaccaaagtatagtattctaatttatgaatacataactcatttatgtatgtattttgttgatgaatattggagttgatgtcaatcagtggcatttggtacgatatgaacaatgttgttctaaaccatctggaaagtatctcttgatatacatgtgcaagaggatgcaggatatcttagaagtagcagggcagtgccacaaaacaaaagattatgtacagctctactaggtatgtgagcctgctttgcaaagcaattgtaccaattcatattctcactagaaatgatgacagtttctactgctccccatctttgtagacacttttcttcacgttcactgatttttcatattcatctaaaggatagaagtaaaacaagtaattaacttctatttccctcataattaattggatttcactttttaaacaagtatatgacaaatttttgcttccttatctgaaatttcagaagaaagaaatttagccccttccccagtattactttgtttttgtattgttgtaaagaagtatctaaggctggataatttatgaagtaaggaggttcattttggctcaagtttctgcaggctgtgtgagaagcctggtgcaaacatctgcttagctcctggtgaggcctcaggaggcttacaaactggtgggagacaaagggagtgccagtgtatcacatggagagagaggatgggagcaggtgccacattcttttaaacaaccagatctctcatgcattcagagctagaatttactcattatcatatggagggcaccaagccattcatgaggaatccttccccatgacccaaacacctcccaccaggccccagctccaacactagggatcacatttcaacatgagattccaacctccaaactatgtcacccctttctatcaggttattacttttttctttggcagatactatcaatacaaaagtcaatttcagtgatccattacttcttttggttgtgacctcaggaagggaaggatagattcttgaatttttctttattgaaccagttttcaagataataaattgattccctccctttctcagaagatgaccaattcttttatatacatttaaatgtcatcatgaacccagttttaaaaacatttgtaattcttatttttactgaagttcttactgtctcacattttgccagctggtaccttttccatttgcctttgagtcctttgagatgacccttaaaatacttactagtttctttgccatctggtatacttagatgtactaagctcagcttatccattgtcacaaacctggaatgagccatttttacatgagactttatttgttttactgggaaatgtcatttcatgactgcaatctgagcactaatgatggctcttagaagcataggtgataattaaaatatttcataatttctcactttattccacattaaatataacacattatctgaataatactaaaactgcccttacgcattatgattactaaaattagctaaacatttttgtatgtattgtctattttctctccccattctatggttatactagagatacagagatagtgtcaggtcacatatcatatctgccacttagctcttatttattgtaactatataatgctcactatttgcttttatatcaatatctctctagtgtattccttataaaggactcatggggacaatattttacgagttcttttatggtgatgagactttgtgtcctttagtcttaaaaattaattttgttcaatacaaaaatgttagttagctcacatgttctttccttccattttttttcaataagctctgcattttctggtagaatgcattagtggcaaaaattataatgataatctgtttttctttccattattagccacttgcttttctcccctcagtgcacaatgatttgttttctgtttctttaaagtacagcaattttactagaatgtattttgtgttggtagctctgagttggtattccagttgcatagtgtactttttcaatatgtaattttaaatatttttctaggaggcttttattgaattatggttttaataatttgttatcttcttttaactttcttcctcaggagcacctatttttcgtttgttgaattttctttatcttcagctttttcctcaacctttttgatcttcgctcaaattcttttggattggaaaaattcacctctttaccttctgtttctcttaagatattattagtggtgcttttttgcttttgcatttctgcacattgtatttatttttgaaggaatttacattcttctatttttttgagatctctaacttctttcctgaaattttctaattctagtttatttctttgtgtcttgtatcccatgcttactgccttttagctcgctttgaagtgctatatctcattttagtctgtttttgaacatcttgattgtgtgcttactatgtttgcagagatcataacagaatatgcaatatttatggtgataaatttttgtgagatttgatctcaaaacatttgttgcttattttatgttaatataaattcccttcatttttagaataaagctttgtttcaatagcttttctaaatctactgagtttcctgttctgttctcgtcatgtagtgtcaaaaaatatggtggcttgttttctaaaatttctggtctttttctctccccagtgattattcatatcttctcttcttaactttctgttattcttatctcactattttttttccactttcagcagttactcttgtatgtggaatcccctcatcctgaatggtaagaaaacttggcagattttaagcttcaagagttcagcaggtttcagagactttatttcctttagccttataacagagcccttgcatccacccattattagtgtgggcataaatgttcacagttctctgctgttttcacattgattttcaataaatcctgtgggttctgttgttttcatggctttaacttgctgcattgcttccctctgtttcttctgcacacatgctgatagtgtgtagattgaccattggtggtgtgctctctctcatttctgctttgaggttaatgaggatgacattttgactgagttttgttttatttaattggcaaaaaccataattacttttgcaccagtctaataaatggtatccatgtgattttaattttgctatcaagttagtcttttcattttatgtaaggatttctgaatgtcccaaagctatgttgcaaccaccactgctatcttacgtgaatttcccaatcattttcattttataagtaaataaaatatagcataatagatgacaccttgatgctcttcctttttgatcctttccccctgatttacatatatatgtgtgtttatatattgtaattatatagaattactatttttaatattaatattaaacagcagtgtttttaaaatgtatatgcctccaatttgtctttctgctgataaaatagactttattataattgatgtatgaatataccacaatgtattatctattatttccaattttaatgaacaatgctacaagcaagcctctctgtgcatgagtatgtattccattaggttgcaaaactaatcttcaaagtgattatattaattcatacttgcaccagcactccaagtagactatttttggatttgtaccataatttcatatcctcagagtttttaattttgctgaatttttaaaatgtaaatggtaaatatctttgtgtatatgaaagaaattgcaacagatggaatgaaataggcaaggaagatgttcattattcaagatgattacagtaggggaaagagagagaactctccactgaaccaaaagatgagatagttttatgcacctgggagagctagtgaaaaagtatttggccggtcttaggagtgagcttggtcaatgtgattaggtcatatgtgtttgctaattggtatttatgaaagttaggctgcttccctgacatagagactgggagataggggttctgtcttgatgactacatctcataaagatggctccttgaaaaagagaatcctggcttttgaaacaggcaagaaactggaagatttaaatctcaaatgggaagagaaagaatttacaattacaaatgttctaaagtaagtgcattaagaaaaagaagttaggggcttatgttaggaagaaacatgtttaaaatttagtcaacataaaggaaatgcaaaaactgattctggtgaggtttatcgttattttttgtttaatgaccattttgtgtttcctcttttgtgaatttattcccctccccttttcatattttatcacttggttgagttaaactatctcattatatacctaactagtattttctcagcatatgagttgtgagaaatctcactgtttctggtgtgacttttaaagatgtatcccagctatatactcataaattacagtctagaaagggaaataggtatatcagtaaatacattaaaatgaactgtaaaaaatacataaaattgagaaatatgaggaataaagaatacataaatagtagagaatgatccattatatggggattttcttaagaatatcatcttagaaattatagctgagctgggtttcaatagaggaccaaagataatcagatggagagtggactaaaattcatgacagacaaagcatttaccaaagtacagatgtttcaagtatcagtgttttcagggaagctcaatgtttgcactcttcctggagcaccacttttgaggaaggaatgatagacgaggctgagaaagcagttggtggcctctacaatgcagaagcctatatatacagttgtcctatagagccgtttagacttattctgaaaagaatggatttattcaactgaaaaatctacaaaggaaaattcatacattcaaaacacaatgcccaaataatacaagaagttccagtgatgtttagataacagttagctctaggtcttcattcaatacgtctaaaaataaacctgtcaactttcctctcaattcttttcagttgttcctttttttttttcttctgacaacactatgactcaccatcctccaagacagaaactcaggagtcatcttgtgttcctcctctcccttcacgccccgcatttaataagacccattgcctttacttctaaatttcttttctttcacatccccactgctactatcttagtttaattcctcaacatctcttgcccaattggtcacattggtctctctgcttctgtattgtccatctctacactcttggtgaaatactattttaaaactgttttttgctgagatatggaaactccagccatcatgtaatctttttaggcagagcggtcctctaaggagaggaggctggttcggtatcaaaatttatgaactgttgaacaatagcttttagttatttgccatttcagacaaccaatttcaattattctgaaggcacccagatgcttttgaccaaactaaactctttcattttctcccatatctcagtgaaatgagtgtggtgctcacatgttctatgattctgaaggcacatacttcaaaacccagaagactgttatagctactgtgctggtgatttgcctattttgtcacagatctgagcctcctcttctgtaaattgtgcttacgtaaactacatttcccaacctccaccaaatccctcaactccctataaattacatttccctgattctccttccaggtattatacttttatttttttctgccaatggaaagtcctaaaaggagattaaaagagggagaggggaaagcacttcgtctggtttcttttctgctggcattacatcaaagcagagagtcactccccagcctccagacatgtttagctcttatattagcagctaggataaacccgttgaagggaggtaccagctaactttacctccatcgctagtctgagcgccagcaatttggggcggggactcaggtatgagcatcaccttggaagggcaacattcccgttgtccatttgagaagcatacttctcttccaaatccctagatgctggttatcctatctcttccatttcttaaaaactagaattgctgctctatgtaatcactaataccaatgttctttttttttttttttttttttttttttgagacagagtgtcgctccgtcgcccaggctggagtgcagtggcgcaatctcagttcactgcaagctccgcctcccgggttcacgccattctcctgcctcagcctcccgagtagctgggactacaggcgcccgtcaccacgccctgctaattttttgtattttcagtagagacggggtttcactgtgttagccaggatagtctcgatctcctgacctcgtgatctgcccacctaggcctcccaaagtgctgggattacaggagtgagccaccgagcccggtcccaatgttctttttttaattgagaggagtcttgccctgtcacccaggctggagtgcaatggccccatctcggttcactgcaacctctgcctcctgggttcaagcaattctcctgcttcagcctccagagtagctgagattataggtgcacactgccacactgggctaatttttgcatttttactaaatacaaaagatgaggtttcaccacgttggtcaggctgttctcaaactcctgacctcaagcgatccacttgcctcagcctcccaaagtgctgggattataggcatgaaagtatctatgttcttttacatcctatttttgctttactaactcttaaaggtctatataccaattccgatattaaattatatctaaaatggttcctgttttcttgactggacctatctgatatagctgttgttaactgtgtaaagttaaaccaaaacataattatctgaaaaccagtaagaccttccttctagtcttcgggtgcggggagtaaaactgttacaattttctataggtttatattctactgtgtaggataacatctgttttagcatttcctcccaaattccagaggaagataatcacatagaaaattagataaagtaagccattgaacagagagtaagggaaaatagatgtcttctgggtgagaaatttcctggaaaatcatcccttgaaccattaagtctttgatgaaatttggcattgagtctggttcacccgggttgatttgaagctctgagtgtcagtgagattactatataaaactatctctctgaagactgactgactaactgggtcttccatagagccaactctacagaacaggggaaaagttgaggcaaggcaattaattcataaatgaataataaaaagcaaatgggactgacaataagaagacgcagcatgccattggtttttgaacacaaattccaagtctctctccttcactattactaatttcaggtcatcctagacttggaatatttgaattaactctgtaggatatggtcaagcgtctcttcaacatcctgcataccaactagttttaatcttgtaaagtatggttctatttctgcacccagcaccaaaacctttattagtttctgtggctcgctcaaaagtgttttttttttttttttatgagttgtactaaccataatagttgtaaaattgtctagggaaagtcaggaagcatctttttatctgtctatatgccacagaactattcttgatcatggagtatataacctgcatcagaatgacatcggattaatctctgtgcttgtttaaacacagagtatagagttctagccagaaatagtgaatcaacatttccagtggtagatcccagaaatggatatttaacaagcatactaaataataactatttccaataaagcttgagaacaactgcctcacagtccctgccacagtgcctccaaacatgaggcatttaatgaatgtgttctgaagtgcaagaatgcctgcatgtaatccacacatctctaagacacatcttaattaacattaaaaaccagattttctaatgaattgaaaatattgacattaattttagccaagaatattattcagaaacaaaaataataagtatgtgtatattcaaaagatcaaaactgagttaaaatacagagtaaatttgataagtatagttttcttcaatcattggtacttgtgaattatataaataactctttcacattttcacttagtggagacctgactagaatattttgcattagtttaatgtgtaattttgcgtgaaaattaataatccgaaagtaattattaagtgctaattgttaagctgaagtgtaaagtactgaatttaagagtatcattttctagattaatatacaatgtctcaattttggaggagatacattaatacaataggtattgcttggggatagtttttattgattatgtttgagttcctttaatttctttataactttaatgttttatgctaatttttaagaatataaataattatatttgcctattaagtaatatatagccatatatatatatatatatatatatatatatatatatatatgaaactaaatgtagttctctggttataaatttgcaaaatagtatggattttgtatcataagattttttgtcataattattgttccatacctttatgttatgagtatattctatggaatcctgttttttccctgaagtctaaactgcattatgatgctcacataagaacattgtactcatttaatacaaattttgcaattcaaattagagtcacttacagcttctttatagttccaacatcatggttatttttcgtttgaaatgccccttatctccacattcatacatccatttattcatccatccattcatttattcattcaacaaattattaattggtccttaattggtgctagtcaccatacagatttcggcctctgggggctaaagaagagtaatcagggaaaattacaatgcagtgtgaaaggttttatttgggaaaagcagatcttgtgggaacacacaggaaggtatctcagtcttagggataacatgaaggcttctcaaaggaattaaaacatcatctgacacctgaagaagcagttattaatagggttatggataaccaggggagcaatcactacaaaaacgtgaagcagaaacagaaacctaagaattagagaatgctggggattcttgggatctacatgaaattccagaatgttgttatatacaatgtaggctggggactggcatgagccaactcatgtattaaaacctttcaaattacagtgtcaagaatgtatgtggtcataaaagttaagggcctatcacagaaatccagacaaataagttgatgacataaatgacaactcaatactttttttctgtggtgatttctgcacctcttgaaatgaacttggtcactccctcacctgctaactttagcacttgtgtgtgtgtgtttataaaattatatgtattatacataatatatataattacactgaatttagctgattttttcatagactatgagcttctaaaaaatcatccccatattcgtcattacattcttgggatcaaatatactgcatgaaaaaagatgctcagaaaagtctatgttaagttaatgtatgaatatatgaatgagtgaaggaaagtgttttgaaaccatcatagggaatataataagataaaattacactagaataaaatgaaactgataagaataaatttgatggggctgggcatggtgattcacgcctgtaatcccagcacttgaggagtccgaggtgggcggatcacctgaggtcaggagtttcagactagcctggccgcatggtgaaaccccatctctagtaaaaatacagacctcagccaggcatggtggtgcatgtctgtagtcccagctactcaggagactgatgcaggagaatagcttgaacctgggaggtggaggttgcagtgagccgagattgcaccactgcagtcctgcctgagtaacacagtgagattccatctcaaaaaaaaaaaaaaaaaagatggaaagaaataggaaagtcacaacatgtacagtaaaaattaatgagaatttctactgagtattctatttccccaacatgcagaatatggaggctattatataattatttgggttgattctactttagcatctctttgttattgaagaatacttgtcatcactagctacacctactgttcctagatgtagcttcagcaaaacttgttcaagttcagtgaagaacaatgagaatagtaaagacagtacaaatttcctatttcaaagatgaagtttgttgatcataaaatgcaaattaaaatatgaaaattgaattttgtattcgttctcacactgctatgaagaaatacccaagactgggtaatttataaagaaaagaggtttaattgactcacagttccacatggctagagaggcttcaggaaacttacaatcatggcagaaggcacatcttcacagggtggcaggagagaatgagagaagtacagagcaaaggtgggaaaagcccctcacaaaaccatcagatctcaagagaactcaatcactatcatgagaagagcacaggggaactgcacccatgattcagttacctcccaagaggtcctttccccaacatgtggggattacaattcaagatgaaatttgggtagggactcagacccagatcatatcattctgcccctggcccttcccaaatctcatgtcctcacatttcaaaacacaagcatgcctttccagcagtcccccaacatcttagctcactccagcattaacccaaatgttcaagtccaaggtttcatataagacaagacaagtcccttctacctatgagcctgtaaaatcaaaagcaacatacagtgggggtacagacattggataaatgtacccattccaaacgggagaaattggccaaaatgaaggggctgcagttcccatgcaaatccaaaatccaatagggcagtcatttaatcttaaaattccaaaatgttctcctttgactccatctctcacatccaggtcacactgatgcaagaggtgggttcccatggtcttgggcagcttcattccttcgactttgcaggatacaggccctccgtcctgactgctttcacaggctggtgttgagtgtctgtggcttttccaggcacacagtgcaagctgtcagtggatataccattctggggtctggaggatggtggccctcttctcacagctccactagatagtgccccagtggggattttttgtgtggggactctgacctcacatttcccttccacagtgtcctagcagaggctctccatgagggctctgcccctgcagcacctctgcctggacatccaggcatttctgtacatcctctgaaatctagacagaggttcccaaacttaatttctatgcatccacaggctcaacaccatgtaaaagccaccaaggcttggggttcgcaccctctgaagcaatggcctgagctgtacgttggccccttttagccacagctgggagacaggaaaccaaatcctgagactgcacaaagcgataaggcccttgggcctggcccacaaaaccgtctttccctcctgatcctctaggcctgtgatgggaggggctgccgtgaaagtttctgacatgccctggagacattttccccattgtcttggcagttaacatttggctactcattacttgtgcaaatttctgcagtctgcttgaatttctcctcagaaaatgggtttttcttttctattggatcatcaggctgcaaattttctgaacgtttatgctctacttcccttttaaaaataagttccaattccaaatcatatctttgtaaatgaataaaactgaatgcttttaagagtttccggtaccaatttattgtattagtttgttttcacactgctatgaaaaaatacctgagactgggtaatttatgaagaaaaaaggtttaattgattcacagttccacatggctggggaggcctcagaaacttacaatcatggcagaaggcacttcttcacagggtgacaggagagagaatgagagatgtggagcaaaggagggaaaagcccctcacaaaatgatcagatctcctgagaacaaactcactatcatgagaacagcataggagaaccacccccgtgattccgtcacctctcatgaggcccctcccctaacacatggggattacaatttggattacaattcaaaatgaaatttgggtggagacacagagccagatcgtatctagcttttaaataatctcaaaagctatttgatagatttattgaataacagtcaattctagtatccaggcctgttctggatatatccatgtattaacatatgtaatcttaaaactctatatgataggtaatattgccaatttttggcacagatgcattgaattctttgccctgggttacattagtttcagtgagcatgatgcagagccaagatccatggccaacaaataggacttcagccaagaataacgttaggattgtctctgcagattgtgtataaaaaacttcactctatattttaaaatgttttgaaattctttttgtgtatgtgggcgaaatagaaaattgcagaagaaacttacttaaagaaatgtattgttggaaagggtatttataaatattagtctaaatacctgaacaagtaatttaagaacattaatgttcagtgatatgcttcatgtacagcaaagatttccctgattatatttttgagaggaccatctatggaactttacactaaagtaataggcttcatggaggaagtacactggaaatacatgaagtaacaagacctctaattgcagttctgctaatgtccaggaccttaacaagtcttagatctcatttgctagccctataaaatcaagaaatgctcacaaaatccatttcatttctcaaatactatgtttcaggaaagggcatattttaaaataatggttgttactttgaaagtattctgggtataattgatattgctgaaagccatttttagtacataaacccatcagataaagaccaccggagaaacttccattgtcaaaggtagtttcattagccctaatctgctgaatcaaaggctacagtacaccaagagaactgtgaggtgactccataagactgtattgccattgactgtttacaggtttgtgcttgtgctgaataattccaaagaggaacttgaaaagagaatagaatacccttgatgagtgatcttatgagggaagggctgtttaacacttgagtatcacagtcttctttcttcaggagttgagaagactgaataatggtgggaacttattggaaagaaagcaatactcatttgtgtgatcttagtgtatcacattagaaataatagctttggttctgttgggaatattgcagtctgatctgtatccaaaataaggcataagtctcagtctctctctctctctctctctctctctctctctctcacacacacacacacacacacacacacacacacacacacatatacacacgccctatcctgaacagttaaatttccttctcaaatgagtaatggaattcgtttgtagggaatggaatgtaaataaggattttacatttttttcatagttaagtatgtgctttgttttatacaaaaagtcttacatctaagaccctaaaatattgattattctatcagagaagtgaaaattaattgtagaagcagcactgaggagtgttaacaactcattgtaatcctgtaggctatagcaagttatagtccatgatcaatatttacaacgcttaagtattcaccattttcagggcattgatgtatagtgagaattcttttataaaaacaaattgtatatggtttttaatgttgggaaggaataagctcagtttgcaaatgatataaaacttcagattccacagggttttaaaatgaaatgagtaaaagcaatgcaaatgattgaagctgtaaaaaatagacttgaggaagagaaagagatctagaaaatagaacagaagtaacaatgtatgaagagatattatacaaatgatgttttctgttttctcttttgagtaaaataaatggttttaaaagaaacaacaggaattgagactaaaaacaatgaaaaagaaattgtgattttaaagtttctgaaatacagaaatagatttagggagtagctttcagcatgttaaagactaagctagactcctgataacccataaacacaaaagcttccagatcccactctactggtctgaatcatgtggattaccagaatgcaagcctttcagaaaaggtcatctgttgtttaacaaatggactttgtagctcaatttaattttactcattttagttcagtatcagttttcaacttaggaccaagaaaaaaaaaaaaagatagtttttaatctcaaactggaaggcctgtaagtagaagtgacacatcgttagatccaacgaggaggtccaaaccttgggtgatgacatgaccttccataactgagggcaagcttactgggatagctgtcaccaggtgagggtcaaaactgatttcaactgacttgcatctcaacgttgactatcttttcttctctccaatcatggccctgataaaaagccacagagtcctaacactgggtttctagatggaggagtctgtctacttggcccttccttataccttatacaaaaattaactgaagatggattaaagacataaatgtaaaacccaaaactataaaaaccctagaagaaaatctaggcaatacctttcaggacataggcactggcaaagatttcatattgaaaacatcaaaagcaattgcaacaaaagcaaaaattggcaaatgggatttagttaaactatagagcttccgcacagcaaaagaaactctcatcagagtgaacaggcagcctacagaatgggagacaattgttgccatctatctatctgacaaagttcgaatgtccaaaatctataagaaacttaaatttacaagaaaaaagcaaacagtgccattaaaaagtgggcaaaggacatgaacagatacttcttgaaagacatttatgtaatcaacaaacatatgaaaaaaagctcgacatcagtgatcattagagaaatccaaatcaaaaccacaacgagataccatctcacaccagtcagaatggtgattattaaaaagtcaagaaacaacagatgctggcaaggctgtgtggaaatagaaatgcttttacactgttggtggcaaggtaaattagttcaaccattgtggaagacagtgtggcagttcctcagagacctagagccagaaataccatttggcccagtaatctcattactaggtatatactaaaaggaatataaatcattctattataaagatacatgcatgcatatgttcattgcagcactattcacaatagcaaagacatagaatcaacccaccccaacagttatagaccggataaagaaaatgtggtacatatacactatggaatacttcgcagccataaaaaggaacaagatcatgtccttagcagggatatggatggagctggaagccattatcctcagcaaactaactcaggaacagagaaccaaacactgcatgttctcgcttctaagtgggagctcaacaatgagaatacgtggacaaaggaaggggaacaacatacactggagcctgtcaggggtggggtggcgggaagggagagcattgggaaaaaatagctaatgcatgctgggcttaatacgtaggtgatgggttgataggtgcagcaaaccaccatggcacatgtttacctatgtaaccaacctgcacatcctgtacatgtatcctggaacttaaaaaagaatttgcaatctaacctttaaaaccatcgttaaatatatttgaggtttaaaaattcacgtttcccatgatacaaaaatgcatcagaacattgtttttctcagaacattgttcattttgtcttagtctaccttttatttcaaagacagtgttataattactaaaatatgacaagacaaatcattgaaatagaatactggcactttgaagatggacttggatactacaaatctttacatataaaataaactttgaatttcttaccttttattcaatattagctttttaaaaataaactttatatgataacaaggaaaattaaaacgtacaatccagtgtctatgggtattttttccagaaggtagttataaaaaagacagagaagagtcatctagtaacagctgtaaagtaaaggcaaaaaattattttataatttgagacagcataggtgttcttagtgagaaaattaaaaaacctgtccttactaatacattgagtttatttattttatttaggctgtgaacatttggaactatgttacttggtgtgtgttgttcagcattttagaaagtttccttacaaacttggttgaagatattttcttaatttaaaatattatttttatatatctatcacattcttataatcaatagcataaaatattacaatggaataaacaggagaaattttacaaataagatttccacttataagaatatttctaggaaaatgtttgaaatatcagtggcatgctaaatttgcaatttgataaaactaacatattgaaagaatatatttgcttcaaaatacatggagaactttaaaaaaaaccttaagattttcttcaatgagggttactctagtttctatgtttatatttataattttgtatagaaagtcttttgttttgaatttctgatgtcctacacaatccatgcataagattctttaattgatattgctgtatattttaaaatattatcaaggatttattttctgatgatgctaattacatttttttctaagataggacttcctatacccacaaagcaagtttttctttttttgtcttttctttgctttttttttttttttttttttttgagacagagtctcactctttcacccaggctggagtgtagtggtgtgatcttggctcactggaacctccacctcccaggttcaggtgattctcctgcctcagcctcctgagtggctgggattctaggccactcagccacgcccagctaatttttgtatttttagtagaaacggggtttcaccatgttggccaggctggttttgaactcgtgacctcaggtgatccgcctgcctcaacctcccaaagtgctgggattacaggcgtaagccaccatgcccagctaaagcaagattttctattatagactatttaactaccaactttcccaaaacttcgcatgttcacagtttctactagaaactgttgttttttaaattcagagtcagcaacatttgctgaagaattgtttttctccattttccttggaagtagaatgagaaaaaatggaatacacatggagtaggagacacaatagtagagttgtcaaagtataaaatttatgaaatattttaagattatgggacttaatattaagtcccccagtcagttatccttcatgtactgtgtagaagctgctacacacctactctattcttcttaaatattttatcaagacacttctctctaactaccttactatcatatggaaatttcctcaactttgttccacaagatattcatatctgcctccattcctgctcacccccttcctcttttccttttgctgggtaatagcagtgccctacctcctgtcaaggaccacttttttgttctatgtaccagacccagttgcatcctcagagactttgctttataaattgtccatttttgcctctgtatcttcaaactcttcctgcaataaattatgcccttttagaaaacatgttgattatctcagtcttctctttttgaaaagtcaataaatatactacacacacacacccctatattcaccttcctaaatgtataatctcctccactgacttttactactttatcctatcacagccacacacttcctgaaatagttgtatacattctgaaattactgttcttgatattcttttgctcctcaatccatttccccttctcaactaaaaatggtgttgccagagtcagcctgtagtcacacctcaattttgtattagttgttcattttccacaattgacaatgtcaatcttcagtttcttgaattatgtttttccttgacccatccctttcatttagttattcattgggaatcctattaggtcctttcacttctcactctgtatttttcctgagtgatagaagaatcctgtttaatgcataggtaattgagacctgtatgtctctaacccaaatgtttcttctgaaactcacacacatatattcatttgccacatccataactgagctcttcatgcctgctaccctcatcctgaaacctgcttcctatcttaatgactgttaccatcattcagtcaatttcccaagagagcttccttgtactaccaacttgggatttccattcacacatgctcccaaagcctaccattgccgtagaacccattaaccagattttaaatgccagttcgcttgtttgtacctacaatagattgttagttctgtgtatttctagttaaaatgtagtattgccagctctaagaagcataatagtatttaaaacattcctaaatgaataaaagaatgaacagatgggtagatggatcaatggatggttgaatgggtggatggatgagaaggagagtacttgtgtgtttataaaattgagagtgtatttggaagaacagaatttccagtttggagtagtggggtcaagttgggttgtgcagttgaccctaaggtacatgaaaaagatgatcctaaatgagatcatagaaatcacagccatttaaggatcattatggtatgagtgccaaaatgaaatgttttaaaggattggtaaaaccacgggatgactcaaagtattaaaaatagcaaatgaaacataaccttttatattgactcttagatgaaactttaaattcagttttgagggatctgagaagaagaatcaattttgaaagagttctagagagtaaaataaagtggtaaaaaagaagggaggatatctcagtgtattggaaaattttcaagtgctcatagtcacaatacattttatgtctcccctgttcatctactgcttctttcatttaacttatgtgtcaccttgaaaatattttcagagaaagagccatttataaaaggagagttcttctcattacttaaaagagatactctcctatatgttgtttgaaaaggtttactcactgctactttatttccattgaaactggaaatgtgcaacatgatatctgaaactattttttccaatttcagcagtttaatgctgttattaaacaatctaaagcaattaagatccattcctgtcctttttatttaaaaagaaagctcttatagttctagggtttttttaattaaaaaatttaggcaattattttaatttgactatacctgttaacaatataagaaacgttgcaacagtcaaacgagcaactcttaagtcttattacatgttatctgtatcaccaccaaagctttttttggttaaagtaatttttgcttatagattcaatcaatctgtaagaccagtccaaaggggaaatcctttgttgtctatatgctgtgatcaatgaactgagtgtgagtgcaactaaactcccatttgactcagtcattaatggatttttttttcaaagtgggattacccacattaaaaacagagatcggccattctcacctaggtcattaaatttgttttcctggccacctttcatttagcctgatgcttttccgcttaggtgtgtcgattctgggtttttaggaaatgaagtccttcatgttgactgtggtatgtgaagaccctgatatctctgctgctctgaccccattaaactttcagattttactgccatattgcttttgtacatgtgcttttgtttcatgtacctcatgtgccatgaggacactcagtggggagtctggcacctgcctggacaaaccctttccttttgttcttcctcttaatgaaatactttctatcaaaattacttattcaaattttgctaattttttaggagttggtttaataaagtgttctttagtacctctaacagaaaaccatttctttcattaaaatgcaatgagcaaaaacctagtgtcacttgtgtgccacgtctcacattctatagtatataataattatttatatgaacactcatctccccttactaagacccttgatgtaatcaatatacttttattattatgagccaacaaatatttgcagaatgtggaaggcaatattaagacatctaggccaggcttggtagcacacacctaattcccagcactttgggaagccgaggaaggtggatcacttgaggtcaggagtttgagacaagcctggccaacgtggtgaaaccccatgtctactaaaaatacaaaaattagttgggtgtggtggcacccacctgtagtcccagctactgaggaagttgaggtgggaggatcacttgagtccaggagacagaggtttcagtgagccaaggtgaaaccactgcactctagcctgggtgactgagtgagagaccccgtcaaaaagaaaggaaaagaaaagacatctttggatattcttaggcttgctgataaaagtcatctttacgtcattaaaaaaatatgtgtctatgtatatttatttcatgtatatattaaatagaaaggccaaaatttgggccgggtgtggtggctcacacctgtgattccagcgctttgggaggccgagacaggtggatcacgaggtcaggaaattgagaccatcctggctaacacggtgaaaccctgtctctactaaaaacacaaaaaaaaaaacaaaaaaaaatggccgggtgtggtggcgggcatctgtattcccagctactcgggaggctgaggcaggagaaccgcgtgaacccgggaggcggggcttgcagtgcgcagagatcgcaccactgcattccagcctaggcgacagagcgagattccaactcaaagaaaaaaaaaaaacaaaaacaacaacaacaacaaaaaaaacaaaatttaaataactcattacttcattcatacatttatccacctatacacttctttacttaaaaacagcaaaaagtattaatcactttattgagcaccttgctgggcatcaggaataaaaaacagattagtcaaaaatacggttctattcctcaaggttaaaatagtgtgcagaagaaaaaacaaatagcgatgtcatagaatttaaaatgttatcgtaaagtgcagagtaccattaaaataacacactgtgagacttcgaaaagtcctcccttgaaccttcatttttgagacagagtttcgctcttatagcccaggctggagtgcagtggccccttctcagctcatcgcaacctctgccttctgggttcaagcgattctcctgtctcagcctcccgagtagctggggttacagggatgcgccaccacgtcctgctaaatttttttgtagttttagtagagacggggtttctccatgttggtcaggctgttctcaaactcccgacctcaggtgatcaacccgccttggccacccaaagtgctgggattacaggcgtgagccactgtgcctggccgaactttgattttttcattagaatttctggaaacattattttattatatgttggcatattagtgaaacatatatttattaacctgttttcagatttaatggtgaccctgtatgtttgtttctgtttatcgatatctagctatagttatgtttacatctataccatattttgtatctatacatatataaaagcatctaaatagggcttgacacctaattggaattcaataagtgtttgcttcttttctgattctagattatgtcaaaatttagtagtgcgttctaataaagttgaagaacatttgaataggaggttatgatgacatcactgtgatgcctactgctgtagtccagctatctaagagctgaattgctttcagttttatctgcggttctaaagttggtgggcgcccctttggaaacgtttactgaactcttggtacagaggccactagatggggcttgtgggcttagtactttatagtttagaaaagtcacttaaaaaaactcagacttctctttaacctattctgttctttattaactgtaacactgtgagcaattataattagaaatctttttatattagcaagtgtgaaacctaactattgcccttgcaaatatgtgatattcctcaaagaaaaaaaaaacatctccctacagccaggcacatttatctctttagaggctaaatacaagaccccgttaccaatttaatagtagttttcaaacctgtctcctcatatagaagaatctcagatacagaatcctggaagctctgttcctactttttaggtttcagattcaatggtgactctgtatgtttgtttccatttatctatatctagccagaaacatgctttaccattatcatgaagtttgctccttacccattgctagtgtttgttttcctctaagacagtggttctcaaattttaatgtgcatcagaatcaccatatatcgtgaaggactttagaaaatacaaattactgtccacaaccccagaatttctaattcagtaagtctaggatggagccggtgactctgaattaccaaaaaatgctcagatgatgatggcactgcttatccagagactacaccttaaggagttctgttgtatgctaaggctctccctggataaagtacatacctttcatgaggtagcccttgtgtctcaagacagcttcctgtcacactgcaacattcatctctccaggcactgagactgggacaaggacgagaagtaagtggtggtttgtgttttctttgcatttatgctcctaaccactgggtacacagcacactaagttagataaggttcaacctcaacaacagaccaggggcacctgtctgcatcttctaacaaccaatagctaatgctcatttgaaaaaaaataaatgaagggtttgacccaaggcatcaaagctttggattctgattttcctttgtctcaatggcttttagatttctaagacctccctttccgtttctctccatctgacctccaaccttccccagattcctaatcccaccatttttgaacctccctccagagtgcctggagctaggcccagtggttcctcacctcaacggccacatccaagcacttctcagcccctagtttactgatttccagcacactaccaggcaccactttacctttactggagacctaggtatacactgcttctttacatactgtatctacagctggataattcaattctccatctatttatcccttcatcagtcattaactaccaatgatataacaggcactgcttcaccctgccactatgctatagttgtaaacaagccagacatgacctcccatcttttgctatttccgtcattgttttgactgatctatctttttggattttggatacccttatttccatcattgttttgattgatctgcctttttggattttggatacccgttgttgtcaccagcttgttgttttgcatctcagttaacttcttggcttacagacccctggcttctgaaaaccacaagctttctggcttttacacggcatctcaacttgtatcagaacatgttgttttctagccccttaagccagtctagcctctggcaacctgagcatcttccccttgtctgactttcatcatatctgctgggcttctgcatcttcactgttaatgtaatgacaatgccttaaattatgtggattatattttcaaaggtgtgttagcgtatcccatctcactttccttatttcaaatgattaacctatcttgatggaaagttgatctttccaatgatttcaaatatgtaccttcatataatttttatatttttataattatacaaattacttacatctcaaccttataaagctcttttttgctcttttatattctaataacagaatagccactagtatgttttttgtgttcttcagaataacctagatcagatatgcacagtctctgattaaaatgatttcttgcatcccagaagcttctgtattatgtcagcaaaattgtgtttatttcacaggctctgtctgataaatattttttgtggtcttcatgtgacaacactgaataacatgcctaaactcagcctcctcttttaaacattcctaccttgagaagactagtgacagaatagcatccacagtactatttagtttaaattaattacaacaaagctcaacgaaaattggcttcgatataccattatttttctattttctttcagttcaggcattatatataattaaagatgccccagtattctacttgcagaagtcatttgctaatgaaggggaagattactgggaatagcataaaaagttcaaaccaccaataaacatttctggaagcttggagctgaaagactgaaactattctggcacatggaagttttaccaagctcttaacctaattatattcctgatacgagttaggctcaatttattccgaagggatgccgcaaagggaagcttatcatgaatactaagggtaatagaaacaattgcttcagtgagcctagtactgtcacagcaggcgcatcagaacagatggctctgcgtttattccagtctagggattcaaattggcagtagtcaaacaaaaatcctgaaaagcatgtcagcagatgtggatatgagttttctttatttaaagagccattcataccattccactgaaaatgcatataaaactggaggtatttgccactttggttaatttgcctattagtgccttcaacttgtggcccatcattttaatatatatatttatatataacatatatacatatataccagcagtatagtaatttctgatatatactattaacctcaagttactatatatatactattattaaatttttgtatagtgtttgtatattatatatttatatgccagctccttaaaatgtgttaatattatatatcaacagttgctaattccttacattaatatatgctattttgcatcttttgagtccaaactgctaccagcataggaattttaacattttctttaaaaataaactagtttagcctgggcacggtggctcacacctgtaatcccagcactttgggaagccaaggtgggcagatcacaaggtcaggagatcaagaccatcctggttaacatggtgaaaccccgtctctactaaaaatacaaaaaattagccaggtgtggtggccctgtagtcccagctactcaggaggctgaagcaggagaatcgcttgaacccaggaggtggaggttgcagtgagccaagattgcacctctgtactccagactgggtgacagagcgggaccctgtctcaaaaaataaatgaataaataaataaactagtttattgtatttttaataaagtatcctaacgtagactattaggattcttcatgacacctgaaatgtattgtcatcaaatgactacacttgttcattagcatctttttctccttgcacaatgagtaattaatagtttctttgggagttaagtaaaaacgaactgacatttttgggccaagaatcctaaattagctctggggtaaaacaaaaactcttacatactcctcaccacctaaaaaaattttcaattaaaaggaaaaaaataaaggataatatcctggtttataatcttgtcaaactggaactatttccagatgagcatggccctctttttcttttacagatgacacagctaagtgcagatgcctaaaaggaagggtttctgatgactttgttttctcaagatatttacatagtctgagcttactcatgaattgtgttaccatgttaggttcaacagctaggctctgactgaactaatttgtcgtggtctctctgtccacaagagtttgtcaaagtaacaactcactatgctattgaactaataacttggtcacagtgtatcttttaacacctagaattctctcatcaatgagtaggcatagcacttgctcataatcttcgtaggctacttctagctaaatgatagattacttatactataatgttatattgccgaatctaacatacaagaaaaatattcagggcctagtggcttttttcagtttcattatatgcttttaaaactttgatgatttatatgatcatagaactttctgttctggcacatgggaagattgaattttttaaagcaaagtatttgtacagattaaacagataacatttgacatcataaaaggataatgaaaacgtataggtgaattaactgaactttagatggggaaagatatcagcctaaatttaaacaaaattttatgaatatgatttactacggtttttactgtggacaaacaatgtagactatggacttcggtttgagtcacaagacaggcacaatggattccactaatctctcagttgtggtggaataaactactataacaaatatgctcaaatgtttattttttagcattcaaggcaggtcttcttaattggcagtttttctccatgtggtggtccaggatacccagcttatgcatgaaaactgcaggtttggttgaaaagtccccacagttaacctgatttataccacagggctaaattccttttgtttaaggctgcagtttaaattagctttttaatttcatttccaattgttgggtttctgcacaagaaattccataatctttaaagctgcattttaacaaatgggaaaataatatccaataaaacaaaagaaaattggaaataagatatcacaacaacaatttaagctggattttctctttgtgaatgtgtatgtatttgtggaaataaagagcagaagtaaattctccaaatgtcaacagtggtcacctttaagtattatggttatgggtgattttttttattagtacaaacacatttattcattaaccaaagggatgatcctaattaatccaacactttgaaatagctgcatgtaaaatgtttgtgataaagatcactgaacacagtaatgaaaagaaaaaaagcagccgtatggagattttctcattcaactgagcttgttcattctcctagctaattcctatccaaagtgatgatggaatttttattctactttttcatagctacaagtacagctgacactgttcatgacaccgttcaccactaatttcccatctttcaattttcttgttaattttctttccttcccatcccaatcctgatgctgaacctctgcaccagctgtaaaatggttacaggtgattttcattgtcctatcactactttctaattgtctacagtgagtagatagtgcttttaaatgagaaaaaggtgcgtgtaaaatacaccttcagctactaaaattgtatatgaattgtcttattaaacttatcacctttctacacaccagttgccaaaacaaacaaacaaacaaacaaaaatcaattaatccccacttgccaagcctgcctggttgtgagctactactctttcctgatagtccacaatagctatagccagcctggttgtgggctacttctctttcctgatagtccacaatagctagtctttaaagttttcttcaataagtcctgactagaaggagaaaaaaaaattaaaactactcacatgatatcatggagatgagctcagacaagaagatccacaacatataatttcttgctactaaattaaagtaaacccaaacaaggtactatcacttttaatttattctcagaatgtagtttgtgtttggggaaaatctgactaatgaatgaataaaatcaagcaaacaaaaaataaataaaatttccctcttggtatgctagataattaatgctttgaatacatgaatcattgctatatatcatgctaagtgctatgtaatgttttaaaaatcttcagatagtacaattttgctggggtgatattgttaagttttaatattttaaatgtgcacatgtggattgtgtaaatgataatgtgtattattaggatttaaagttagaagattttttaaagtaaagccctaaaagcaactgaacaaagaaagcaaaacagatacataacctactagaaatgagagctcagatttcctgacatctcagtttgatgtttgtgtattgtatcccattgtttctctaaaatgggaaatcatgcaatgaaaatgcagaagaaagcaaaatggtgaaaaagagtttgaggtgggccttatccagtcaatggattaaattaaaatggaaagatgctgtcctacattatgcaattgtaataagaacttgaacagaagatttaaaggatagataataaggaggctcaatgttgagtaggtttgcattgggaatcaagtggcagaaaaaaagatgtcagggtaagtttatgtttgttaaagatgagagtattgagagctgggttgggaaactagaacttttccttcaataaaatagccattcatttaacatttcaaattttttctgtttatttatttattttttttgccagggaattaataatccaaaagaacagagaaattcagagctaatggtttcggattatattatttgattaatttggaaagaggtttacctccctgattattcctcccttacagctatattttaacaattctatccaaattttgaaggcattgaaaaatgtcacccagaagctagctgcccacatctggccaaacagaaaaactgactttatcagtaaaaaacgatctgtgacttcaaaaacaatgttcaaaatataatccacttttcaaacaaagatcaagtaaccccacttttaaactgataactcaatgttttgttaatgtgaattgaattacaaaattcaaaatgttaatatttctttattaagacatctgatgggtataatgagtcaatttaagtagatacaaaatgtaaaattgttatgccaaagttctatttagtaatttttcaaaaatttattcataaaccatattttggtgagtttcagtgttaagaaaattccgatcgccataagtatgggaggccgaggtgggcagatcatgaggtcaggagatcgagaccatcctggctaacacggtgaaacaccgtctctactacaaatacaaaaaaaaattagccgggcgcggtggtgggcgcctgcagtcccagcttctagggaggctgaggcgggagaatggcgtgaacccggcaggcagagcttgcagtgagccgagatcgtgccactgcactccagcctgggcaacagagcgagactccgtctcaaaaaaagaaaaaaaaaaaaaagtaaacattttaacacctacccttgatacatcaaggacgttgaaacaaaggtggcagaagaaactatagtctcagtttactgggtattccagaagaggttcataacgtggctctaatgtgttaatgtttgttttatgatatatactagtatgtactttgtttttattccagttttaatagaggtaaagttggtttattgaacagggtggaactggtagtgtaagcagatagcaaccttattctttcccaccattccccattacatgttttcccacatagcctttcaagacatatttagataataaacagtattttatttttgcattaaaattctagttcagtataataaccaagaatgcctggccagtgtggtaataagctcttacgaagtataagctttttcctctgtcaacatgagcttgacccaaccatggaaggctgaggttgggataggtgggtgaggtcagctgctttttttcttttttttatgtagatacatatggtagcagcaccatttattaatccactattttctttcatacttacagtgttgcatttattatatatccagtcctgcataagtgtgtcattcattaaccatttaaccatgtaccaattcaatcctgatttaattactaaaatgttttaaaataacaattaaaatatagttagcaattttgagtcacttatatataaattttaagattaaaaacccttggaaaaactgctagaatttttattttggttgcaataaatgtatagattagttaaggaatcataccatatttataatagtaattctgtcaaatgtaaatatggtatatttctcaacttaggtctaattttgtggtttttaaatcaagttttatgatgctttttatgaattttaggtgcatattttggtgagatttgttcatagatctcttacaactttagtcaataagattgtcatctttttaaataacatgatgcattctgggtaatctcttaataaatatcatttagtttaccaattttctctttgatcttatctaatagggtattttaatccaaccactgatactattaatttaaattatatcatatttttaaaaaagttattgaagtgtcatcttaattattataattttatattgtctgctagattaccatataattatctcaaattcatatggctctaatcctgccctttattttatgtgctgtcttttgcttatggtgtattatttatactgcaaattcatctttggtttggctttttcttttttcttttgaggaggcttccagtatgagataccatataatgatcatgttagcttgttctaaaactccataagaaatctctcattaattatatatacacagagtataaatttgaatatcaaactgctctagttgaagacctaacctccttcaaaatctattttaaaaatcttctccagagtcaggagagcacacaaaaaaatttatttctattactagagttctttagaactttagccattggatatatctttgaataggcagctctctgagggtctcagctttagggagtagccccctctcccttccccacttcctacttctcctgaggcccaagcttttagcttctgtctttgtgtcaaaattgtctccttaaataactaagagcaaccttccaatcatctcttcactacctaggaatccccagtgaaagattaaacattggttgttctggatttaattctgttaggaaacctgaagatacttttttgttgaaaatttagctatgcctttaaaatattttttgttttattttaattcagcctatctaagtgtgtgtaatgagagaaagtttagatcaccttagtctaccatattatatgagtgtatcatttttaaggtatctactcattctgaaactctatatctttattctttttctggtaattaatatgaaactgcatacataattaaggtattcaaagaccaccaaaactaaacaaagaaatttacaaagccatgtctagtaatgtgccagggttgggcaaacacacaacagtgaagaaattcactaagtaatttgctgaaaaggtaaaaacaacaggatttttaaatgctagaaaggagaatttcatgtcaattttgcaaattaagtaagtactggacagtagcacctgcaataggacagaatgagcccataggtttgtacacagttagatgcactgagtcccattgtttattgttcaagaatcagtcttcagcttgctccagtaaaagtctgatgtgccagggtcattcaatatcctgggacctttatcagcttcagttagtcagaactagtggcataacacacagttttttattctgttttctccttagcaagtctgtgggaattcttccttttaagttagtaatttgtataaaagtgaaaatacaataattttgatcttcatgctagtatggacatagatatcacttacctgatctccagctcaaaatattaatatgaattctcttaaacttactaagatgtagtttcttgagttatgatccactatgggcaatgcctcagttctccagagaagtaaactaactgattattttactctcattaaagtcatactttagagcattttcaaaaataaatgactccttttcaccacaataagaagaaatgaattttttttttcaacttcacagagctgaggctctccagacctatttgagctcacagaaccagaaaataatcttatgatttggttttaataatataaatttaactccagctaagagtaaataaaacaaaacataaaatagtgtatcttcaacttaaccctacattttgagattgaaaaattgttctacatcattgtcaattagcttatgaccctgtgttgcaaccaaattagaatatgttgattgattcccatgtaaatgataatattgatagtattcaataactattaggttctcagtgaactctgggaaagaatagataaagcaagcatcattgttttcattttacagcttgatattctccagataaaaaatatacagatactgaatgctaagagtgagtcaattaatgggaaatattcaaagataaaatgtaataacagctttgagcagtaatgaaatattaatttaaagttaaatgtaagtataaaatcagatattatgaaaagtttgctgcaaaaatagggaactcagaggcagttatatttcaagaccacagatcctaacagagttgctgctcaaagtgatgcaagcagaacattgatcttttaacaaaagcattctggtagacattatcttctgaatattttatagatatataatttttaataatttttaacaaataagttgtaaatgtagatccttaatataggttttcatcttttgggcatttcagctttgaaatttggaaaagaaccttaataagatttgaaaatttgaaaatgtatcataattatcattggatatagtataatttccagagactgcaagggaaatcttaattagcaatcatatatgtgtaatataatatttgttttttctaatatatataatgagtaaattttggccagaatgtacattatataataaataggtttctataataaaatatattaactagtattggatattttggcatggggaattaaacacaaatgcttagtaaggttttaaaatatatttactctcatcggcaaaaacattaagatattcagggaattaaatgagaagtattttccagaaaaactcaaaatttgaattagaatactggatttgattctaactcactactgactgcatcgtcaaggattggtgacttgcccactttggcttcaatccactcatgtgtaatacagtgtctcattgtttggcatgacgatcagatgaagaaatgcatatacaagtatgtttcagtggaagatcattatgcccacattacctaaaaatttacttccgctcatgcctgtaatcccagcactttgggaggccgaagtgggaggatcacatggggttaggagtttgagactagcccggccaacatggcaaaaccccgtctctactgaaaatacaaaaattagccgggcgtgttagtgcacacctgtaattccagctgctcaggaggctgaggtaggaggatcgcttgaaccctggaggtggaggttgcagtgagctgagattgcgccattgcacttcagcctgggtgacaagagcaaaactccatctcaaaaaaaaaaaaaattacttctgaaactgttcactcagcatgtatgaaaaccctcaatgtaacctgtatttacacgcataagtcagcctccaaaataagttagtacatccactttaagaatggattgcagtaggttcttaagtttgttggactcttgaaaggtatattccttccctagtacattttctaaaacaaattattcatttgctatcttttaacatatgaaattgttaaggcatgttgacttgatagagtgcttgcttccccttgagaggactcaaaaatgctgcaattttaaatcaaactatggtctcaatggactcaatttcaacacgtcatgccatatgatagggtgaatgaagtcaatgcttaaaaatacccttttagttaccctgtatttccatactggattccaatgttcaaggtaattctttgcacaataaaaagcaattcctctctttaccagaaggtggcactgcacccctcactgtcattctgaggtgggtgctgtgaagagattattcaacaatctagaaagaagctgggctttagaacattttatttgaaataatgagacacatgtgattaatttcctaaagaataattttacttttgtcatattggggaaagatgtgcatactaagtaaaaatgaacagctgttgagaataaaaggaaaatgcttcatttagaatctattaatttctatcatcattgttcagtacaatattctcagacttaattactcatgtaaagaacagtatgactaaatgtgaaataaagttttctttactcccttcaagatctgttctccttctaaccacaaactgtgccactgacattttattatttattttttaacatagaaatcccactagggtaactaatttcattctgaaacccatttatttatgttgtgatatgacagtacctactttggctttttttttctctctcctagtcccacctcagtctcatgggagtaaataaatcaatcattactgcaggaatctctccttcgagagaacagggctctttaaaaatactagttgcatatgtaatatttaaacacctgatttttaaaaaaattcctgagacagttgagatagccttccatgcagttccaaatgtattgtttgctgatggcaggaggaaagaaaggagacagtgaaaagacttattgacagatgaaaggggctcaacttgattatattttaagaaatacaataggagaaattcatgttactaaaagcacaagcactcaattaattaattgtcagaatcaggagtaaaaattgcatcttacaagagagaaagtaaagggaaaggataagaaaaagtgaagatgcctttattttatgtatttatttattttgtacccttgattttgaataaatagttttactcctattcactaaatccatgacaataatggtatgaaataaaagtaagaccagataaaaatacctatgatgctcattgtttaaatgaatcattccacatttaattgaatagatttaataagtaaatataattgctgcataacagttatatataacagggtttttcacatttctttttcctaattatcataaaataaataaaaattcagcaatatgtttaatttttattttgaacatggaggaaaaagaattgcttagttgacatatttggtggccttccactttctggttcagcatctaagaaatttgcacatcaccatgccacccgacagcaggtgaaaagctaaacaacagaaaagccaacagtccttcttagctctgttagagcagtgaggtcacgaggcaatcactgccctaaaacttggagagacaggcaggtacaaaacatcacaacttactaaagcagaaactcacttgctgaaagcacaacaggaactggtgtagggggaggataacctgatggataattgatgcattgctggaggctgaaaactccaggggcacctagtcatagaaggggcatcacacttgtgaattttaccttcaggagctttactaggtccccacggtgactatctgagaaaaatccctttatgtttccagcaggaaggggagaaaaggaaccatttaaaaatatgtcagaactttctgttcctcttaacttggcccatcctcaggagaaactattttaccagacccaatcttttgggatttcattaacagccaaacctacctggagggagggaaatacccaactctagccaactctagtctcccaagtggggcaagggaactatgcaactccagccacctccagccgttctgtccccaccttagttggggacaatgagaatgacttgtgaagttcagagtccagaagttcaggctcactaaaagactgaccctaaatattagactgtagaacaattctgttccccctccagcatgccactacattactgaaggcctgtttacttcagtttcttttacatcgtgtctgcctttccatacacgtgcacacacacacacacacaaaagtttcaagagactgaacgagtatgagaatcagagtcagatatggcagggttttggaattattgggccaggcattttttttttaaagctatgattaatatgctaagagctttaatggaaatacaagaacagatggataatgtaaccagagaggtagaaattccaggaaagattaaagaaagtgctgtcaaataaatgaataatgcttttcaatgggctcattagtatacaggaaagaactgagaaaagaatctatgagcttgaagatttcgcaacagacacttccaaaactgaaaagcaaaagaaggaaaggaacagaagtaacattgggagaaataatgactgacaattttcccaaattcatgtcagacaccaattcacagatccacgaagctcagagaacaccagccagaacaactgcttaaaaaactacccctaggcagattatgtacaagctggagaaaatcaaagatgaaaaatcttgaaagaagcttataaaaaagcaaaaataagaattacatctgacttctcctcagaaaccatgctagcaagaagaaagtggaataaaatattcaaagtgttgagagagaaaaaaaaccaccaatggagaattctctactctatgaaataatccttcaaaagtaaagaagaaacactttcttagacaaacagaattttagagaatttgttgccagtggaactgccttgcaaaaaatcttaagtgcttcagagagaagaaaaaattatataggtcctaaaatcatatctacatagagaaaggaagaacatcagaaaattaataaatcaaagtaaaatttgaaaaagttatttttcttcgttgcagtaatacataatttcttcactataatagtagcaacaatattttggattccatatacttatgcattatatatgcatatgtatgcttatacataagtgaaacgaatgataatgatacaagagataggaggaaggaattaggaagattttgttataaagtaattgcactgcttgtgaagtgatacagtgttatttgaaagtgtatttggattcatttaaaatgtatattgcaaactctatgaaaaccattttaaaaactaaaaaatgaaaaagtataatcgataagctaagacaggagagaaaatgaaatcatatgctcaattaaaaccacaaaaggcagaaggtagaagaaaaacaacaaagaacaagggcatcagatagaaaattataacaaatacggtaggttttactccaactgtatcaataatcaccttaaacctgaaagttctaaatataccaattaaaagacagagattgtaagaatagatgaaaaatcaagacctacctatatgttgtctataaaatacccactttaaaatataaaaacacatgtagattaaagcaaaaggatggcaaaagatataccatgaacataatcaagagtaactgagactagctatgttaatttcagacagagtgagcttcagacaggaaagttactggagataaaaaaggggcattatatagtgataaagggtcaatactccaagaagatatagcaatccttcatgtgtatgtacctaataacaaagtgtcaaaatacgtcaggcaaaggctgatagacatcccaccattaagatatacaggtggcatataagaatataaaaacatgttcaacatcatatgtcttaagaaattacaaattttaaaaaatgagatatcattactcatctataaaaatggccaaaattcacaacactgacaccaccaaatgctggtgagaatgtggagcagctggaactctcaataattgctgacgggaatgtaaaatgctacaaccactttgaaagagagtttgtcagtttcttagaaaattaaacatactcttaccatatgttccatcaattgcactacccaaatgaattaaaaacttatatccatatagaaagcagtacatggatctttacagcagctttattaataattgacaaaagttggaagcaaccaagttgccattttgtaagtgaatgaattaactgcggtatatctagacaatggaatataattcagtacttgtaagaagtaagctatcaagttatgagaagacatgggggaatattaaatgctcttactaaaagaatgaagccagtctggaaaggctcaagactctgtaattctaactaaaaatgctcctcagcttccaaatgggattgcacgctcattgtaaattgtaaatattgtaggttgaaagtgtatttttgactcaggatatttttaatttacagtaggtttatccagacacaaccccgttgtaagtcacagaacataatgaaggtgtattgctcctgcaccacagtaaaatcaagaaattacaaatcaaaccattgtaaattagggactgtctgtatataatattctggaaaaggaaaaattatggtgacagtgaaaaaattagtcgttgctaagggttaggaggtgaagggggtgaatagatagaggacaaataatttttaaggtggtgaagctattctgtatgaagctacagtggttgatacttgttattatacatttgtcaaaactcagagaacgtacaataccaagagcaaaccctaatgtcaattgatactttggatgataatgatgtgtcaatgttggttcatttattaaaacaaatataccactctcgcaggggaaactgataaatggggaaggtgtgcgagtggggttgggagtatataggaactctgtactttccattcaattttgttgtgaacatataactgctctaaaagtttattaattaatatatacatatggagctcatttttcaaggaaattatccaacattttatggactaggtttagtaagtaaaaataaatgcgtgataacaatgatcattccttttttcacatttctttcttctaaattgtcttaaaattataaaaagcaatatgagtttatttttaattctaaatgtggagaaaaaaagtattgtttagttgaagcatttggtaattatgaaattagatgtctattggagagaacagtgtttattaattttagctgacaagggaataatttaaaaagctttcattttagattaattttatgtctatgcccacgtatgggattgcagattactgaaatgtagaacatactttacagcaaataagtttaataccattatgtttgcatgacaaatacacatatttttcattattactttttttaaaatttgaaataatttgaaaaaaatttactgagaatttattaaaaacatattgctgccaggcgctgtggctcatgcctataattccagcactttgggaggtcaaggcgggcggatcacaaggtcaggagtttgagaccagcctggccaacatagtgaaatcccatctctactaaaaatacaaaaattagctgggtgtgttggcgagtgcctgtaatcccagctactcaggaggctgaagcaggagaattgcttaaaccaggatgctggaggttgcagtgagccgagatggcgccactgcactccagcctgggcgacagagcgagactctgtctcaaaaaaaaataataaaaaatatattgcatattatgctcaggtagaaatttcaagaatattattaattcaatttctgcctacaaaattttacattgaaataaaatattttctttttccaataaaaaaagcagagtttactggttcataactcaaaatggaatcaaatagcatacatatttgcatttatattatgaaacaatacaaattctgaactccatatctccagtactgtgaaagagtaacagtattcactttattttgtgtatgtaactaacaggaaaggagaattcccagagagtttcctatattggataatagatgagagaatcctatattggataatggacaagagagaattatttaactccagatttgattaaaatgataaaactacctcttaagaatgattatagttcaactctgaaatgtaaacttaaaccattttcctatcattgtaaacaaattaatccgacagttatattcactcctactggtgtgctaaggaattgttgacactctttgggcaggatctaagtggctacacccattcggctctgccccagaagtcctgcatcctttctgatacttccttaattaaattacatgtacactacattctctttcaagaggcttttattggccaagaagattaaccactccattctttgttcccattatactccatacagctttttgttgcacaggtaattacgtactgctatatttttacttatttatttcttcttatccaactatatacattttaaggggaagagaaataatattctttttgaatctgcagtgtttagtaccatggtgaactcagtgcctggccaatagcagaaactcaacagtaacttaatacatctttgttatacgaatgaaaggaaagaagggaggaagaataatggaaattatcatagtttatggagtccatttaagtactattacttctttatggcaatttactctcataacaaccttatgaagtacagattattatcctcattttacaactaaaacaaaacacaaggtgatgatcagagagtttaagcaccttgcctgaattcacacagttcatcctgtgtgcttgggatgcaaatagtgagtacctccgactccagagcaacactcaggacatgacaatgttcagaaggtgtgtgatgcatgccataggctctccctcataaaaacacacttgatcctaataccgtcactgtggactagatattaggatccattatttgcagatgagaaagaaaacagttaaaacaagtctcctgtctgagcaattttgaaaggtgctaggctacagagatgccatgattataagttcaaggttcattcactgccacaaacctgtcttataatacttttgcatatttcctcactgaaaaatagtatcctcattcagaaattacataatggccatagctaggtaagtgtgttctgtgaatttggaaatcagtttcagtttgctgcagcctgcaggtattctcaaatgcatcagagagtagactaggaaaaataaaactgaaatgtaaaaggaatgagcagggggtgtatattaggctctttctgacctagtattagcctccccatcagatttcacttccaatggtctttctccaacaacatggtctttcaggcctttccttgtaatctaaggtagagtgagaaggaaagtgattttagggtcatgattgaatggctaacagcacaaattcaaagacttcttttatcaggaaaaaataaggttattttatggtaattatcattggaaattctaaaccttaaatcagagaagcattagcagtcaaagatctctgctgtagatttgtggagtttgtattacattacagatattttagaaaggcataaattgaaaccaacgataagaattgacaatgaatctgaaaatcaagccactaagactgcatggcccttcaagataaatcaacattataatattcaatattaagctctatgcattttctcatacaataaaatagttttgatctctaatctagagacagccaaaaaacggtggtggtggttgttctttttaattcagtgatacatatgtgcagtgcctaaaactaaacaagacagggcctaatcagcgtctggtattataaatttacaaaagaggagtaaaaaagaattaagccaagctccgtgcaaagtgtgtcatctttattaggtttatagtcattatttaatttaacctttaaaataaccccttgagttaggagcgtattggctccaaataaattaccagtatattgatcttactgtatggcaagtatttgaatctcagattcaaacccaaatttttttggaggccaaatcaactgcttttcataactacactgcattcccactcatatgcttctactgacaccacgtatgtaaatgggtcagtagccatggtgaagttaaggacacaagaataaaccactgatttagaatcataactgaagctagatgacagggcacatggcaaacacgaaatatctggcaaggtcagttttgatgaacagtgactgtaataaactcaaatgatacttcatttagaataagttatttatatacttaataaaaatcattatagcctttaattacttaggttcatttgtcattaactttatcccgggttttcactgatctacccattcatctactcagcatatacttatgtgctcactgtgtaccaggactcagaagggggctctgagagtgacctgaagagtgaataggggtttaaggagagtgtagcacttttaacaaggaggcgcaggccctttggcatggaactgccaagactttcagggtctgaaagagagccagttgaggcaggcgctcagggcaaagtggaagcacagcggaaaactaattaaagttaattttgcttttcattaatattatcttcaaaatttacatttctatgtgtaatatttattgggaaaaaagatgtatccccttgaaaaaaaagtaatgctacatgatatgctaacaatgaagtactaagtatctatataaaatagtttgaaaactttgaaaaattaatatcaattttacagccatttatgctgatagcacctgatattttataagatttaattagacagattatgttttattttaaaggtatgtacttcttacacaggaatatgaatagaaataaagatttctatgtacaaaggcacttaatacatatatttaatatctattttaaattttaattgaaatggttttttaagagggaaaagtctaggtttcattagctttttattgttctatatttaatcagccctaaaatataattacagccctagaatataattactgtcaaatgaaagctttattataatctaactggccccactaaaaattttagtcatgaagtctcagagaaatttcacttttgtttgtaaaacttttcctatggcccctctgttcacaatccaaaggcaacatttctctagctgctcagctattctgttttctgctttctaacatgccaacatcaaaagctgtaactctgcccttttctcttcgtatccatgtcagacgcagggtaactgggagagctttcaatatcaacagcagctcatcttactgataaacaggcgcagacagaagcagatggtttctaggcacagaaagcagtgggtgaaagtggtacactcccgtttctatcttcagagagtgtaaaatattttatcctgaatgacatgctcctaagttaaaataatatttatttgggtaggcctgctatacaggaaatgttaagataccgaaaacggtacactggaaacaatatgaatcgtgcaacaaaagcgagtgaactctgaagatgagggaagtgagtcgcaccacagacagcagtgggggatagcaactctaacaaagtctccgctcctgcgaagagctcattcaagcacctcccttttaaagggtattcctaataccctttggaagtttcttcttcccttcactcacaatttcccttctctgaggttccaaggatgtgaaaaaaaaataataagataaaaacccccagaccataaattttcttacagacttcatatagagggatatatgatagatacagatataaataatattgacataaataagtgtatctacatccgtctatatctatagaacgtctatacctatctatatctttataactatattgatcgctgtaggtagatctagatatcaggaagtaaaagggaagctggaaaatatgatttatatacaaagattaaatctttgctcaaatcacttgaagggcaaaccacatatattttttcctattggggtttgtttgagacagggtctcgctttttctcccaggatggagtgtggtggtacaacctcagctcatggcagcctcaacccccaaggctcaagagatcctcccatctcttcctcccaagtagcctgaactttagggcatcgccatcacatctggctaatttttttttttttttgtatttttgtatttttgctagagatggggctttgccatgtttcccagactggtctcgaactcctgggcttaagcgatccacctgcctcagcctcccaaagtcctaggattacaggcatgagtcaccgagccaggcaccccatatgtcttaagataaaatccagatgtcttactgcttcccaaacaactccgtatgataccctacttccacctctaccactctgagtcattgcatgccaacagtagtacattgcagccatgtgggccttcttttgattcccaacatgccaaaaaaatccttgcctcaaagtccttgcacttgttattttcctattcctggaattcatgtgcctgactctggacctgaggcttcttatcttctcagtctaaagtcaaatatcaccttctctgaggaatcatttctgactttatctgaataattcagccatcccccaatatcatagcatcctattattttacatcagagaaattatcccaatctaaaaatgtcttgttacatgtttgtctatatattacctatttgtatatgatatgtctctccacactaaaatgctaccttcatgagaacagcatccttactggtgctacattcctctatatcctttaacctaggatggagcctgttactaagagatgtccaataaaaatttcttctgttgataggttggttgatacctcattgacagatcatagatatgctccttattaattaataatacttctttcttaatgaatgatgatttccccacagcattctaaagtccaaattgatgacttatagttcagatatttgaatgaccaaattagctcaaatattattcttgcttccatcatgaatgtggattaatgtggactgatgtggattaaatgtaggcagactggcagtgagtaaagtcaggatgtagacacattgctcccgtcaagactgatgtcaagaggaaatcaccagctgtctagcctttgaagccaatgggaagattacttattgacctgatacattttcacttctgattcagagtgggcattcgtacaatctttgcaagtaaattatagctataaaaggatccccaaaaaaattatttctgacaatttggggagagtaggtcacatctctatctcagaaaccgagaaatggtcatatactaaaatgagaaggaaaatggtgagtctgaaccaggtcttattccattaattccatactcaaattgagacaccatagagatagcagacacacagatgataagtatttttcataagcaatattgatttttgtatttcatttttaaaagtgcttagcattcagaggaagccaaaaaatactgtttgatactcttctatggaaaaataatttgccactaactgacacatcaatgctacatcaaaggaaattacagagcgctcagtagtactaaagctagggcatgaggcccatttagaattggatttttgttgccacataggttattacttctgtaaaacatgcatatgtgatcatcgtttggttagggagcagaaaataatatttgaaaagtgcatttttctgttttactgcacggacctgtgtctttcagtctccacaatcagcaacttctagcctgacccactcaatataaaaagatatgtaaaatatctgcgggtttaacttattccaaaatcaccccttatttaagttggatgcaaaattaacaaattaatagacttttcatttaattccaaaatataaatgtctccagttatagaaaatggttaattctcaatatttgagataaaattgaataataaaaaaagatattttctttcataaaaatttaaagtaggttccatcattgttggaaataaaatattgacttgaaatactgtctactttcaattagactgtaattacaaagagaacattggtcattatttttacactttgtatgtttggctattttataggcaaatattaaaggcccaatattccaacactactaaagaaatattagaattggatctatcctgggactgtcttctgtccacgcaagagacttgcccctttgaaataaaccaaaaaagcattgaagttttattttaaaattcaggcagaaatgttgacactgcctgtatcaatttaaacacaattttttttaaaaaaagccacaagaaatccctctagactgctgtatataacatcgtgtctcaggaatttctttgagaaaataggtacaggtaaaagcttgcaatatacattttttaaaataaaactttagagcaagctgaggattacctggattttgttagtatgtcatgctgaaaaacacttatacttacctaagtctttgctcaatgtattttcattgagaatatgaagcacagccattctaactttaaatttggccaagctttgttttgattatgtaagaacataccaggaaaggatgactgtgtactttgaattcatcttaattttctttcttttatatttccctttttccaagtgccaaataaaatttttctcacgttttcttttaaaacatgagttcagaataaaattaagaggaaaaaaatcaatctcaatgagtgttttattcacatctatgaacgctattgtgctcttacttgatgtgactaagtgacatttgctgtcaaacaaaacaattacggctgtattacccttaatcataaacatttgctaagcacacatttgtttttcagtaactgtgttagccagagctcttttggtggtaaatgcaagacattcaactcgaatgtacttaagcaaaacaggtaattatttggctcacataaaactatacaaggcctcaataagaggaactagaaaattataacagttgagattctccctacctctcattttctgttatgttccaaacaaattatctcagactgttttttgacaaggttaaaagcatgatttcagacattatcagtgcttatatcctcatacctatctaaaaattccagctttcagcttcattttgtaaaaccatgggggagtttccaactggattcgattggatcatgtgcccaaagctagaccaattattgtagctaaagaattaggtacaatgattggacgagccctggtcaggtggcatcattaaatcaaaaactgtaactgtggagttagcttcacgggaaaagatgctggctcctgttgtgacctcagggtcggagtatgagaagtgtatctaaactgaagaattcaggacacatttcccagaataaattggaggagtgtagggagagcaacagacagacacacaggcactcagacacacacacacacacacacacacacacacacacacgcacacacacgggaggttacgccttctctctcttcctattctttcatcttccctatcattaaggatatactgaacgtcatcatctctggactttagtgaatgccaatggtaaagatctgatattgtttaggttattcatgatctttattctgtaaaagtctgagatgccattatttatgcctttcactcttgaagagaagatattaatgttatggacaaagatgtaaactttacataaaatgatggatgagatggttgaaaatggtatttcatcagttctaagttacaacagtgacacttggttaaatctaatatttgatacattgctgttggccgaggagcagccatggcacattgtcacttcaattgatgtgcatggttgatactacaagtgttgggttcaactgtcatagaagatatctttaaaacaggttacactatggttcagcatgaaaacaaaaaaatacatattgtcttcacagaaagtttctagaacacagcagtgatgcatgcatttgatattcctgaagcaaatatttagcatctgaagaatgaactccattccatttttttttcttttggaacaaaacccaagtgttttagaagacctaagatagtaggattcccacaagttgatgaagctatgctaggttactgattcaggtacaatgcaactacaggtgggggagattgctagatgtcttgaaagagacaaaagaaattaaagaacacaagaatattgaatgactaaattatgtagaattagtattaagatagcatgtgaaaccttgccaggaattttctttagtgtacataaagcaataatacatctgacaattgatggagtctttgatgtcaacaaaatacagtaataagggaaattgatttttacttcatggaagttactttggcaacattgtgaagtagcaggattgttacaatagtaatcagattacttaaattttaatccttggtgctatcaccaactaattgtgctgtctaaggaaagtcaattaaatacttaggtcttcatttacactataaagattttggactatagattatgtcagaagtcagtctcaaacattaagtgacatgattctagatgaactaaagaatgtaaaaatgttttattattcattttaagaatgatggtttgaaaatactgtaactgtagcttggtcattagtaattttcagaggccagtgtaatatttttactttcagttctggaataatgtatctagatcacatacctaatgtttccagttgagatagatttagcatgcagaacaggctatgttttgtgtttttcttaaccttcaaagtgtttgttattttgattagtgtttatacattcagacagattagtgaggcaataaataggagtaaatgctaaaggacagctaatcaagtgagtgagaagcaaatagccacttactatagactacggttataattcaaaagcatgtgaagcattatcattttgatgtagtgtttttagaccaaacgttgtaactagaacaaacaaatagttacacactagcacactggaggatatggtcattaagaaccaaagattttctaataagagacggtaatctttctcagaggccacaggcagttttagtgcccatttattgaaaatgtagtgcaacattttaaaaagtcaagcacaaacattttattgtactgggttcttagggtctgagaacctgaaggtcacttgagttgttaatataatcctttccccatctttaagaatgatataaactaaattatcccacattctttctactggaaaaatgctgagaaaaaaaatagacaaatgaattccattatctcctaggatagcattcttctgaagcacattttttacaattagtatcatgtcaacttttcaagagaacttatgctccttattaatttacaagaaaaaaaattatgaaatattagaactagaagaaaagctaacaatcatacaatcaatgtttgattttagaaatcaagcaacatagtacaaaaagcttaaataaatattcacccccatagaactagttgatgacaaactggatgtggagcccagatcttttaatttttactttaataatttaatattttgcacacttttcatttactttaaaaccaaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagacataaaaaatgatgagttcatatcctttgtagggacatggatgaaattggaaaccatcattctcagtaaactatcacaagaacaaaaaaccaaacaccacatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaatatatatatataaaaaaataaataaataaaaccaaaataatctctagcaattgattatgccactcctttaccatccagtcatttgactttaacttccaaaaacttactaggaaaaaaaaaaaatcagcaacagaaggaaaatctcgatgactcgcaggcagaataaataaaaagacaatcacatcaatggtgaatctcggtaaaactgctgaaatcaaaatcaaagagaaaataatagaagcaggccagaaataaaaagcctcttctttctcaaatgaaaaaaaagaagcagtaataaaactaatagctaacttctcaatagtaaaacaaaattgaagtcagaatgcagtggtttaacatctttaaaatgtgaaagaaaacacctaatcttaaagctcatgttatattaaaatatctttccagtatgaaaggaaaataaagttgcttctagacaatcagaaaagaatgggagaatttgtttctagaaaacttctattaaatactaaagggattgttcaggcagaggaaaatgatcctagtgagagacaaggaaattcaggaataaataaatggcaattgaaaggataaatctataagtaattgtacatgaacattgacttgcataaaatgatactaatggcttatgaggtttaccatatatgccaatcaaataattagaatacaagctagaaaaaataaatggttttaactctttctaagacccttgcaatgtctgggaagtggtaacattacaaatattgattaatgtttgccaagaactagccaaactccaaagtttgatggtacagtccctcagactgccgagtctgcccagacttcggaaaccaacagcaaggaatcagggtccaattacaaaattaaagggaaaagtccacacaacactaccctctcttttgacaccaactgcaagttttgagagttcccacaacaattctgcgttgataattcactagaaaaacttacagaactcactgaaagccattatgctattatgctcatagttgtgatttatcataaagaaaagatacagatccaaaggaagaaacacatagggcagagtctggaaggtttccaaacatgagctttctacccttttcagaacacattaccctctggcaacaatgtgtgacaaaacacacagaatgttgtcaatccaggaagctcataggagcattgagacctagaggtttttttgtttgttttttggtttttgtttgttgtttgtttgttttagacagagtctcgctctttctcccaggctggagtgcagtggcgcaatctcggctcactgcaatctccgcctcctgggttcatgccattctcctgcctcagcctctccagtagctgggactacaggtgcccgccaccacacctggctatttttttgtatttttagtagagaaggggtttcaccatgttagctaagatggtctcgatctcctgacctcgtgatccgcccacctcggcctcccagagtgctgggattacaggcctgagccaccgcacccggccctgttttgtttttttgtttgtttgtttatttgtttgttttttgagacagttttgctcttattgcccaggctgaagtgcaatggcatgatcttggagacctagagtttttattagggtttcattacataggcatgattgattgattaattacctatctgattttacttggtcttccaggtctccatcatgcccctctctggaggtcaagctgatgtcacatgggctgaggggctcaccaggagtcacctcattagcataaattatcaggtgtggcccaggcagcccactataaataacaaagactctccgatcattcctccaactccaagggtttcattagaggttactttctagaaagcgggaacaaaattcagacctctctttgggcaaggacaaattctttactacagagggcacattctgggcttttggccaagcctttcttacagcaaaacatcacatttgtctagacatttacatttaataaagcatttatatgacagctgcaacagtgatatcattataaatatacctaacgtttggaggagccatttggaacagtgatacgtttataaaacaactatttcggccaggcgcggtggctcacgcctgtaatcctagcactttcggaggcccaggcgggtggatcacctgagatcaggagttcaagaccagcccggccaacatggcgaaagccccgctctactaaaaatacaaaaattagggtgatggcacatgcctgtaacctcagctaatcgggaagctgaggaaggacaatcgctggaacacaagaggtggaggttgcagtgagcagagatcgcaccactgcactccagcctgcgccatgggagcaagactccatctcaaaaaaaaaaaaaaaaaaaaacccaacaacgattccattctgtaatgtcattccatatatatatatttgttgttgttattgttgttgttgttatcgttgttgtgttttttttatttttttttttattttttttttttttttgagacagagtctcggtctgtcgcccaggctggagtgtagtggcgcaatctcggctcactgcaagctccgcctcccgggtcacgccattctcctgcctcagcctcccgagtagctgcgactacaggcgcctgccaccacgcccggctaatttttttgtagttttagtagagacggggtttcaccatgttagccaggatggtctcgatctcctgacctcgtgatccacccgcttcggcctcccaaagtgctgggagctcggctcccaaagtgcggtggctggaatgcagccaccgcacccggctgtcatgccatgtatttttatgttttgttccttggtttaccattatttgtaccttaaaataaacttatgcagaactatagaacctagaaattattgaatagttagattaattttgtttttcctcagaccagtcattttccactaatattatatcctgaagatgcttttacttaatttccttatacatttgaccatcaatatcagtattataatcttaccaacaaggccagtgttacaacataccatagtatggcagatggaatctgaaaaataagagtcaaaaaagactagcatattgttagaatctcattctgtcattaacaattagttcaatccatcatcacatcatgtgaccaaaatgtcttctagaccaatgcctctcaggtttgctggtttacatttaaccttgccaggttccaaaagatggaatggtcttcaccctttcaggcatctaggataactgagctaaaggacaaaaatcatcttttgctatgagcctctcttgaggtattaatataatattgaattttcctttttgcctatcttcttattcattttttaaccttcagctgttacttgagcttcacttcatttgttatttaattttacccaaacttttctaccttggaagggatattaggttcagccactgttgccagttctgactaccagcagcagtactagtctagcaagtccctcctctctttcctttcccattcatataggtagagctagaaagctggtggattgtcttgagcactagaaaatacagctccattcactttccaccacaattttgccagatggagtaaaggcacaagccaagcccactaacccctgaggaattctgatataaagttttaaaggtataatttcttgcttaggaatcattcatgcttcctgcacccacagctgcagccctagtcctgaaaccactacatcggatagcaaaaaaagaaagttgagaacatgtggggaaaagaaaaaagtctagtcctacactatctgcttttccctccaccataatatagttagaccagtattctccccacctctacttctcctgatcctccagaggaagaaaggaatctgtctattgagaaacctcacttggccaccttcatgttgaatttgagtattcactgctagagacatataatccagcccttcttgccttcatcttctcttattttagacaattgttttaattgcctattccaattctttttcaaaccattactctgcggttatctgtctactcattcttagacattatgacctgtaaaatttcttggtctgagaaactgtgaattggttgtccaagttggtgcaatatattctattatgatgcgcttatagtactctgaacatttttatctaccactaggtatgcaagtccagtccggaataaatgcctattcctgttaggaccaatttgtagctcccaagggctatttgtaacaattaaacttgtcccccatgtacagagctgcctcctgagggaatagccatgtgtagcctctgtcgttcttgttagcagacagcagtttgtattgacatttgtgtgccctagaaggtgcaggaggaataggtctgaattcagccgttctctgcattcctgcagcccctgagtgttcactcatttcatggacccaggtggccacctcaagccagttcaacaaaaggtccacttcctggttccagtcgccttctgatcttggaacggggttcttccgatggcattggcatatctgattttaatgttctcccttaaatttccagagtgatttccatggggtcccgccccatatgggtatccatttactaggctggtttcccattccctttctcccagacctatatgggtgggctgttggccactactcattagtcagtaaaaacccaaatatagaggccaaccatattctattaatcccactaagtttgtttatttttacctgcttttcagcaaaggtcttccaaataggatactgttcattcatcttggaattgctgtccataagccaagcaactctatgagaaacatcttgaatataaggacattattaggcttaaaaataaaaaggatggggaaggatagaatatgcaaaaactaaagaaaattgctttaactactgctttcagatacagttgactttaaggcaataaagaaataaagaggaatttttcataaagatgaaagggtcgctctaccataatgacatgacatttctgtatttatttgcaaaaatttacacaaacttaaatagacaggaattcacatatctttttcaataacttcagataaaggataacaagcatatataagactaaaaacataatttatagatctgttctaattgacacagagaatgctgcacccaataataaaacatcaagcccaacaatgacagaaagcacatccttttcaagttcacagaggatatttaccaaattgataatatgatggatcataaaatatagcttagagtatttctctgaccacagtgaaaactaaactaaaatattagatacagagtaatgttagcagctacattgagattttgaaatcaaattaacatagcagagaaactacaaatctatattttattatgaaacattccttttacctgttatacataatttatattacaacttccaattaaacttcataaaaatgagatgtattgcttaaatctctgtcagttatttctgaatgccttaaattaaatgtttgacatagagatgtatcccttcatagtcagagcttaacatcatgaattgtttgtatactaattaggatgttcataacaaaatgccacaattttagatctgggaggaatttggaggccatattacaagtgggaatattaggtcaccaaatagaaagaaaagggtggttatttaaaccattggggttaagtttcaactttgccctctgtcctgtggcagagtgtgagattgaaatgctgaactccactctcctgtatataatgattataataaattgttgtctactaactgcaaaagcatataaagaattggaactaacatccacagaaggcctaatgactgctgttaataagcttgcccctgaatctgtgagttgtttaatcacagttaatgctcccaacaaccttgtgacacagtagatataaaaataacatgtgtgtgagaatactgcattaactgtaaaaaaaaaatagtgtctagttattatctcatgcaaacaaaattatgtttgtattctcatccaccatatgttagacagtgtattagggttctctagagggacagaactaataggatagatatatatataaaggggagtttattaaggaatattgactcacacgattacaaggtgaggtcccacaataggccatctgcaagctgaggaggaaagatgccagtctgagtcccaaagatgaagagcttggagtccagtgttccaggacaggaaacatccagcatgggagacaagtgtaggctgggaggctaagtcagcctagtctttccacgttcttctgcctgcttttattctagccatgctggcagctgattagattgtgcccacccagattgagggtggatcggcctttcccagtccactgactcaaatgttaatctcctttggcaacaccctcatagacacacctaggaacaatactttgcatccttcaatccaatcaagtcgacactcaatattaaccatcacagatagttaacatgttatcagtattacattgatgagaccctattttaattgatttttctagtaccgtaaagactcaaagttgtagtatatttcttttttatagtggattctgatttcctactaaatgactcaaaatgtttaagtgccttaatagatattttaaaaattgctttaggaaattttgacaattcttcttgagaattggggttcagttctcatgttttttctttttagcattactaaaaatagttgattcttgaatgtaaaatttgattgactaacgttatcactagacttccttttatctacagctatctgttatcttcaggcgaactagtgaacctctccagtttctaataatatatgaataacaatttataacagtggtccataatttttttttgaatactgagaccatggtatagataaaaatattcataacagttaagatctgttggagtatagatgagttaaaatctgtagaatataaatcatatataaaacaaagtattcagactatgtatatgtaagggaatagcaaaagctctgagtcatgctagaaataagcttttattattcctcttgactatagtaagtctggtttctcaagtcagaaatgaaaatggactaaaaaacaggtgtgtgttggcatgactttgagaagagggcaatgaaataaatcaggcagacatcacgcttacttctttcttttagatttcatttccttctatcttgtaatgaaggcttttgttttttaaatgcatcctgaggcactggttctaccaccccacaaacagctgaattttaaacaactcctttaatatgaagttattttattttgaattggattttccagagtcgtgtttactgccttggataaacagggcctcagacatgtaataaataggtgagtaaaataaatgattttatttatttatgaggaaaagcacttgaaaatggctaattcttggtatatgcaaagtgggagggcttggaaggaaaggatatctattgaattgaggtattacattcttggtcctgagaactcttaaggcaaacaagcacaatgggtgttttatatgttttctaaaagtcagttttattaaaagtgttttttggctgccaatttcctatccagaatccatccatcttgctcttcctcattcctgacaccctgtctatgtaacccatgtatgagtcaggagaagttgattctgccctcagttctaagggtggttcctgaaatcaaaaccaactgtggttctcccagccctcaattttccaagagttggttcattcaagaacctggccttagccaagcagtttgtaacctttctctgaagcctgatactggctaaggaagtggctttccaagtgtgtccagcagcagcaacatcgtctggggacagaaatgtgaattcttaggatctgggacttactgggtgagaaacttcaggagagagccccagcaatctgcattttaataagccctccaggtgattctgaggcacaaatttgagaactcctgaattagataataggagctcctcaattagataggagctcctgaattagataggctcaatctgatccaaggagaggatttttatctcatggatgtgagaaaggtttcgtctgttcctattgatttgaatcaggaactaaattatccccactgctgctggcagcctttctgacagcatcagagattttggcctgttgattgcaaaagtcaaaatgtttgtcgtcttcacctcaaattaacagattgataccaaatccccaatgtgttggtatttggaggtggggcctttgggaagtgattgggtcacaagggtggagccctgttccgcaggtggtaagtgccacaataaagcaaaaaaaaaaaaaaaagacaatgacatgtttggattgcaattttagatgagatggccagaaaatctatcctgagaggatgccatgcagttagacaggacggtggagatcaaagccggggagggaacatttatgaagtaggtaccattagcctcacctctagctatgcaaactgagacagatagaggtgaagcagtttgcccaggattacaggggtaataaatgataggatcgtgatttggactgaggactgtctagagctctgaagtatgagtatttttatttacagtatattttttctagcaacatgttagaacatgtaaaaagcaatcttctattattagtaataatgagggaaaacagcaaaattcatgagcagctttgttaaatttctttggaactcttccattgcttaagacagtccttcaaagagcaaaatatcttaaagaggaagaaatttccatcttcttacatgtttaaattaaactgcttgcaacatggatctacctttgtttggagatgtgggggaccctaagtagtaatgaattttcctttgcttattctagagcttgttattcagcttgtatgggcaagttggtaaaacactgagatactttggatccagaaatagctgctgccttaacctccactaatgtcctctgggcacagcagtgaccctagttcttccattaggaccttgctttggtccggtacctaaagactttacctggcagagtaggggactccacaccctatgctgttgccaatgtctattccaattagttggtgccttcactggaccaattaaacattgcatgtatcatctctatactctgtcatccttaggctctatcaccaaaatcccttggcaatgtagccagtcaatgacagacaaggatggtagtgaaagagttttctcttggctgcagtcaagccaccaccaaagggaataatcttgacaagaatccagttgatacaaactgcaattctgctctcctctgcaacagcccagaagaaagggaggagatttctctctgaactcaaagctcaggtttctcagacaaatgatcaaatagttgatttgattgccctgaataatagatatgtcctttagttaacagatgttccctactgttgcctaatgtaaattgtacattttcaatgtgttttcctttgtatcaaacatatatatgacaaactttccatcctcccggagcttacaaatcatttttttaatggaaaacttgggaagacagattttatttcatacaataacttgcagtgactagaaggacagcccaaatataggagaaaaaagaatgccttgtaacagaaaatttttatgttttctgtctatggaacacttacctctgagaatctgtcagaaaatgaggccttatcttgcttgacaacaatcattatctagtcagtaattccttctgaggaatttaaaacttctgcctttgcccctgaaatgactgtataatctgtcagagccattatgtaaactaacatttataaagcagagggtgttataactacttccatcaaaaagttaataatctgtgacattccaaaatcacaacaaaaatgttgtgttggttctcctagtaacaataataaagagttcctttatggtcttgagaataaaaaagcccaactcctaaatagtttaagtcccttgaattccatttgatagtcttttgctgcagtcctgctttcattagatagatctgactatatctctcagaagttaaagctggaagattcaagtgccttataaagagtattgtaagattcttatataggcagaactttctaacccactattgttattgagactttctgtgacagacataaaaattttatttccatttaaaaaacattttactgatgtatctgattgtaatctgctgtttattctcttcttttcaagagcctagagtatgttctgtgtggccaggatcaaggacaaaagaaaatcatacatgattagaggagtgtaactgttttatgggttgcagtagttctgaactatattgagtcttcccagctgttttctatcatagcaataccctctgtccttcacgtgaaaatcaaggactgctcaagtataaatttttttctatactgccttactttctgttttagggcttattcaatatttttggtttattcaattttggtagtttcttacaaatgactttaaagtcaaaaaagtgcaaggaactcatccacatttttgcaaaacactatagaagaccagtggcacttaattcattcatctttataaacattattgaagtgtccacctaagagccttattttgttaaaaagccaatttcacccttgtgaacactaacctctgagcctctaaaactctccttgatttaggtccataatttactattaactcctttaagccttcagatactattcactaagactctgctttagtccatgatgtcaactaccaccctgataataataccctctagaatttgtgcactactgtttgcctaagtggttcaaaaggagggaaaaactgggagactggtattcctgtgccatctctctttcccaacaacccctgagaggcagaataatgactcccttaatccctggaaatctgtgactatgttaggttgtacagcaaaggaaattgcagatggaattaataatgctaatcagctgcccttgagattagtctgcattgtgcaggtgtccaatgcagtcataaaggtccttacaatgtgggagagagagaagagacagacagctccatgagaaagtctgaattggctgttgctggttttgaagacagaggaaggccaggagcctaggaatgtgagaagctggacatgtcaaggaaatggattcctctctgctcttgagccgccaagagaaatgaagctctgcctacatcttcatctccacacccaatgagacctattcaaacttctgacctctggaattgtaacacagtcaattcatattgtttcaagccactaagtttttgaaaccctaaaagggagatttaactgagtaacaaagtattatgctagcaggaataattatatccatgtgaaaaacagggaggtggaagtacacagagtgaaacaaaaacagaaacttcttatgaaggagctttgtaacttaaaacacattagtatctgtttccaacaaggtatttttcctatcaacatttagaatattttttccatctttttatacagctcgaacaagtttatttccatttaaaaatcttgcatcacccttttaattgagagaatgtgattgctggaacaattcaatggaataattaaagcaattttaatacatcaacatttgctatttggcaaaggaatcaagtagaaagtaaaataattcatgtggcttgtctttcataagtgtgggttgcttctatctgaaatcaacaagtgattatgaactggtgactctatcccctgcatctcttactggcatgtcattctcatgctcaccaaacaaaatgggcacaggtgttttagaaagcaagcacctagaaataaaatgaaggctttactgagggcttcagtatactttctgaagccttcacctagggatgaccacagcccttcatggtttcattcttgtcctggggctctaatgtgctctctagaaatccattacagcagagttttcatttaactcatgtaaggtaaggatagtggcaccacgtaagaagtctcatgtttgttaacggtgtgtgatggtgcttgttgatggtctagtgttagaccctgcttagccaggacagcagtgggctccgtttgagggaatttggtcacccctccttagctcaggctttgatgtgatgatttataggacagtgcatggtgagagggtctgggaatgggattccaacaatgtgtttggatgcccttcctcccagaaggctgtatctaatactaggcacaagctccctaaacccaagtcctaaggcagttttaagctaaaggacagaaaaacatcattcctgagatacagacgggcagttcttccagaccagtgtaatttagcctaagtccttacagttatcctccactgtcactggtgaaaacttgctcttcctttccaggaacttacacaaaatactgtaagtgcaaaacaagattaaaaatagagtaatcgttgttgaacactaggggttcagcctagattctagttgtttgcctcacagaaagcccattgacacaatgagtattgtcagggaaggcagactttattgcaggtaacaacaacagccaagagacaggagatggaagacaagcctcacatccatctctccaactgactaaagttaggggtttatagaggagcttgtcaacacgcagcaggcagtcagatcaggggtctgatgcctcattgtccagatgtggtgatctggaaagttcagttccttgatactatctgagaggaaattaggccactttcgtaaggacactaaaagaaaccacaaatgataataatgatagctaatatttatagagcagctactctgtgccaggctctgggtattttcattgtcattttaccaatgaggggaatgaaactcagaagtcatctaacttacccacaagccaggcgcggtggctcatgcctgtaatcccagcactttgggaggccaaggtgggcggaccacctgaggtcaggagtttgagaccagcctggccaacatggtgaaaccccatctctaccaaaatacaaagattagctgggcgtggtggcgtacacctgtaatcccagctactgcagaggttgaggcgtgagaattacttgaacccaggaggtggaggttccagtgagctgagatcgcactactgggctccagcctgggcgatagaggaagatcttgtctcaaaaaaaaaaaaaaaaaaaaagtcatctgacttgcccacagtcacacagctggcaagagggtgggggtagcgcccagtccctctgaccctgcagtcttcactattgcacttaccaccttctctaaagatagtgatggcttgtgcctcagggtatgctcatttgtttttcaggcatgaacagtgcattcgcaatggttgtaaattccctatactagtttacgccactcatattcaacagaaagcatacttttaactaccaatggctgtgtactgacaaggttctttgcttaacaaaatttcagactcctaagccttctcctaatatcagctgtacacttccttgtaaaatccagttttagtaagaaccctgctaagtcagtttatcaagaatccttcatccttcatctcaccttcattatccagtttctcatcctctacctttccccaggtgacagctgatcaccctggcctgtcttcagtaggagttctgtcagattggtttagccagaatcccccttactcctgatattttctgctagtaactttctatctgctgatagtcccatctccaatctgtggctacaaattcccacttgcccatgccgtattcagagtggagccccgtgtctccgccaccaagtgcaaaatcccagagcagtggtccctgtatctactgcaatggttctgaaccactttactgtgctttcataagcatcattatccctgaatatttttttttcttttaacaacattcaggatcacaagcttttacaggccagttgccttgatgtagacttgactagcttctgtttctgcattcagaatgccagataactcatgcagttaccctaatatgccataatacaacatggagaacacatacaataaatattttataccccagcaattccatggcactggtattatttctactttttttttttttttttttttttttaggcagggtcacactctgtcatccagactggagtgcagtggtgtgatcttgactcacttcagccttgagctctaattcttgggctccagcggtcctcctgcctcagcctcctgagtagctagaactacaggaatatgccaccatggctgactaatttttaaaaaaaaatttagtagagatggcgtcttgctatgttgcccaggttggtcttgaactcctggcctcaagcaatcctctccccttggcctcccaaagtgctgggactacagttgctcactttaccctaatttataccaaacagaaattgacatgtctggaggttcagaatcctaagttgtaaagaaatggattcatctttacatgaacttagtggaagtagaatttaattctctgtaagattagtttcccttttgctattttatttcttcattcacttccatctagtttctggacgtacatggtcaagtgatgttactttaggtaatatttctagaactttccctaattttaaaattaagaaagaaaaaagttttcccttcactttatgatatgcccttcaaggctgaagactcagaaatgtgctccagagaatttgtacctcctctttcacccagttcagcccctttgtcccctccccctgcttcactgttgaattcctttaatcttctttaccttaaaggtccataaaaatcccaaccgccttcactagaaaaatttggtgctgtatgagaacctaagtttctctaataaaaatcagcaacatttttttcaaatccagctttcccgaaattgtagatcaagcccagtagtgtgattcacagataacggctgaagccacttcatctccaagctaagggataaaattagcatgttaaagagttggagggcttaattagaaaggcaatccttaggcaaaaacctctcaggaacactaaagcagtttgttaattttgtttgctatctctttgggggcagaacctggaaccagaaattaactctgactttgaaaaccacaataaaattatatcatcctcaggcccaacgttaaaggaagtgtgctcataataaatggataatcttctactttccatgactattgattttaatcatcccaacattccgtgagaagcagtctgtttctatgtgctttcctcctgttttctcccattgtgttgagtatggggtttggactctccagttcaaccatcctggatggagaggctgcttcattttgggaatagcttatccctacccactgtgtcacttactagatcagaggcaaagaggctcattcttctgaatgtttttgtttcttctggcattcacctccatatttttaaataacaagccttaaaataccattatatctggatttttccaattatatcactttctactgccttcctactatagtgtagggtttagatctcttaccttattcctgcatacatattgcctctctccacatcacaccactattgaggcaggagaaaaggtctggaggcagggaagctaaggccgattcgcactggcttcctagaacgaaatcaaaaggaaaacccctactttccacacccaagtaacacaaggatcagaagctactcccttttcaaccccctcccccattttttttgcatggcagatgagaaattgaaagtatctctcatttgtcccctccctcagtcagtcaggctgctcctgggccaagtcttcatttgcataggagtataactgtataacttgactttagcttctgattggtcaccttccacaaccaatcagatgtttgcatagggtataactttgtacctttgcttcagcctctgactgatcccctcctgcaaccaatcagactgattgtggaccactactttatttacatagagtgtaaagcaagtgaccaatcagaaacctctagagggtttttaaaccccagaaaatctgtaatcaggctccttaagcccctatgcttggcccactcccacctggtggtgtgtactttcatttttgataaatctctacttttgttgcttcattctttccttgctttgtttgtgctttttgtccaattctttgttcaagttgccaagaacctggacagcctccactggtaacactataattatgacagtttttgcttaaattaataattgatgtttacatttttacaattatataaatattcacagttcaatgcagtagtgttctgtgtaaatactttgtgcttttctttttgctttccttacttattgaataaataaatacttgagcaccagcctctagtgtagccactcttctgggtactggatatataagagaaaagataaaaaaaaatcctgccctaaggggtttacattttattggggtggcagcagaacaagtgtctaagaacagataatctgaaaccatgtttgagttaaaacactggtttttgcaaagttagcaactcactgaccttaggaatttgcccagcctctccatgcctcagtttcttcatctgtaagttgggcgtaaaatctatttacagagttgtaacaaagattaagtgaatcaatataagtctaggcaggtcaaagatacagatagcaattttcaaagtgtatactaggatactatcgggaagtaaacttaactatacaggcaacaggaaaggcaaatttagagactgtgatttttaaataacatattgagaaaataatattttttcctatctgattcacttattgtctagcatttgtgtatcttttaagatattaattttgaaggaagtttattcaacttcttgcattttcattgtttcccattaattcatttgtcatcttactttgagtttctatctttaatgataatgactttcttttcatgtctggtaatacatttattcatatataaaaattggacactaaaattgatcaaaaatctctgtttacatgggtttttgattgttcatatgttgatatttctgttgtagactctttaatgtcactgttcataagccttttttgtgaggggtggaggttgtgtatttccccagagagaaagactcccatttcctctgtttggggagggatgtacctcagttcagagcgtttgtggttcaacctgtctggatagaaaacacccagccttctgctcaaacaggagaggggtggtcactcaactcatggcaaaagctagaagtccctgatgtctgtctcagaggacttgctagttaataaacttctgccctatactgctagggtcaatttacaattgggaaataattaattttgtgactatccaagggtagaatgctatctaatttcttagaatgtttccattattttggccaatcagactgagcgttttctgaaaatacgctatagttcatccaactttctattgctttgtcttatcatatacagtgtatggtgttgatgctaagaggcattactataaagctgaataaaataagccctctctcttctcagcaatcatagtgttgttaaatttattagtttgggctctggcatattcctcaaagtagagttaggaattgtagagatgaaagtcagtttatcaagacaggatcctatgttttcccaacaccctctcccacatgggccacttcctctccctaagctcccatgacttcaattttgctcccactggcataggcatttggtggggatctggaggccatttaaaccctaaagttctgtccacaaatgataccccagaatcaaaccttttctgcttattcttcttgcgcaaagtgcacgccaacaatatccatgtttttcctattttttttccattaagtgcaatgcaacctttcttcattgtaaagaatcactagaatccagctctcaggctccctctgcattttttcgtacgactcaagaacaattacgttcttgctaataagatatatctctttaaactccctagagaaaaatgacaatatacatttaaattataaacttggacaatataatagactttctactgttagtattatacagttataatctaactttaacagcagttaagcagagacattttacgaattgcatgatatttgagtgttgggtgtgaatgagttggattcttgaccttttgctggtgggaactttcttatctctttttgttttcccaggactaatctgtgcagtgtagcagcacttcctttgtaccaaagtagttatcttcctgcggtatctccgatcaattctataatctgtaggcatcatgtgccactgtgtcacagggtgacaaaagccctcagagcacaggaggaccagactattgtcgtcactgaacccaccaggttaaaaaggggaagatgggaggcaaaaataacactaaataactggttataaaaacaccttaaaattgtttttacagttgagtgattgtactacttatttgatgcatctgaaattgttgattaaacacagagatgcacataaactgagacgatagaaattagagaagtttaattacagtaaattaagaaaaaacactgaagcagagacaacagatggtcaaagaagaaagtgataattcaaaactatcaggaacattagaggaaaactaagaagtgaagcaagttcgcacagacacaaaacaatttcttctatttctttcactgttgtattttttcttgccatccttaagatttgtcaggaatgtctttgtgtctccacctttgtttttctttggggtgtgtgtgtggttcttttctgtaatcctcccttattttctttcatgatttgatcctagttggataatacgccccgatttaagaatattttattttaagtgtttctcagttattctcataggatttcaagaatttcaaatattaatagcattgctaattaatagtttaaaatcatttctcaaatataacatttagcatttttatgacaaaattagcatgtattcattcaacaaataaattataatagtttgatggcaaatatcagtatgtaccagctattgggctgcagaatatgttttcatgctgtatacaaaattaagttgttttaggtttattgaaaaatattttatggggtagtatttatagattttttatgaggactataatcccgaatataattttatttcatccacattttttctttgttcataagagatcatttatttttacaggaaatgtgacaattagaacctattgctgaacctaaaaaaatgacaattttcttttacgatgaatattaatagcataaacgagtttacacttgacctcaaagcaattctgttttatggaagttggacttaggaaacttgaaaggcttcttactctgctgtttaacacatggaaatgataatcatgttagctacaccctagtaattttagctgaaaatattcccaccctattctggagataaaataaatttgatttaacatcgggttcaaccattctttcacagttgtgctttattattagtgacagaactttatccttaaaaagcttcaggggtcttctatcagcagaacaatttataactagctatttagggaaataatgctgcttttgtgtactattttttatagtttgctttactcaccatttgtttgcaaaaatacaacttctacaattgggttatatttcttatgatagaaagtatgtttcaagtgatcagcatatgatataaaaagatgaaacctcattgatttttttttttcaaaacctttggatgcttcacttagtataattatgactcagggtggtggtaaaaattgggataaaaggataagtttgtaagaaactagcttttttatatttaacaaaagctggctttgataatagcatatttgcagttcataaaagatcaaacttttaaggaacaaaaagcaaataacaataaaaccttcttaagtcaacaaaatgttttgtaaagggcatttcattttcagcttggccttaccgctgagaagcattttgcatgaaatttgtgcatgaattctcattccaagaatataagaggaaataaatgagcaaaacagaaatgtattagtgaagcaatttatggcatgttgaaaaaataagcatctagtatacacgcatgttgaaacttgatcaaaccctgttttaacaacactataaaaactgttttcttatttgaaacaaaacacaatgcataaatgaaagattatggtgacttagaattattgtttaaagaaaaacctgaactctaaaagaactttctgcactattaaagaaaagctaatacaaaagtaaactgaatgtactagtcaggccatcagaatagcaataacattggtaatgttattgttgaaccaacctctctcttctccttagaacaacggagaataataaatgaagccttaggtaattctattgtggcggaacaggaagttttcttgtcaattcttcaaagttgtatcaaaactagataagatttaaagcttcaggaaacttttggatttgtaactctcaactgtattctgtagttagtaattgtacaaacgagaattaacacagcaggcctgagactgctgtcctcagaaacaggcctgcctgcaaggctggcccttgcctgtcttctgttaacggatttcaatagggtccaccattcccaaagctgataagagtggctcactcaccaaaactacttgtacaaacattgtggtttatgctgaacatctgcttttttgtttttcattttcagatagtctggaatttgggtatgtactaggcagagggtgtctaaatgacagttccacaaccacaaccttgactcataggcttaggcaagcttcccttgtagataatatttcacacatgttgtccaaattcgagtgctggaggaattagcacatcctttgtggctctcccagaagaggactcttagaagcttgtgcctggtttcttacagactttgcctcatgtaccttttctctttactgatttttactttttaggtttgttgcagtaatatatcatcactatgagtacagctgtatactgagtcctatagtcctagcaaatcaccaagcctggaggcagtcttgggacccatggcacagcactatccttagaagctagttttgtcagtttcactttccatcttctatacctttgctgacatggtttcctagccccataccacctgttgccccatagcctattgagtaacttttcagtgcttggccaggatgaaaccttgctcaagatgatccctgatttccttattgttcctggctggaaatggctctggaatatcttgactttgattatctgaattattcagtttgattaatttatggcattaatcgaccttatattatagttgtgtatgcacatcacctcttctatttcattttaagctatttgaatgtgtagaattgttttattgtttttgtgccacccagagctgcttggtttctgaatggcttatgcctttgagttcagtgaaagtgcatataccacattaagtggtttttgataagaatgccattaaaatagatgtgactttgtaatttccgtctgacctcaggagctatacaaaaacttagaatatctgaggggaagtgttgaaaatatagcagttgaattttaagcaatttagtcttttataaatgattaatgcagtccaataattgtgattaattgacctgaaataacatacatgagcttttgccagctttctggatacatataaaagggagcaaagcttactccagagaatcgaattatttttcaaatatatatgcatgaatttgtacatgcatcataatatgaactcaagttagagttctaaagccaatcttaaattcttccaaaaaaaaaatgccctttataaactttttcaaaggcccagttttatgtcttttttttctttatttctttgaaaattcctccactctaactggtaactatgaggcattagctgaacgtcaagatcctgaataaaattccaaaaataaagaaaacatggagaaccatcagttcctgatatggtttggctctgtgtccccacctaaatcttatcttgaattctaaaccccacttgtcagaggagaggcctagtgggaggtgattggatcatggaggtggatttccccttgctgttatcaggaaaatgagttctcacaagatctgatggcttaagagtgtggcacttcccctcttgctctctctctcctgccacaaagtaatatgtgccttgcttcccctttgccttccaccatgattgtaagtttcatgagtccaccccagccatgcagaactgtgagtcaattaaatcacttttctttatacattacccagtctcggggagtttatagcagtgtgaaaacacactaatacattccagttcatttttatttaaactttgacagaattgtcaagggagtatataagagaacaacaatcgtgtgtctggatatatatcctttctccatgttaacattttcagagattcttctttatatggttatttgctcaattagttatacacctacaactttaatactacaacttttgagtaattatggcagactagtcagacataatttatcttcttctaactcctgaaaagcacacaaaaatggtacacagttgaccaagaagtaaaatgaaaaacacaatgggaacagagcatatgagagactcagagtagtgactgagaaacaagcagaacttttttttttctttttttctttttttttttgaggtggagtttcactcactgatctcggtcactgccacctctgcctcctgggttcaagcgattctccttccccagtctcccgagcagctgggattacaggcgctggccatcacacccagctgattttttgcatttttagtagagatgggttttcactatgttggccaggctggtctcaaacttgtgatctcaggcgatccatctgcctcagcctcccaaagtcctgcgattgcaggcgtgagccaccgtacctggctgcaacaagcagaactttaatagaagtaacccgtatgctcaactagaagaccccagaaagtccctgaactggggccagttaccttggaaacctacaagcaatagaaactgttgaaagtcagtacactgagacattaaaatccaggtctcctcctcagccttgagtaaacaggcaaatactttccttgtcttccttctgcccctttctgaaacagaggaggaatcttgtgtctgtgtgaaaacattgaatagtaaagtctctggacacggaaataccaaagtggagggtgaaagtaaatctaccacttggtagagtgatttaatgtctacagattgaacattgctttccaggcccctttctttgctttgcttaccagtgacctgcagccagccattgaaaaacgcaaacaaaaaaacagccacccaatgtggccataggattaggtgaatattccccagataatctagagggccccaaagaatagttctccagaaagtgacatggtatttcgcagaaggaaacattgcctaactcagtgtccccttcagtaaagctgtcagtctacaagttcctgtctcgtcaagggtgtgtcattatctattatggtctcctttcttaaatgtaaacagagccaaagatcaccaggaatctgaggaaagctatcatgtgaaagacagttatcaaaagagacagaaaaacgaaacttggtaataaccaatataataaagtagaagaaaatgccaaagcaaaaatgaaaacaaatactagaggtaatatagttcacccttgaactatattggtgcccccaaccccaacacagtaaaaaaaattcatgtataacttaatttttttcttaatttttaatgcttgtggctaataattgtatatacttatgaggggcatgtgatgttttcacacagtggtacaataggtaataaataaggtataatttttgacttccacagaacttaactactgatagcctactgttgagcagaagccttaccaataccataaatttgattaacacattttgtgtgtcatatgtattatgtattgtatacttccaataaactaagctagagaaaatatattatttaaaagtcataagagaaaaatgtatttacttttcataaagtggatcgtcataaagatcttcatccttgtcttcacgttgagtaggctgaggaggaggaggaagaagatggattggtcttcctgttttaggagtggcagaggcataagagatggagaagatggaaggcgaagaaggagaggcaggcacacttggtgtaacttttgttgaaaaaaaaatctcggtatcaatgaacccgtgttgttcacgagccagctatacagttgatttctccaaagagttgaatgaaaccaatacttatataaaacaaaaatataaataaaaagaaataaaagtaaaattattgtaatattttgaaataccacaaatgcaatgggagactaaggtaaagtcacataaacatttataaaaaatgtagatctttgaggatacattcaagaggtcctttacacatttaatagtcttaagaattttaataaaattaagaaaaaaagttacacgaattatctaggaaatactaaacatatcccaaaagtaaagtatgtgagaatttggtttcaagtgcttttcatatgtccactcagtagagaaataacttcaaaaatcctaaggaagatgatcttgaattagaaatctatacccatttaatttatctattaaagatggaataagataaagacatgtcagagataaaaagcatcacattttcttttaattatcatttcttaggaactgactagagactatgcatacatacacacacacaaacacacacagaactaaaagaaaagaaagaacttgggaattcatcactggaaaataaccaagcatggtcccaggataatgttaactccaagggaggtaaccagggaaggtaacaaaggtttagctttgtatttaatgaccattttgatgatattgataggtttggaagttttttaatacatttggaaaaaataatgattatatatatcacaagaatgatataaattttaaaacaagttcaaaatcaatagcaaaacacaaatttgcacaagaaagaaaaagtgatagactatatggctcagcagtgagcagtatgtacatagttgtgaaaatgtaaactttgaccactgacttaatttaaaaattataataaccctacattaggctctgaggaaaggggaagtgttaaagatgttaagtggggaagtgaggtacaaagtgtgtggctggaatttcttttttaaaaatcataggtcattatttgattcattgaactaactatatgaaatactcataataattttaaaattgaaatactgtattgatgagaaaaggtaaagtgttactttatcttatttttaatctgtcatagaaaagtatactgatatatttttaactgggttaattgagagatggaacaaaaatattagtctcttacaaaaattattttggatttatgttgccaatatctatacttaatattcctaataaaatcttgattgtaaataaagcatatatttttaggttgagcttctgagaaaggaaagctgaaatgaaggttattgttccagaaatttttgcattatgatgaaatcaatgtggactattctaaataatttcagagaatgttgtttatagctttcttgtcatgtcagcctgctttgagctgcctggccataatgtcagcctcttgtgtataattcagccgaaaccacattttattataatttgggggcttccaaaagttgctttttaatttttcagagatacagaaaagttaatatataataaaatattatggcataaatagtagagatatttcatataactatcttcatggccttaaaaactcttgtagtttccaaaggcaagttggtgtaggtgccacttgacactttttaaaaaatagtctctcttactctttttcccctaaagcattttaaaaacaaatttatattaagatggaatttaattattaaaatctaattattagcttttgatatgctaatacctctgaagatagagcactataaatgaaaacaattttatttctaaactaaactgcgttttgaactgatacatttgtctaaaagagaaagaaaaaacaaaaggtcattgatcatcaggtccagagcagatgtggtcttgtgtgaaataactagaccagggaggtaacagctttgcaagtcatatgcactggcttaatatctccattactcttatctacaaagccaaaattataaaatatgttctcatataaattgactttttacaataaaatatagcaaccttaatagtaagttgtatatcttcagtgttgtgctagaactacgatgcaatctgtgatttcttttaaaagttaaagataaaggtagtcatattgtatgtaatactggttactaccaatttgttttgaggagaatatctgtgtaacgtactattaacaaatacaaatttaaataatcaacactgaaataatttcaggataatttttataaaatcttctctttttgctatcaccaaatctacttcttgacaaattttaatactgagatttctgcaatctgtgataatcttttccttattttctctcaaaatttcaaaatcagaagtaacttagaccctgcgtttattaataatccactaagtcaattaactttccataactgtagcaaactcgagatatagcttgataattagtacaaataatcagaaatagatttaaaaatttacataaatatatactgccaattattcctttgagagcagggcctgttttaattaccctgttttcttagggcctacctggtgcactgattggcacatagcagattctcaaaattacattgattcataaaaataaatgtaaaggtaggatttttcataaagttagaaataagaaaattaattaccatataattcattaggatattccattttcataaataaaatcttcaataaataaattgtccttagaaaatacaggataaatgcaaaggcagcaaggtgtcatggaagagcaaagcgctttgcagtaagatagccaagggttgggctttgctctttctgtgactttaggtaagttaatcatcctgtcaaatatcagcttcttatgggtaaatatgtgtgtatgttgtaagatttttctgaggctaccaggtaagtcatgtaaaggatttaaaacagattctcagtatatggtagctgccacagatgggattctagtctgaatcaaacacaatttgatataatgttttgtcttccttacaagaggtaaactcaagacaatcatcatggaataaagccattttccctttttcatgcttctccacagtgcatgttatctctcttttggcaaagaaaattccaagggtgagataatcatttatacggccattcagtgttttttgcagtgctcccaattcaatatagtcaacaaaatgctaattagtcctaattgtttggaggacacctgtcagtccactgatagatgcagagacccctaaagaatccctcagaaattcctcttgagatgaatttaactctatcattaagaagttaaaaggtttagaattaaaactagtcgtcatctcccattttaactacctgttgaaatatacagatccagatatacatattcttctaggctttgtctgattaaaagaaaaaacaaaaaccagaatgcaaagtagaaattcccaatgacagccaggcaaggtggcttacgcctgtaatcccagcactttgggaagctgaggtgggcagatcacgagatcaggagtttgagaccagccgggccaacatggtgaaaccccatctctactaaaaatacaaaaattagctgggcgtggtgatgggcagctgtaatcccagctgctcgggaggctgaggcaggagaatcgcttgaaaccggaaggtggaggttgcagtgagccgagatcgcgccactgcattccagtctgggcagaagagcgaaactccatctcaaaaaacaaaacaaaacaaaaacaaaaacatggaaattccctgtgactaaagttgtggcacctatcttgttcttgatgtaataaagaaatcttaatgttagcaccttattattataaactattctgatagaatctgatgtggcaggcagtactggtttacctttgataacttcctagttaattatagaaataaaaataataaaaataagaatcgttttttccatccagtctactctatttcagcagtattattggcatgtccatattgtccaattttacagaagcacaaaatctgaaattagtctgcgtggtggggtgggggtgtgggggcggctgttattgggataattaagttctgtgcaataagtcaaattactatgttttaaattttagtttacaaacaggccaccaggaatattacaagcgtattttcttttcttcaaaaaccatatagcatctttacatccttaaagttgaataaaggaatgttaaatgttttcaactaaggctggctagggtcagtaatatttctcatgtctggcagatcatctgttaccacttactaatggatatgtattggtataccagactcatattacagttttcttaacagaaattgttttaaattctatgatattcctctaaaagaaagtgttgaactgactataaagttaaatcagaaggatagaggcatcccatggatttgtagcctgaaatagagtactactaaaaagactttggtgactgtaaaaatatttctaaggtagaagtttttcatgattagtggatctaatctaagctttccccctattaaacataccgtaatttgtgagatataccttctctaatctaaacatatcatgttaaaactataattgtagcagttatccaatcttccgcattttttttgacgattcaagcaagagtattgaagcagttttcaagagaatcttcaacttgacccaaagaacttcttagtgtatatgaatggtgttctttcaaaaattacttgaacaaaatcgagcatttctatcatatgtgaatgtcggccactctttgtagctgccatgtaatcttttgggctatctccagattattgctttattgccactctggctacaaaatgcttttacacttggtcatcaactcgtttcaaagtaataaaagaacaatgcctgtggcaccacgtcagaaagaaatctttaaatggtgaacctgccttatagcaacaaatttaattatgaaattgaatgtataggaagagatgaaaattgttgctgtcaccaagtacatgattctactgtataaaacaaagtttgtagcaattaaaaggttttgccattttcctgcagttttcagcatttcacactttaagagtaagcatttgaaatatctgtgtattgagacttaacaatgcaaacactaggtcatcggatggggctgacttgataatttgcaggctggcagaaaatctggataatattttaaaataggaacaaataagctgttggggagaagaatatattctctttctacctccttaggatctttggctgggtctaagaattaagttgacataagacagaataaaaggaaaaatcatacaatatgtatctgatgtggtgctatatgcattattctttcattaccattatgtttgttaattttttttatgctggatgttactttttatttatttatttttattatactttaagttttagggtacatgtgcacaacgtgcagatgagttacatatgtatacatgtgccgtgttggtgtgctgtacccattaactcgtcatttaacattaggtatatctccaaatgctatccctccccactccccccaccccacaacagtccccggtgtgtgatgttccccttcctgtgtccatgtgttctcattgttcaattcccacctatgagtgagaacatctggtgtttggttttttgtccttgcgatagtttgctgagaatgatggtttccagcttcatctatgtccctacaaaggacatgaactcgtcattttttatggctgcatagtattccatggtgtatatgtgccacattttcttaatccagtctatcattgttggacatctgggttggttccaagtctttgctattgtgaatagtgctgcaataaacatacatgtgcatgtgtctttatagcagcatgatttataatcctttgggtatatacccagtaatgagattgctgggacaaatggtgtttctagttctagatccctgaggaatcagcacactgacttccacaatggttgaactagtttacagtcccaccaacagtgtaaaagtgttcctctttctccacatcctctccagcacctgttgtttcctgactttttaatgattgccattctaactggtgtgagatggtatctcattgtggttttgatttgcatttctctgatggccagtgatgatgggcattttttaatgtgtcttttggtaatttttacatgtgcatagggagcctcacaagagagtgaggactaatgaaatggtcaaagcagaaagcttttatatcttttagagagagacaccaacaattcttgaataaatgaaagacaaaagggtttgggctggggggcaatacattgtggggatgtcactaggagatatatggcggtggtgggggggtgcattgtaaaactagtagaagataagggttactttattaattgtatggatccattgcagcatcaattccctgtctctggtgataagggttatttattttcttctttgagaaaggaatagcacttttctcaaaagaattcttacggcctggtgcaggtggaagaggaggggtcaaacagctctttctatatccactgtctctcaaataccttcagcctgaagtaattgatatgccaaatttgcatatttggggatggcatggccttaactttatccatacaaaaggattatatcaacaatttggggccatacaatcaggtagaaagatacaaataaatccatgaaaatcaagaagcaaaggcaggggtatatgaaaaagttttaggtccctaagaaaatcttaaaatgtgttttataaatttaaagtatgaagtcaaccaattgacatgaactcaatcaaaaaaattggggactagaagagatgttgaaattactttttaccctcggctttatatacttaataaaggttattattttacttactccaggatctctatttctgctacagttttttaatcaaaaattgttgccttttattacataattaaaataaattgagaagattctacttcttgttctaccagagcacccgtggattgactgagggccactgttgactcactaatactgtatttattgaaatagactcctgatcattagaactatttttgtcacccgtaattttcaattatttaaatattaaatacaattttgtttaagttgttgttcatgagaaaattgcatatttataaggatgttttcctcaattttcatacccatattccacacatttatttcacccttttctactcattctttctacagtttttagctaagttggatttcgtaaatttaagtaggatggtgttcgatttagagaagtggcccaaatctttatttttctgtcaaatatatgattggctgattaacttcacaaatggagagaaacgtcttaaatgattaggaatgataagtttattagcagtcctgattcaagtctccaactcaaactcaatagatgatgtcctttaattactaccagggacctttttcatgttgctgctgatcacagtttattgttgcttttatggctttattaaaaatactttttcccttgtagttatcttctcaaagtccccctctcacttttattcttactattattgacataagagtaatagccactgtatttttagttgtgcttgaaacttaagatgttgttggcactggtgtaaaaaaaaagctttttcctttgaaacatttactgtttataaaatattaagctaggctacctttttcctgatgactcaggtagaatagcattctttcctttactataagagaagtctgatccttgtatgacctcttaagaaataaggtaatatttattttagttctgtattataacaagcaccaatttaatagaatcttcttcaaatttacttgaaaatgggtttcattttcagaacagaatatttaatgaatatttcttactaagactgcatgtctgtgtactattgttttaaatataatttgggtaatattacttagtttgttatttgaaaaaatcatagactctccatgatgaaacttgtacctacaaatttagtctaaaattgtatgagaggacattttaaagaagtgttttatgctaatgcaatatcatatcatagcaaatgatgtaaatctaactaacctatatagtaacttaatttttataccttctgtttatgaaatacaatattatgaagagggtggtatagatcccagtagaaaaaatagaagaatatatgtgttggaaaggtgaaattgtggaactgtaactgaacttccctcactttttttcatatatgttttaatattatactttaaacaactatttagtattatttcaatatgaatgtctaaggtaatttcatggatgcttaattttaattgttctattttacctttcaacattctttgagaactagacactttatattaataagtttcaattcagtgcatatcatcacgaattaataaaatacagatgtgtatcatgttgatttaacttagtgacctcaagtgtttataataaaattagcacaaaggtctttgagacaaagtcaagttctctggaattgttcacagggttctatatatttatcagcattttttttttgttttgattacctctgcaatcattgtctttgcctccattctttctcaaatcattgaccttgcactgtttggttgtcatcttatgcataatgttatataattagagtgatataaatcactttctttagttaatgtcagatgttaatacatttccttttctctggttgcatatcacaatattaatgaaaacaccccacaactaatgccctgaggtattaaccttagggaactgacatcatgttctgaaaactctcttgagcttttgcatgagctcagatgtcattgcaaatcactttagcttttgctttattgtcttttgctaataataacaattgtacaaaaataaaaggtcttgtgttttattattatgattattgttttttgagatggagtctcactctgttgccaggctggagtgcagtggcgtaatctcagctcactgcaacctccgcctcccaagttcaagtgatcctcttgcctcaacctcctgagtagctgggactacaggcacgcaccaccaagcatagttaatttttgtatttttagtaaggatggggtttcaccatgttggccaggatggtcttgatcccttgacctcatgatctgcctgccttagcctcccaaaatgctgggattacaggtgtgagccaccacaccctgacagtcttgtgtttttaaattttccacattagcattaatagaaaaatcatgatcatataattattttttccaagtatgtgtatatttgacatacttgtatttcttgtgtaggtgttttaaaacatcattaattttttatggcatctttgtcgagatagagttcacaaactatagaatgtattcactttaagtgtacaattcagtgctttcttagtttattcacaatgttgcacaaacactaccacaataaattttagaacattttcatcaccccataaagaaacaacttgcccattaacagtatctctccacctcattcccagtactaggcaaccactaatctactttctgtcttaatagatctgcctattctggatatttctataaatggaatcataataagcattctttatgactttttaaatttaacataataattttcaaatttcatccatgctgtaacttgttcatccatgccgtacattctcatttttatggtggaataacttattgtatggttataacacattttgtttatccacttttctttcaatggatatcatttaatggtcacctctgtttttgtttgttataaaaacgctcctatgaatatttatgtacatatttttgtgtagacatgtttttacttctcttgataatatagctagtagaatttttgggtcatgtgataaggttatgtttaaccttttgagaggtttaaccttttgagaggttaaagcagtgtactctgtacactgctgtacagagtagcttcatcactttatattacctccagaaagaaatgtatagtgttccaatttattcacatcctcaccaatacttatcaatacttattttctatccttttgattataaccatcctagtttgtgtaaagtggtttctcaatgtggctctgatttccatttccctgatggccagtgatgttaattgttcatgtgcttactggcaatttgtatctcttcattagagaaatgtctacttagtgtatttgccctttttaaaaactgggttatttatctttttgttatggagttataagagtccttatgtattctagacacaagtccattattagacatataatttccaaatactttctccctttctctgggttaacttacacaagtccgttattagacatataatttccaaatattttctccctttgtctgggttaacttttcattatcttggtggggttactttgaaacacaaaagtttttaattttgatgttcaatttatctttttttattgtttgtgcttttggtgtcatatttaaacaatcattgcctaatccaaggtcatcaagatttatgcctatattttcttctacagctttttttagttcttatatttaggtctttgaactattttgactaaatttttatatatggtgtgaggtagggctccagtttaatttctttgcatgttttgtcccagaaccatttgctgacaagattattttttttttcatggaattatcttagcaccttgttgaaaaagtaattgactataaatgtgaagttttatttgtagactctcattagtaccacactgtcttgattactgtagctttgtagtaagttttcaaattgtgatgtgtgagtctttcaactttttttttttttcaagattctactggcttatttgatttcccttgaatttctgtatgacttttagtttagtttgtcaatttctgtaaagaagcaagctgactttttaataggatttttactgaatctgtcaataaataggagagttttgccatcttaaaaatgaacaagggttgtttttacatttatttaggtctttaattttattcaacaatgtttctaataaaacaacattacttattgatgcaaaatcattcagtgaatacccgcacaattcttataacttattcctatttattgttattaaaccatccatagtgttgcatgcatggtcatttggttccaatatatacaacacaccactacacaccttctttgcgtatattattattttctaagaaatataaatttgtccttgaaattagtcataaaatatcctgccattgaattttaaatcattgtttaaaaagacgtatccaatcaagtgaaaacaacaatatatcagattcattatatataaacatctcagaaaattattatagttataatctctatcttaccttaattataatttaagggaattatattgtacatgaggtccattatatttcaatgatattctaggctggatttccacctgcaaatgatttgcttttatacatattaaagtatatttaaatatgcattttacattatcaccattttagctatattatatttaatagatcacctaagataagcattttcatattaatgtccctgatatttctttatatatataagaaacacatcttttactttttcagttttttgtccatataattaaagaataaattttcaaatttgtttaaacaaaaactgtataaattccttctagcttttttatatgaaaaacttcacaaaaaatgaaagggcacctccttgatacagtgcttcagtgacacagcaaaactccatggttataaagacgttatcaatactattctaatactgatgttgtagattatatctatttgatattatatttcatttattcctgaaataatatttaaagtatagctatacagactgactaaaaatatgaaccgttttttctctgttttgggaaacaaaggaacttcagctcaccaactggtgcttttttttttgtggaaaaaatattccaataatatattaagcaattcttagcatctaattgtctatagttttatgtatattgactatgaagcctctagctagcctttaagtgtaatactacttggcaataaaatgtatctctactcatcacagttaaagaatctgttaaaagaatgttgcattgctaaataattataaatttataatctttttgttttgttgtgttttgttttgagatggaatcttgctctgttgcccaggctagagtgcagtggtgcgatctcggctcactgcaaccttcacctcccaggtttaagcgattctcctgcctcagcctcccgagtagctgggactatggtcatgcaccacgatgagagactaattttttgtatttttagtggagacaggtttcaccatgttggccaggctggtcttgaactcctgacctcaagtgatctcccaacctcggccttccaaagtgctgggattacagatgtgagtcaccatgcctggccatcctttggaggtttttaaaaactttcaaaaagtgaactagagacagaaagagaaagttaaaaagtgtggaagaaaaaaatggaggagacttggaagacatctctgtattaaacactaatcagtcatggttattaggtggaatacctatagctagagggagaaactattctcttatttatatgaaatacattcttaatgcataaaactcagttactacatttttgcccagaaccaagtttattagattattctttagagaaatactccctgtcagttaagcaagtccccaattaacaaatatctagtataagacccatctttaaaaattctttctccaaatttgattccattgcagaattattggtgcagaatcaaataaaagaagatgaacatcagtctttgggggcaagaagtatgtgcacactaaaaaataagtagttgaagacataggctttttatgtaaaagataatggaaagaagttaatgggagagaagggcaaaagaaatggaagagactggaactcttcagggggatggaggtttcagcaaagttgagatgtaatattatttgcatgataagcctagaaggataaaattttatgagcaaatgctggacaattagagtctgagatttcagagttttagcagttcacagtaatgttagttcaagaaatagaagggaatagttttttgaaatgcatcacgggtaaagaattggaatactccagctccttttttggaacatagattgaaaatcattaccttagatggttttatttctgtgggattggctatgactacagcaattttagtgagagccttgaaatgtcattttatattctgaaaatagagaataacttacaagtgagttttgatattgtcacctttcagtggaaaatacatatgtctttgaggtagctattctctattttcatctaaaagtagagaggttttaaaaatcgacttgaaaatattcttaggcaagtactctatttgagttttagtatacaatttctatggctcatatactagctccttaaaagaaatttccttttggcaactaatactttgtgaattcaaatgctgtaactgcagaagctattgtagccaaagaaaagaagtagaagaattagaaattaattaagggactgggcatgagggctcatgcctgtaatcttagcactatgcaaagccaaggcaggcagattgcctgaggtcaggagttcgagaccagcctggccaacatggcaaaaccccatctctgctaaaaatacaaatattagccaggcgtggtggcaggcacctgtaatcccagctgctccggagtctgaggcatgagaattgcttgaacccaggaggcggaggttgcaatgagcctagattgcaccattgcactccagcctgaggaatagagcaagactctgtctcaaaaaaaaaaaaaaaaaaaattattcagttcaccaagcccaccaagccttctttcctattaccagtgatactaaatttagtttcccttaagacagcatctaattgaatttaaatgaccatagtatcagtgtcaacaaccctacttgtagaccattttgacatgcatttatctatgaatgtgcctgtttagaatttgttttcgtgttttgttctgatcctattttttaagagttctttcttactacctatagaaaaatcttcttcattttttaatctcttcaggtttgaaataaacttcaaggttcattttttatataccaaaagctatccagctactatgtaaccacaaaattaaaaaaattaaaaaatatataaaataaagaaagagtcatgacaaacctaaactagtcccatttaaactattgtttatctcttttcagtcatgtcagatatcattcagaaaattcattagtacttcatgcgtaggagacaaagccatgcatcatatacaaaaattataacctattagtctttatgttacacagaatagccccaatactaggcattttattaaagagttacggtctttatatgatgacctgttacttcaatgtccttatagccaacaatctgtaagaaagaaatattaaagctataggattttatgtgtctaatttcttactattatacattctattcaataatattcccaagtaatttaattatttaacttaaaaatccagtacattctgcacttcagtcttgttttcagtccaaagtcttgactgatagttttctctcacattgtttgtagttacattaaaacttaaattttcctttagctctaattttaagccttagtttggaaatgatcctcgctacaagcctgtatttgtttgagacttaatttgacttgttattacaaataattcattttaatttctgttgcaactcaaaacatttctcacagacttttcacaactacatattttgtgccaatgttgcattttgaaccctttcccttctgtttggatcactttatggcttaatatttgtcagatgatccacttccctaaaactcacttgtatattcaagagaaatctccccactgcagtataagtaatttgtagaaaattttctgttttcaagaagtagattaaagagaagtcagagtagaaataacaggaccaattgggagcctattgcaatagtctaggacagaggcgtgagcatggcttgggctaggttattgtcaatagaaactgaaaaataactagatatgagactcatcttaaaggttgatattataggattgatggaatggtgaaagaaagaggaatcaaaagttactccacagttttagtttgattacttttgtgaatgatattgtcatttattgaagtgtagaaatgataggtgtgataggaaattaagatatattttatagaaatattttcattgaattgaagttctaatggagtaaaaagtaaaattcaagagcctggaattaatagacgatgtctgtgttaaagatataaattgggttgtctatagatactttttaaaacctgagagtagatctgtgcatgtaaggaaagagtacagctaaagaagagatggcagccagaacctaccctttttggtacctaaaatttggggtatgccattgggaggattcgagcaaaggaagctgagaaaatgatgagagaaagaagaaagatcatgggtaacagagtcagaaagtgaaaaacaaactatttcaaaaggcaaagttaactgtgtagaatgaggcatagagatcaggaaagattaggatagaagagtacactctggacagggaagtgtgtcatgcagatgaacattcttggtactcttaactttcataagaactgaagcttaaagtttatggttgcgtgtttgaacttcaggccttagtataggtttaaacttgtcacagattacttaaaggttgttaaaagaaacaatttgtgtagatgttcatcctggtatgcacattttatttttaatgtcccggcattgattttatgtttaattctgatttccagaagagtaaactttgctaaattgttatatgatattacgacatttgatctgcattagaaaatattagagagagtgtaacgaaacctcatatgtattacctaagtttcagcaaacataggccagtttttaaatatttaaatagcatggactagagtcaatattctacattgtattagaacccactgtgttccctaacattccagtaaatttccagagatttataacgttatggtccaatctagttccaagatacacttcctattggcttgcatttcactttcttgagtgatgttcttactcagagaactctgaaacataggtgtttgtttttttaatttttgtactcccaaaccactcacacaatgcatttatacatgtaacattttcctctaaagctgggataatttttaatcattgtataccattgtaaaaaacaaaagagttaaaattgcatattgttggctgggcgcaatggctcatgcctgtaatcccagcagtttgggaggccgaggtgggtggatcacgaggtcaaaggatcaagaccatcctggccaacatggtgaaatcccatctctattaaaaatacaaaaattagctgggtgtggtggtgtgtgcctgtagtcccagctacttgggaggctgaggcaggagaactgcttgaacccgggaggtggaggttgcagtgtgccaagattgggccactgcactccagtcctggtgacaaagcgagactccatctgaaaaaaaaaaaaaaaaacttgcacattgtccttctggttaaatgttctcaggcactctcccaggctgctgggacacttgtctcttgcaaaacacagttgtccttcaaaatctttgagctacttccaccttaaggtctttgagcttactgtcctctctttatggaatataatgtcttccaatgcatgcatgtttcactctcattttattgcagtccctgttaaaatatcaccatttcaaagggctgtccatgactaccctatctgaagtagcttccgcatcctatccccttactttctagctccatatcatgatttatttttgtttctaccatttatccccacttggaatttttacttgtctctccatccacatacttttctaagaataagttcgaaaagtaaaaaattaatctgttttattcactattatattcctaataactagtgtggtacctactctatggcaggcactaaataattgtggtgaagaatgaatgattaaataaacatgtctgaaccttagtttctttatacagaaagtggacataatacctacttatttaaaaggaatatttttagggtcaagtgatataaataatgatttcatatgtgtttttatagctgtagagtttgacatagatacacagatttagtgtcttaatattatgtaacagaaaatatattttactatttattttctcttaaaataatgttggcactacatattaaatctataaatctaatggatcccagactcactgaagttgcttcagttatatgtagtcaaaattgtttcttaaaatttattttaacatctttttgtggaatatactttttgcttaggttctaatttttttggtaattgtcttaactgggcattctcttttgaatattcttatgaatagggtgggccctatattattcattttcttgtttagtataaaggggtgaaaagtagatcccatttactgtaaaaatacagtaattcatcattaaaaaaatcatcgtatcacccatgatcacctcattgattctgagatcttaagatgagtgtaagagacaagaattggaaataatttcttttctttttgagctgaatattttgtactacacatcactctacctattccaaagtagcaacataggaaagtcaaatttaaacggcatccttcattttaagctagagacctttgtgtttgatctttatatccattggtgtgttggttagagagctctgaaatatcttgttctttatttctataataataaggatatattcagtgaataaataataaggatatattcattgaatttattcattatgataatatgtctacttataccagtgagaaattgtcaaaatatttgatggtaggagggagaatcttagctgtttgtccttgtctgttcttggcttggaattcagttgtaaagacagatctctctgtcatttgccaataagccacaccccatctttacaaaccatcctgtcagtagatattattgccatacagaagacttggaaagaggtggaaaaactcatcatcatttcctactatttctgaaaaacaactaatacttagctgaggttgcaggggtcagcccttcatatgtaaaagcaatctactaaaatataaagtccagagaaacctcaaacagtatagagttccattttcaaatccggtcacgggctatgaaagcatgcttttcttttaaatatatcaaatgttctgttagagtttatcacagttagacacagtgtaatgtttttcaactttttaatggtaattttcaacactaatttttaaattagttaattataagagattgagtacactaacttgaatcttttaattaactatgtagacaaaaatccccaaatgtctgtgataaaatccatactcaggtattcttgtgtagtagaaatatttctctttcaattttttgccgtgctatgtcatgcttctcccacaaggacaatggttgccctgtgtgggattattaaagaccagcagtgttcacagacttgtgcaggacattgtgtaaaactaaacaattatatcatctaggttattttgtcatctgtgctataatatggctttgccctaaaatctaataattctgaagaaaagaaaataaagatgactgcagagttatgaataatgttaaatacctttcagcttacaaaacacttgcatgtatatatgtatgtgtataagtgacatctatctgaaatggtatttgttccttatgagacctccatgaagaaggtattaattgagacaggtattgttaagaaattaagatgtggattagttaactgtcttatctaagactgagcaatcacttaatagctgaactgtaattcaaacatgtcaccatattctatatttggtgacactagtatataattctttaatgctgtttaggttgctgttaagattgtcttgtttacaaatcaagcaagtataaattatgactatagttcaacagtaaatagaaattctttattagaatttggtataatatagtctatggaacatacactgccccttatgtttgttgcaatgtacataatacataggaggtgatcaaaaggacttaagatggagtcaaataatctaatgagtgatttgtgtgtgtctgtgaaatatactgttgctcctaagcagaaaatgtcattttggtttcatcctatgtttaactaccatataatagaatactagcttttcttaatgaaaacctcttaacacccacttgaacatttcctgtctataaacagcctggtttctcaccaaataataacaatatggaagcagcattgatccatattatgtgacttattttaacctgagttagggatattgcagtatcctttgataggttctatgaaattatagatatataagactactcttaacacatttataatccaaacaaacagccagcacacataaacatgataaataacactatgagaaaaaaaatgagttatcaggacgttgaagatgtagataatggcaagttagcagggtaagtcatatttcaatgtgcaacctctgcaagtccacagggtgtgatatggacatgagggagatctgtagatgaatactgtacaatactttgacgggttgacaaaatgtaaaatagaggtatggccataggaaaaaaaaaaaaacagatttttagccccataggctgagggattaaggagggctggctacaggcattttggaatggaagatggtgtaccaacaaatcaagcttaggttcctggcaatttgcccacatataatgtgtgaaagttcagatgtgaaataaatctgcagctcatagtaagaacctagccacaggagttaaaacttatggttctgggaccagatggactgccttctaatcttagtcttactaaatttcaacagcataaccttcagcaagttacttagcctccagcgtctcagttttctcatctgtaaaatggtgataatgctactcttacattgggttgtagtaggataaaaagagaaaatgtatgtaaaggctttagtagaaactcttataaaaattaaacaactattatttctccattcttcaaacaattattatttctccattcaccaaaccataattatttatcaattcaccaaacaattattatttctcagttctaggattctaacctgcaaaaggcataaggccgttgctgagtacagggtgaggagatggggattcgatcaggaaaactcttgtttcactgttgctgttggcgtttttgtttgctcgtttgtgtgttttttattcattattttcacttctgtttattgacaaggttaatcaataacatcatttacatttagtaaaagtaaatttccctaagtggtctcctaggcagcaatgtttattcattacgtggagagcagatacaaggattattttattgctgcaaatattttattgttgatatttcatatttaaaaaataattttattttttaaattttttgtgggtatatagtaggtgcacatatttatggggtacatgagatattttgatacaggcatatgatatgtaataatcacttcggggtaaattgggcaagcatcacttcaagcatttaaccttttttgtattacaaacagtctaagtattttagttattttaaaatgtacaataaattgttgactatagttttgccactgcaaacaatagaaggctgcctgatatggcctcctagtcattggagttctatggcagaattcctaaagtcttcaagtttcatgagatcactaaattttggtaaatatgatactttctttgaacagatgctacggaggccaataaaaggagtgtgagtaacagagtggtacctgtgatcagtatctctccaactacaattcaaagagttgtcccttacatttcttctgtgtggctcctcttatgtaataccctgcttggtccagataagcagaagtcagaactggctaagaatttatttatgtgtgtttatcctgatgttttcctactgtcacttttcttttcttatggattagcattgaggggatggtcagatggcacctgtctgagtctgactgaaaatttttagtgggggggttgatggcatgctcaatggtttagtatatttgagttagtggcagaatgtagacatgagggtgagtagagaatgcagagcggaccaggcaattcaggaatctatgttggttgtttaattgcttccgttttgtcaacatcttattccacctgaaaaaattatctaggaactagagaaattaatgacacgtgtagtggaaactttgcatagtgtaagtgttatccatttacctctcttagtttccggtacaatgactctcctggtagctgtcttatatgataaatatgatttcattaacaaaatcatattttatataattgcatactttaaacaagtgatcaatataactcagttataaatatacagtaacaaagatcaatggataataaatacttcttcatttttatggatacattctatttttgtttgtctcacaactagtaatcagattatgaattgtggtacagctccataaacacttactttatagcaattcaatgatacatgctcagccaaaaaaaaattaagagaaggataaagacaatttaaagcttctgtgtgtgtgcatgcaccagatgtgtatggctttttatgtttatgcctgagtgtttaggttcatacgtatggttttaggcagagttttgctcgtaatacgtgcaactttcacatgcccattttaatattagccttcaaataaataaagattggtttgaattaaaacctgtaatgaaaacttataattacgctcacagctgacagctgtcactgaatgtggtgcataaaggtcctcaagcatacagtgctcttttcaccatgtgtttgagttgagcagagttcatgtacgccttacccttctttatggctatggtgaagctgtgggtttaaaaacactcgggcaaagagtaagtcctcaaagttgcaggccattccatggagaggctcatcaggaatagcttgcttgaccgccgctgctgtggttttctctgctttaaaattattacttttgacacatgaaaaccataatttcttcatgtttataaaaaataactatagctggaatatgtaaaatatattaaaataatgcatctaaaaactagttttggctaactgatataattggattttcagggttttccagatcccactaagtaaggatgtaatgtaaactaataaaaataaagcctgagaagctttatgatggcatatggcaggtcatttttattgattgaaaaaaaaggatgtttataccgcatgtatgaaaatgaaagaaatctgttcggaaaaaatgggcataggatcagaaatccaagttaaaataatttaaatccagaaaatacatgaatgccttcaaagtttaaaacctatgttaaggattctacatagtccctgatcccttattttctttgttattcatgtactccatgcttaaatacagctgctacaaagtatcaattaaattacaatcccacataaagctccagaaaaccttgatatatagggaagtgaagctggggaagcagttaagggtgggattgatgattgatgaattgagaatactgaagtcaacaggctggacgtatggtatgtggtgtatcaaaagagtggatatttaagacagaactgttagagttcatgaaattattggggatgatggcaccgttaacatgttaggctgagttttgcagtgggaaaaattaccagtgtaaggtggctccacgtaaatctctaactgctataaatgaaagcttatttgggcttactcaccagcacatcactggatatatgtgagaagatgctggggtttgtgggagctgtcttcactctcaatatctctggattatccttggggtgtagcctgaggtaggggaaagagtggtctttaggatgtcaccccaccgatttgctccctacatgatcatgggaacgagctaacttctttgagcttcagttataaaattagctttttcttgaaggaattagaaggaagtaatgtatgtagtatcacagcacagtgcctagcacatacaagaccctgaatgacaatgtctttttccttttaaactgtgtgttaatgggatgggaagaataaagccggatttttaggaagctctgctgaaagaacataggaaaatgtgtttaaccatagcttcttaagtgaccattcctaatagccccaaatggctgtatttattctggctcatttttaaatcacgtgtgatccagaggaagctggttcccatctacagcacagtgttatccaataacacagagcaaggataaatgtagttagaagcagaaagaacatcaaacactaatgtaattatctcaaactgagtttatgcagtcaaaaggtaaaataatctgttcagtgtggttagattctttaatgttatgtctcatctgaagagataaagtatctgagaaaggatagagcttaagtaacttggaacattaagcaacattgaattgaggtagcactcaagactgagaaagcattagtgacacatgactggcctctgtgacagtatggcatgtactttttttaaagagaataaaactgaaaaagaagacttaaacttttgaagattatgttagtttttatttataaagcaaagaaattaatgtttggataaacagtggatatttttggttaactgatgtttagataaactatagataactcatttactaacagaaagtaataaatgcaaacacatgtgagaaagaagctccctgcgtagatgcagtgaaattttattatatatctactgtgttaaagacagattttgcagcattaatatgaaactagaaaaaaatacttttttattttttgtgctttttcactttatattacctcagttgaaactgcacaatgatgacttcattcttggggtaagaatgttatagagtaaaaatacatctatagatatgtatttacatatctaggcttatacttttaccatttcttagataaaaattataattctataaaaacagttacttgggattatattttaactgctgaaagttaccagaaagttacataatctacctcagatatttttaaaaatggaaagtaggatttggtaatgcacagttaaaaacagcaatcgaaaagttgtaaaggaacattgctgtttataagttgctgagttaacactcctaaaaacaattacaaatgtcattttctctgggcctcattctttcagtcaataaagagttagtgactacctgagtgctgcaacaatgcataagacacattcctttagcttaagagtctaacatatggaatgggcataaaaatacagacatagacgatcaaagtagaagtgcaatgtgtcgaggagaatggcagaaagtggaaatgctatggaagtttagagtgcaaagtgatttctttccatccaaggaacctattttcatattttaattgagcctgctaagatggggagtattttgccagtttctgaaaaagtgagaatttctccatataggataaaatatgagtaaggtgaataggaaaaatcaggtacaattttcttgtagtaatttatgtggactgtaatgcaggaggtaacaaagaaaagagtgagcgttttaaccagactagacaactgtggactgggaaagatattaatgggtgatgagaagtctctgaagggtttggacctcacacaaagatgagatctcataaactggcatgagtgaggagtgctggaaatggctgatgagagacctgtctgggactttatttaagtggtttataggtagaaataacaggagttaaaaaaaaatagatatgagacccactacagagatagaatgaaaataaattagcagttagtcatgcagataaggaaagagtagtcacctgtgtgtagtggagatcaaatgcaccagtagtaagatagcattctggatggatgcagccatggcattgcaaagaggatatcttcatgtgtgcaatagaagtcatgaggtataggttgttgtgagattaaatgaaagtatgtacatgaagtggatttttaattaaaatactctaagtaagtgaataatattagttttattatgaaagtttagaataacatgacttgaaagatagtactattttattaacagagctgtagaaataaaaaaaagaaggaaaatattttggggaaattagcgaatttaatttaagagagaccaagattaaaatattattagttagggtcccaaaaggaataaattaggatagtttgaagaggatttgttacaaaatgattactggaatgtctatagagtgtcagggaaccacaacgggttctataggaactcagagcaagaaaaggaacccaaggccagctgattccacccctaagcttgaatggaggaagggagatagagatggaagaagaaaaagttctgtatagctaagctgcctgaaggtagtcaaaggccatgttcaacccaagaaaaaatcaagggagtaaaccaggggaacaaaaaattgaatgtcactctactctcttccttcagtatctagtagttgggtttccccattggatgaaccaactggaagccaaagagcatgggaacaaattgaggttttctcagagtttaagaatttgtaagtgctggtggcactgacatttaaataattatactctattcactaacgaatacattaggcattctcaaaaattagtggaaacctctttgaagaatctgtggattatgacaggtattctacatttaatgaagtttgtatagattcacattaaagcagtttggaattagtttctcacctctttgaccagaaaagggaacaacttgtaccagaaaaatagaaaggaattgttgatttttatatacagtcagacctccatatctgtgagttctgcatctgtggattcagaaccacgaataaaaaaccatgtgtattagtccatcttcatgctgctataaggatgtatccaagactgagtaatttataaaggaaagaggtttaattgactcacagttccacacggctggggaggccttgggaaacttacaatcatggcagaaggggaagcaaacacatcttccttcatatggtggcaggacagagaagtgcagagtgaaggggcgaaaaagtcccttataaaaccatcagatctatgagaacccactcagtatcacaagaacagcataggggaactgccccatgatgtaatcacctcccatggggtccctcccccagtacatggggataattcagattacaattcaagatgaaatttgggtggggacacagagccagacaatatcaccatggatggaaaataatcagaccaaaaaagaccccaaaataataatacaacagtaaaattacaaatcaaaatacactataactactttttatataacatattagctattataagtaatttacagacaatttaaagtatacaggaggagatgcataagttgtatgcaaatactacactgttttatatgagacttgagcatccacggattttgatattcttgggagtcttgcaaccaacctcccagggatgtgaaggataactgtattacactatactagggtacttaccaaggaaaagaacatgtcagtgaaacaacactgaaagcagaccacaaaaacttctatacttaactagaatggggcatcaaagagctaaacatgctttctgtctcaacataaaacaacaatgtgattcgtcttaattcagaaaccatctttgagtcagtaaacttgcatggaagaacatctaacctaaaaatatggattccttcaggttttacatggggataactttgtctcttccaaatttatgtatctagatgtataaacttgaaaaataaaagagtattattataatggcatatatcttttaacatttaaaaatataaacttgaaattttaataagaatatatgaacttaaaatatatctaggctttatattaaggaataaacacagttgttcaggcagatgtttcctttatgcaatcactgctagtctggatttcttcattagatctcttagtagatttctgaatattagcatagagataaatttctgcagtaacacagctgggactcttggcttccaagtatttggaacactcacaagattttgttgctttcagttttgtcattattttccttatccattttttatctctttgtttatgttgtctccagtcctattccaaggattttcacagacttgctagctttaaaaaatgagtacagagtgtttagaaggaagggaatgactctaaatgaatttctttgtataccttttttgggtcacttcaaaataatttagaatgaaaataattaaggctttatattctaaattaatgattctctaaagtgggtccaacaacattgatgttactaaactatattttactttttctaaaatattgccgtatctataattcttcatatattcttgataaaggctttatttgtaaaacttgtcaatttttaatatagagatataatatagatataatatatagagagatataaatatataactatttttgtagtataattactgacacatggaagacactccaagatggtgtcctcaattggatgtcgaatgtccacgaatatgggactatataacttattgtatatacagtgttctctatgatctcgaatatttataagattgctctaggatagatatactttaatataacaacaacaaaaaatgagaatcaaataggttaaattacatagccaaattcctcaaaggaatttgtgttttgaaacattttcaaacccagaatattgtcagaggtcatccagagttagcaatatttggttctttctgcaactacggatgaaatgagttctatcatttactttagagcatttttgtactcttttcttttttatttataatttttaagctattgtttcacactgcacttccaaaatataacatgcatctaacattaacatattggttttccattgacaaggaagagatgtaatattaagatatttacctagttcaatatgaatctgtaccaattaaaagcaatattttagtcagtatttcctgaggtgaattgatttatattgttttcttccattaaaaaaaaaacacattcccatgtgttcccttttccctcatcgttttgaaaacatggaatcaagtttgctttgtttgacctttcttttgtattattactaattttgctttttaaaagtcttattagaaaggaaatagttactgaatgtgcttgagaaagaaaaaacacacagcagtaaataaaaatgcttagtagctcccgatttctctctcttcccagccactggcatccaccatgccactcttcgattctatgaatttgactattttagatatctaaaatagtcatgcagtatttgtctttatgtgactttcttactttaccaataaaataaaataaaactcaaatataaaaaaatttctgtttggcttaagctggatatttaacttcaggtaaattgttgaaaagaaccgaatcaaagtcaaataactatttgaagtagaaaatatgataggcaatatctgttcatagtttttaatcttgagtaattgaaatgtgattttttttcttctaatcaaacaaagcaaaatagattccttaagtggtgtgactatttggagctgttttgctgtttaatgaaacaactgtatggttttcataatatgtgatacttaggtatgataatatgaaaaaattttgtttagagatattgtgattaatgtttttacttatatcttaattcatatgttgaaagaaaaatatatctggtttctattatgtgcaagattctctgcacttagcatgtagttataacctttcagctagtgagagaggtttctaatacagggatttttttttttttttttttttggggacagagtctcactctgcctcccagactggagtgcaatggtgcaatctcagctcactgcaacctccgcctcctgggttcaaacaattctcctgccttagcctcccatgtagctggaactacaggtgggcaccaccacacccggctcattttttgtatttttagtagagatggggtttcaccatgttcaccaggatggtctggatctcctgacctcgtgatccgcctgcctcagcctcccaaagtgctgggattacaggcctgagccaccacgcctggcctacaggggtgtttagataagagtcctttgagttgcggaactcatgaatgaagtgaacttgccttttcctggtaattaaaccaaattattcagaagtaataaaatgttttatttaaaaggtataattttttaaaaagtaatttgttttagttcttttataattcaccaatttattatgattacattgctcattaattgcctctcaagtatttgttgaattaaaatatcaaagaagttatagtttaaaaggaaaaaaacaatagcagaaaacgaattactttttaagacctaaatgcctaggcttctttttcataataacatttagaagacaaaatttaatttatttggagattctaatgcaaattcacttataaatagggcaataccccttaacagcactaaaacatgctatttcttcagatagttaaataaaacctgtcagccatattctaacctgtgctgaaatgtatcctgaaacctggcaaaagatcctattcttttgtaggcttgtaataaatacaacttacaactataatacttgctataattactatttaatgtagcctttgtaatgctttatcaatatgggtgcagtccaatggttagtttcattgaaatgtgtatataaatatgtattctagtcagtgtgttaatatcagtaagagtaaatcagaagagttttccattttaacttataactagtgcaaaggtaaaacactttttggatttatttctataagatagctctaaatatatgacattgtaactaggagttaatagtctaggttcaatcttaaaaaaatgtcgttaatggtaattggtaaagcctcaaacagtcttcatcctaaatacacatacacacagacacacacactaacataaatcaattttgtgacttcctggcaaataaaactgagtttctattttttatccattaaattgatgaaacagccaggcatggaaatgcacctgtagtcccaactacatgggaggcttaggcaggaggactgctgaaagccaggggttgaaggctgcagtgtactatgatcatgcctgtaaagagagttactgcactccagtctgggagacccttgtctctaaaacaaaatgtaaaattcaaaaaatttaaaatttacgtcttgtgagatagaatgaattttgcatcttcatataccattcaagggagtataaaattacaatgctgcttgattattttgacaatatgtctccagcaatgatgagtttacagaaccttggatagatagaacatatgacattactatcttaagctgaatttaatttgtttccatgctcccttttctgctgttggtaggaaccatttacacttgtcacttcaagttcccacatttacttctggtttttaagttgttttctatgaactaaatatttaattatattcagttttgttctcccttcctctttccgttgtttatggctgggtggcctccaaggacaagcagtttatgtaatattttgaataagcaagatgcataggatataaaaaaagacttaaatttttgtctcctgctgttcctttaaaatgtgttctgtggaggaaatgcctcccctactcctgattgaaaactccagtggtcctatttcctactcactcttggataataaaattccttcagttgagtcaagaggaaaatacagatttgattctttgaatagtctaccctatcattcccatcctgccttgccttgcactttgactcctgtttctcatcttactaatcattggtaactaatagagaattaaagagagagtgtgggggcggctaatgttcttacctgacttattctaacatgcctggacctggcaggtgcttggagctgagttttgctcttaggaggaacatgtgatctcatcagtttggggaactcccttaaagctcccttgacttgggcaaagcattcttcactaattctgtgctttgctgcctctgtaaccctgcagatcagaaattcacccttagcttctggctgttcaggctctatcaccctctaagtggcccatttgggaagagtccagggaaatagtcctgccagctgtctcaggaggagtacccaaatctcgtagggacaggtaattctagacccaacaaactctgggaaaacaaacccactgttatggcagcttccctctaatctgcagccttagcaactaaactgcttattcctctctgtttcatacataagtcaagcctctctactcactaatgctgggattcacgttcagttctttggaacatccaattaaagtctgtctaactgaaactggaagaaaaagataagtcctggccactcttctaccttgggtatggggaggatgctaaaaatataacagcagctcctcacagaaactgtattcagagactctctcaaatctccaaaaacctaatgtggataaatttcctaactcacttctaagccccttcttggaaactgtaatgcggtttatctaactctctttggaatatagcatctctcatcttcattcctcagccgaaaacaaggcaagaagaatcctatttgaataccccgttggaatatgaaagtactatcatggcagcacaagttaagaacactgttctgtagatccgcatcaggcccggctccttgaggcaggccttcactgagctccctctgttcaggtctgtgctccttgccttacatcctgttttcacccccactgcacccggaactgaggcttctgctcatctgtcatcctcttgtcatgtctgcaactccccacggagatttcaaaaatttacccatagccacaggaaataagtagggtgggtttggttactagtatcccccatggttttagtccctttcctcctgtctcttctcacttgtttatagcattcttatgttttcttggtagaaagactgataaaacatccatctctattcctgtcttattacttgatttaattaacatgagaattgaaaaaccagctcgttttctcttgactttagatgtgctctgcttaaagacatttatatttagtttgcatgaaaagctaaatgtttaattctgcttcctgaaagaatcagcccttaagacctcaaaggtcagttgttatagtagttgaaataatgagtattactgggaattatacatcataaaaatttccaaaactaatatcccaatacttatataataacatttgtgtgactaaacatcagaacattataaccatgttgtaagcatctttcttatttaaaattagaaagtcattaaattacatatgtttgaaattatatggaaagaattatgatgtattattaaatggaaaaactagaaaagtgacaactgaacactagttaccaaataattttgtgattttttgttctttttcagtctttgtcaattttgctagcataacctcaagtgacaaactatttagaatcatacaatcttacaatccttctattcagtgtgttacatgttgcaaggcaatcaaaagctcaagaatgcatttgaagtcagacttctcagataagtttctacattgtaataagaaattaaatattacatagtaattattggtgttgtgaatggattggtagctcttggtgtagtgaatggttcagtttctaaaaggataatgccttcaccttaataggaaaaaaaaatctctgtagagtgtgcattactcatctaaataaggatttagaaattgatttctgccagctttaaagaaatgattaagagagagaatatttaattaccactaattataccagtaagcataatgatgtatgggtgaataggaaaactttactgctttcatattaaaaagacattaactcatgacacattttgcatctgatgatatagtgctttatgtaaatattggaaaaaatagcttattagttaaattttaataaaggtttggagaacaaaaggatcattaacaataattatgaaaactacagaataattgaaaagagcatatgattaaatattgcataaaacataggataaaatggtatatctaaatcttaagtgcaatgtcatttgtaaatgtcggcatctctacctggcatttgttatactgttgtaaatggtgtgagataggtatacaaatgaaaatatctattgaggttttgccatatgtccagtatttgtagtcaggcttttttcccaaaagaattacagctttaatgtaataaatgtaaaagaagaagataaggaaaatacctgcctatatttgagggagaaaaagaagcaaaacttctctgcccttttccttccagtacttctctgcaggtccttgtactgccatggaccttggagctaccttataacatctgatttatatttggtttctagtatttcacaagtgcattataactagaagcagagccaaaatcttattagtggagatgctatgcagtgaaatgtcaacacagggcattcgtgttttacttttattgctttaatagatagtacattttgtgacaacatggtctatttgaataatgtgacatttaggggaagttttaaaattgattttattcaattgatattaatgttgggttaagacctgatataataaagaaaatagatgtgccattctctagctttctttcagagtgaaggagtttgagccaggaggccaagaaaaactgaaaggatctttatatttagcattaatgccatgcatttgagctcacgtgttttcagtgcatacttaatgtgttcatttgaacagagcaattggtagctaccaataaattacagcctagagagtaacaagtcatgaattcagacaattgcatcatagtagaaatggattgggatttccgtatcctattacttacaagtgatttaatgtatacagagttattcaaacacatttcacacaatatataacttcaagttaaaagtaatgtaaatatgcttcttgcaaagtcttgagaaaaactaaaaaaggttgagactaaagaattgagaattagttcctgttagctctttctcatcatgtgcttcattagtttatcctttgagtaggctaagccttgaatcaagctattcttgtctttttatcccggtattactctctatcctaccatttccatactctttagctattagcacggaccgaatattttatacattgtcataaagatggaacaccttggtttatatttttatgacatagagagtagccatcttaactcactgtggagaagttcaaagtctctcttcattgtacagaaaaatgaaaactggaaacaatattactctaaattatagaataataatgttattatatttgtaaattattagagaattatagaattataaatgatacaacagaagaaaaggaaacaaatttatcatgtgtaaatcatgtgaataaaagttgtcacttggatactgtttaaatatttacatattaaaatggaaacacaggctactcagagcacagacgcattcttgagttgaagcaacacacttcatactcccattgcaaacgtgcttcccactcagctgggaaagtcaacatcagtatcttaggacatgtgtttccttctttttcctctccaatacagtatttatttgtatcacttttcctctcttgtttctattttttaagaagaaagattctgctctctaaggataatattcccttcttagatcatttacatttcttcttgtcctgtcttccaggaagtatagtataatatatagtggggtagaaggtagggaactgagcttcagagtcagataatccttcaaatattagctgtgttatactgacaaaggtatttattattcccatttataaatggggacaaaatattaacccatagtgttcaatttttaccttgtaccttaagaatccattttggcttaaagtcatctgaaaatgttttcttgtattatcggccatatcaccgataaaaatctttaaaggttcaggccaaagattgaggtaagtgactagcaactgggtttttccctggaaatggaaaatcattcattggtgggagcagtattaggaattgctgcgataatttcacagaatggtgactataatcaataataatgaattgtatgtctcaaaattccacattcaaaagcatttggagtgatggatttgttaatcagattgatttaattacttcacattgtaaacatacagaaaacatcacattatatcccataaataaacataattatttgtcatttaaaaataaaattttaaaaataaaagaaaattttgtctaattccagaggctatcatatttaaaagtactatcaaccctatgatattcccttttgtatgctagtctaaattatcaggtcagctcagtagagagtaaatatactaatatactaataacaagaaaattaataaatgaaacaagatgttagaagctggctgtaacatttttaaaattattttttaaagactattatgaactaccttgtaagagtaaacccaaggcaacaaaatagttactggaaataggcaaaagagaggtgagcccagcatttagcaccatattttgctttaaggtgttttcccaaactgtgcctaaatggtggttttcattagtttttgggtttgcaatggagttgcaagaagcacacacacatacacacacacacacaagcaaagcaatgaaaaaatggagcaaggagagctttgcttgtacgttttgtccaattctttgttcaaaacaccaagaacctggatgacttacagtcaagaccctccactagtaacaatgggagctgctgagttcaacctatgttgttcttgtctagttttttttttttcttatttcttctacaatactgagaagtatataggataatttccaataatatggatttttcccatcttttgttactaatttatagctcaatagcaacatgttcatgctttatgctctgtaggatttaagtcctttcaaattattgaaacttttttttgtgtcttgtatatgtttagggtctctctctctctctctctctctctgtgtgtgtgtgtgtgtgtgtgtgtgtgtgtgtgtgtgtgtgtgtgttgcaactccattgcattccaggttcaaggctgcacggaaatgtagagagcagagatttgaggcagtttagggcatgaatggtgaggtcccatgagcacctttctgaaaactttgccctcaagagcctacctttcttggaaaatttttgaaatgcctttggtgtcattctcccattgtcttaatgaatagaacatgacttccttccatccatattaatctcttagcaaacagatgcttggccatacccttagtattctctcaaacagttttaaaattctttatatggccagggtgagaattttccaaattgcttcccttttaatttataaattccatctttaaattctcacctctcactttttactatatccagttaaaagaagccacacagctgcttcaatattttgctgagaaatttctttctccagatagtttagttcatcactcttaaattctgcctttcataaagcctttggggatagatacaatttagccaaattatttgccactttgtaacaaaaatggtctttcttcactccatttttcagtaagattttcctcatttatctctaagacctttttggaatggcctttcctgtccacatttctaccaatattctgataacaatgacttaagtaatctctaagatgattcagaatttccctacagctgttctcttctgaactctcaccagaatccccattagtgcctcattcatggaaatagaggctttttgcagcctgcttctccaagccctttcagtctctgcccattacccagctccaaagttgcttccatattttcaggtatttgttatagcagcgccccacttctccagtaccaatttgtcttagtccattttgtgctgctgttagagaatacctcagaccctggataatttacagtgaaccaaaacttactggcttatggttctggagggtgagaaattcaagatcaaggggccagcacctggcaaggggcttcttgctacatcatccccaaaggtgaaggtgaaagggcaaagagaaggtgaaagagaaagcaagaggggactgaacttgctgttttataacaaacccacccccgtaataacgaacacactcccttaacaatagcattaatccatttattgggataaaaccctcatagcctaattgcctctcattagtccccacctcccagcactgttacattggggattaagtttccagtgcatattttttaggggacgcatttaaagcataactgggttcttctcacccctattttcaacttcttttttctttatctttgtttttagccgtttgattctaagatgtttgagtgtgattatcttccagttgatacggattagagttcactttatttcttagatttttagatttttaaatctaagtattttactctgaatgggaagattttaaggataatttatttatcacctgattttctggctagaggaagatgctctcttctggagctttttctaactacatccattcagacttccaggatttaagtttacttaaagccccatataggatataggaagcaaaaaaaataagacaaaacagaaaacatcggagaattcactgctgagtcatccctcaggtcctgtgttccctagccagtctatttgctgttacgtacctttcagagtcttctgatggaagctatgtatattatctccaagtcttataatcaaagggagagattgggtggaatgtgcttatttcactgtagttggaaactaagttaacttttaatgacactaacttagcatcttaagtttcaaatatcattagcagaaataacatttttggcgttttcccataaattaaatgtcattttagttttaagaaatgaagacacaaattatttgattcttactaatgatagtgtaattaaaaacatcagtgaccagacatctattttcaaacatagaaagaaaaacacaattttttttttttgttaaataaaaaacttaatgacacggagcactgcaaaaacagaagtttggtttttgaaggttcaattttgctttttgtgtcctcccaccaaaactttatttctacaaatatcagagctattttttctttgctaaaattgagtcttttattgctttagcttcatgcaattttgcttcctttcttctgcacaattcatttctttctcggagttctaataagcatacatgtaaacttcaaataaaatattgcctagcttaaaaacaactaatcaaacatacgttcttttttaatataatgtttcctccatacatcctggctattattttacctccctagtcttcatagcaaggctttttttgtttttaagattttgctagattatatactctttattatcttccagtttttctttaacctgttctcaatcattaccacttcagaattttctcataataatttccatcctgtacatccatgagaaaatgtcttccttaattttatttgactcagcagccctctacaatactgaacattctgttctttgtatttcttttcttggcttctgccataccacactgtccgggtttttcattctgtttcattggctgatctttctcagaatccttggttactcctcattatacagtttccaaatcttagtaaaacctgggacttgatcctgagacttccttttcttcacattcttcttaatttcatgctttttaaaattaagtcatgtctctaataacatattttatggattccacattgcctagaatatggcaaactgcattctgtgaactggcttactctttttttgtaaataaagttttattggaatacattcacacttgttcatttacacattgtcacactgctttgactacagtacagaattgggtagttctgacagaggccaaattaaaatatttactatctgaccctataagaagaaaactcccaacccctagaatagaataaaaaatttttagcaggatataggcttttcatgacctgtttcttaacactcttctgagatttatctcacagttatatttttagtctaatagtgccaaagaacttgtggttccttgaatgttttacatctttgtgcttataactttttgagtatcatatgctttcagaaactgtaatcactcagaaaattatatttttacccttcaaaacacaatggataaggcaccttaatttcaggacttaaaaaaaaaatcgcaaatgattcttactatttatgtgctatcacgtaaactgttctaatattgtatatagctcactgtattttaattactcgatttcactcaactttttgaaatttcaaaaaaaggtaaaaaggaaattaaaaattctcccaaatattactattttcattttgacatatataaagtacaaattattcttcccatttcagccctttgatttggtatatatctctttctatactttttttttctcatggaaaaatgatataggcacagatatataacaaaataggatagtatcatacagtttttaaatcagatttaaaaatacatactcttaattcacttctgtggtacctacatatctttattttgtaaaatagtgacactgtatttcctggtggagatgtttataataaattatttaaccagctctatatgatggatatttaggtaatatcttttttttttgctattatacacgctcataaaaaactttgttcatttatctttattcctgctagaacttttgtagccatttttcttgaaatgaagctacaaaattattctgtaagaattttttatcttatacttacctcatagatttggactggagacaaatatgtgtcctttgctttatgtctaaacagtatcaggttaaattttggtccagaataaaatgtatgtgaatactttttcttatgtcattgtcagcaatggatgtaactaatctttcaaagttgacaattttatgattcatgttttcaaactttttttagtatgtttaattgccttttatatacgtttttattaattgtagatctttattaagtttacatttgtctatttggttgttatattcatatttatatataggacttcttaatttagtagataaataaccatttggtctgtttatactcttcaaatgctttttcccagtttatattttatcagtagacgttattcataattactcttattttgtctttggaaatgatgcatgacttgatttcttttcaagggctttactcaaagaatataaaccttatttttctaattttcttatataatgcttggatcctttatccatttgaaatttgtttttgtatatgctaggtggtagtatatactttcataactaaattgaaataccccaatttttatatatctgattttacttctgtatgctattaggttgtaattttctatttgtcgattatgttcctatatcaaacaattttaattatagtagctttatttttttagacatctattccttttttttgttttgttttgttttttttgagacagagtctcgctctgtcgtccaggctggagtgcagcagcacgatctcggctcactgcaacctccgcctcccgggttcaagcaattctcctgcctcagcctcccaagtagctgggactacaggcatctgccaccatgcccggctaagtttcttgtatttttagtagagacgggatttcaccatgttagccaggatggtctcgatctcctgacctcgtgatctgcccgcctcagcctcccaaagtgctgggattacaggcgtgagccaccacacctggcccgaagggatcctttgacctaaatcctaaccccattacagcctctgagtcttctcgtcttgtggaacacagaagtctgccaaagctagagcaggattttggttttcgtttgttttgtattccttgttttcttgctttatagaagagctcatggctaggatgggtgattttagtactagacattatcagcatttctcatttatgttgctaattagtaagcatccctaccaaagtctatttcaatgcaagtaacctgtagttatatcctccgagtgattttgtcatgtggagacccttgtacttttctgatcccagcaagctcacatgggaactgtggttcagggaagggtaaggagggtggtggggaaggggaggctcccacatgtcctcaggcacatattacagaaataggaacatagggatcatgatgggaatttgaaacttgttgattgtagtgagcaaatcatgtaagaaggagatacttgaatggcaaatggaatgtaatggttcttcccattatatattgataagatttggatctgtgtcccagcccaaatctcatgttgaattgtaatccccactgttggaggtgggtctccgtgggaagtgattggaacataggggtggatttccccctccatgccgctcttgtgacagtgagtgtattctcatgagatctggttgtttaaaagtgtgtagcacctccacacctctctctttctcctgctcctgtgtaaagtgctggctcccccttcactttctgccgtgattgtaagtttgtggaggtctcctcagaagtcaggcagatgagtcttttacagcctgtggaaccgtgagccagttaaacctcttttctttgtaagttacccagtctcaagtatttataccaatgcaagaacagagtaatacatatatctagaaaatgtggactcttaaaaattactcctcattaggtagtaacaaataacatgaattgcaaataagaggataatatgaaaatatctttgtttttataggttgctgtttcataatagaaaatccctacatgcagattctgaaatcagttcatttatttaaatccttttctgggcagatcaagaaagctaaactcctttttaaaaatatagacattagagttacatttgcaaagataacagccttggatctcttctatgcttatataatacataatcttgctttgtatttgaatatgaaagagctattttatttttgttggcttatgtgtggtctttatgaaccatgctcaagcacactacctttagaaatatttggtttggccttcaaaaagacatagaggctctatgaggtctactgggagtttgggagctgacctatcacttgatgtaaactattgtttccagggcgcccacagaaacaatttagagcccaattccctggagcttcactgctgtgagataagtatgtgatttctcctttgtttctgaacaatgtccaagtaactttctatgtagagcaatgccagggcatgccatctactatgccttgccaaaggtgatatttttggggagacatggaacatgttgtacagtcatttgtagcttcacattttaactaagtgtagaaggagaactacctgttacttctagcaaaaatattttcccagggatcatgataaatgaataatctgtttctaactccacccttttatggcttataccttacttgttaatgcccttgggacatgttttccatgaaccagagtcttttacaacttattatatatttccaggtataaagttagctgctaaagccacctttttgagaaagagattggtgacaaagaatactataggaatatcatgcagcaacttatatatgaaataaaaagagaaagttataagttgtaatcctctaaatatattaataggcacgtttagtaaggatgtaaggcataatgatattcctctgagataaagaaatccagggtggagttgtgaatgaagctggagaggagaaaggagagtcagaaagaaggtagagctctagagataaatgaaaatggtgagtaggagttcagcaatgcttagtgtatgtgactaggtaagtaggaaagaaattacactgcagaaatgatttcttatcctccagtataaatatggtctgagtaatgtttcttaggcagtaataagatgactgtaaataaattgaaaatacaaaatgaagataagattaagcataagtaaaaaaataaagcctcaaatcagcaacattgagcctaataggatgacgggagtcaatcatctgattgtttattttggggctcaaagtcttatttggcaaacctacatcctttccattctgattgtcacctttattcactatactcagccagtgatggcagggatgggcacctgcatctctaaactagttagtaagtttcctaacatgtcatgattaacatttgaataaagttctttcatttaaaatgcaatttgactagttgatcctaatatacccttcccacatttttttagccaatatttacctgtaaaaatctaaggatggaagggaagaagaaaggtagaaacacaggaaagaagggaaagtcacatcatcatagaacacataggctgtctgagagtcagcctactgcattcctgagaggaatatccactagccatgaggtacttggggctacattgagaaaactgcctatgatgtaaccatctagcaatgttttgatttatgaaatagaattgatatttctatttgaaagacaataggaagatagtgattctgccatcacagccactgagtaccctactaacttgtcagaggaccggacaggtgcaggagaaatcacaagtcctgcacagtcaagactctgtgaaggaatggcattggaaagtgtaattatcagtctcttgccccattgtgtaatgaaaagttcaacccgggcctgggacctacctggccattgatcaaagccaaaaattgatgttaatgttacatagcccccaccttgttgacaacgagaaaagtaatggatcccaataccatggagcttaaaagcatgtattacagaacaaagtggaataattagaatctgtgagacttggagaaatataaactttcataaatgatattctatagaacacattagaaaacaatttgacaatcctgataggatgctggagacatagcatggcctcaaattgagaaggatagaaagccatatagtggcaaaaatataacaacatgaaaatgagcgatgagagagtaaagcaagtcaacttgtgaaagagaaattggagagcttaactggtggggaccctgggagaggtgacaccaccaaatttcctttgagatttggtggtaatttacttgaaaataaatttacttgaaaataaacaggactttttcttgttgttttgatttcttcttagtcacaatgtttcctttatttttaaatttaaaataacattaaaatatctctggaccacagacttatcttgtttaatacagtattcccaattcccagcaccatgactagatactgtaagtatcctgcaactatctattgaattaatcaatggatgatgatttttacactatcaaaataggcctgaagcaataactccacagctggtcagtctgagtccatctctaatctccatactcattagctatggccagtgacctcttatgcatcagttttcacatttgtaaacagggataataataatatcttttaagtatgttatgagatttacagggataaggtgtgtaaagtgtttgttctaataataagtgcagaataaatgttagcaattgtcattatattaaaacagcaaaaaaaaactaggtataaaaatgaaggtgatgtgatactcttaccaaaacaaaggaaattcccctccctgaacaggctttggtgagatatttatatatatttagaaaattaaaacaattaaaaatggcaaaaaaaatggagtttgcaataaagaaacaatgatgtggaaaggaagctcaaacgtctactctgtgaatttaagtgccaggagaaaaaggaacagtaaatccaaggttcaggggaaatagttacaacccaagtatttaatccataggaaaatgacagtcatagatgaagagaaagatgttgtatcatatgcaatgaaataagaaaaattatccaatacctgcaaataaccaaaacgattcctgtgtgacccttcagtagactgccaaacatagtctagagggccctcctggaatcgcctaactatacaagagtatgctctttaattgactagtttctttaacaactctgtaggactagataccaacctgtagaaaactggtgacaatgaagtgattcacttgaaaattatactttctgaaagtggttataaaatattttggagcatatgcttttttgcacataataattttgtaaaagtttatactgatttcatattgcccttagaattttattctaggcatgattttcattatagatacggattacatggctattcatgaccctggtctctgcttaatttttcatcttctttatctttcattttgaattcttcttctcttactactccttgccttgcatttaacatcacagacagtagatcaggccataactttttctcaccttctcacctctgtgtattttcatttgttgtgtcctttttcagaccagcatcatctaccctctccatgaggcatgcaaacataccacccttctcctgagtaactcgtacttattgtttaaatatcagcttttcctcattgttcaggatctttaaactccattctctggatttgtgtccctatggtctagccttggtaacctgtggatcaagagtctagatattggttagctggctcttccactccaggatctctcagaaggttgcaatcaaggtgtcagtaacagctgggatttcactgaaaagctaaaatggggaaggatccatgtataagctcacaccattgtcaatagcacgtgaccctctctaacatggccgcttgcttcatcaaagcgtatgggctgaggagacgacaacagagtgagtttattagccaaacggaagttacaatcttatgcagtataatcatgcattctgttgattagaagaacatcacaggtccattcacactcaagaggaagaattacacaaggtggggaacattgggaccattttggaataagcctgccactgtagtgcctgggacagctgtagaataaggtactgaaaagatggatgataaaaaattcattaatgaatatatgatttatatagagactatcttacagaaatatgcagaaaatcccttcccttgagcataagataatagatgaatttgcttcactttattcatatttttttcactttgaatagattctcttactttcttattcttcctcactagttttcaaaatattttcataaaacatggtcagttaagctaaaaatcaaaacaattgaaatagatattaattgattcattaaaaccctactttacataattttctttaaaatacacacaggcttctgtattttttctaatattttgaaatctacattacaaatgcaacatggatccagagcaatgtgagcatcgccacagatatgcaaaatccatttaaaggatttcatcatatatttgcctcaacctcttgaaatataactttaatgatacacactaaaactacttaatgcaatgaaattgacttcgttgaattttataacaggacataattttgactttcaatgaaaaaataaacaagataatatccttgcaaactttgtctaaacaataagtcagaattggggagtaattctataataaaataaaacacaattacattctgttttatttgtgatttcttctattagacatctgaacatttctttcacccataattttggattctctaaagtaatagaagaagggccaaaccaagctgcaggaaatggttacataaatatacttaatgatccttgccgaatatatagtacctaatattataggacagtatttctggggcatgtatccatcgttaccaaggataaataaagccttttcaaaattgtattctatatgggttaatgtctgcaaaggttaaaaacatcaaattctggaatatcatgacctgatattagtgacccagtaataggttgacatttgcaattctttgttgggggtaatagcccaccatatgcaaagatcaccttctgcatttagctgcttatttcaaaggaaaacatatgagtgataatagtgcaagggaggttaataacaggtacaggcctagcatagcttttatcagttcatttagaaaatgaactgagaattgctgtcaacttgattgggaagaggaaagaaagaacggacccatatgggaggcatcagtcagcttccagtgtgtgtgtgaaggttgtttgcaaggttacttgggctgatacaacataaagctggaatttgcatgtcaaattttgttccttttgtaacatactgtcacacaaatcactggccctggggtttaaatttcacagatgtctaaactcatttaaaaattaaactgcaataatttgtgatccacagtgcacctaatctttctgattttctcagaatggtttgttttgccattatactttcttcttaccatctaaaattctaattcttcatagactatctcagtttttccttcaaaagctaatgtattctttgacgagactattattctttgaggccattgtattattattacagttaaaagattcaaaaaacacaatatttactcatagttggaatcacaaacaaaaataattcaggattaaggtgaccattacattttcctgggcttctggaaaagtaaaaatgtgattcatgagtgctagctttattaccttcttatttattacattgttattatttcaactacctagcaattttcagaacactttgcaaggaacatttacactatgttttgctctatgaattatttcatcagaattaagagccttttattactatacaatatcctaagatgcaatgatccaatagatgtataatgacctgctatagattttattaacattgccaaacattaatatctttcctcagtggaattgaaagcattgcatgataaaattttagtataaattttacaggaaagaatttcaaatgatgatgcaagtagaattttactcatccagaggaggtatatattagtcatgttactttagtacactggaaatatgaaaagtaaacattacttttagtctctctctctttttttttctttactttatatttacaggaaatgctaaagcaacattctgttgcttacaacattcacataggttccaattatgcctggttaattcaatgatacaaattttgccttatttcttaccattattattattattaagtaatataacattgaaatagtttcacaattctgtttcatattttcttcaagattgtagggaattgacacccaccatgggtctgggaacatgtaacaccttgagcgtttttgagaagcagagaagaagggaaagtctaagattgtgctgaggtttctgggggaaaatccatacattttcaagtatgttacaggccatattcttcgttttatgtacattctaaggtaacaacaattcagttagaattatttaaaagaaaggcacttgcatttattgcataattacagcaatgagtatgttcaaggatggtcaacaattaggatagcttgtaattagtggaaggtaatattatacatcacttattattttacccaagtgcagaaaacatctcaagttcaagagtatatgtaaattgatgatgcatttcctcctctgctgctaataaaaagatcaatagaataagaatatattaaaatttaatactaagcatttttttactttgttttttatcgttgctgttggcccctgtaaaattaaatggttgacagtttttacattcaaaatctgaagttgttaaaaattttgatcacaaaaatggcactgcagacaacttgtttctacttctctagtagaaacaagttctacattaatatgtgaaaaagtgttaattcaatcaatatgtagtccatgaacatctgttaggcatagaaatatgatgggcagtaaggtctaactcctggcttgatggtatttagatactagaaaaatatagtcatatatacttaatttactatggtctctatattctatttgattaaaactaattatatagtaaacaagtagatcctcaataaacaataatgaaaagtttttatttaagaatctggaattttaggctattactctctggagttaaccaaagatcctagcactctcaagaaagattgagaaatgcaaatattagttttaatttttaaactataaaaatatatacatatacaaatattacttaacattagtataaagaaagtttgccttttggtaaacaaagtgtggtctacatatttaaaattttaatgtttttattaaacctttttagatattcaaactacttttgtttgcagacacatttaaagcagtaattgccaacttaaagaccgtaaccactttgataataaatctatatatgcagcaagaagtgcttccaatctgaatttaaaatataccttacactcatatatgaatattttccttgtggattgagacatagttgtgactaacaaaataaattaaaaatattacttgattcttacagagaatacaaatgccacaaagttagcatcaatatttaaaaagtctaaaagacaacttctataatttgggatgggcaatgtaccttttatgattattttcacattcccacttatttattttttcttttgttgttcatgcttttggtgtcaagaatccattgcctgatcatgaagatttaccctgtgatttctttcaatagttttatacttttagaccttcatttaggctatggtgcattttgagttaaattttgtgttgggtgtgaggaaggggttcaactttattctttagaatatgtttttccagttatcccaccactatttgttagagatcactcctccccccgttgacttgtcttgatactcttgtcaaaaatcaattagtcatggatgcttgggtttatttctggactctcaattctattccattggtctatatgtctatccttctgctagtactacatttgactactgaaactttctaataagttttgaaattgggaaatttgagtcttaaatcatttttttttctttcagtgttgtcttaactattaagggccccttgtgattccacatgaatttgaaaatcagatttcccatttctgcaagaagggccattgggattttgattgagttgcactgaatcttctgattactttggaaagttttgttctattaacaataataagtattttgattaccaatacaggctatatttccatttatttgggccttctttaatttctttcagtaatgttttgtaattcttagtgtgcataccttgcacttcctcatcttacttcttcctatgtattgtttccgctttggatgctatcataaatggaattttcttaatttctgtgtttgattgttcattgccattgtatataaacacaattaagttttttatattcatcttgtgcactgaaaaattactggatttgttaaatattgtttaatatagaaaatcatgtcatctgcaatagagatagtttttacttcttttctaatatgtctgttatttctttttcttattttattactcctgataagactttaagtacaatgttaaatagtgtgatgaatctctgtcttttgtcttgttcctgaccctaaaagcaaagctttcagtccttcaccattgagtaggctgggtatttttttattattattattatgaaagggtattgaattttatcttattgctttatttgtatctgctgagatggtcatgagttttccttggttctaaaaatacattgtgttacattgattacttttcttacattgaaataagcttgcatttctagaataaattccactttgctatggtatataatttattcagtatgcttatttggttttcaagtattttgttgagcatttttgcatctacattcataagaaatatttttctgtagttttcttatggtatctgattttgatatcggtcgaattctggcttcatagaacgtgttgagaagtatttcctctattttatttttatttttggcagaagtttgggtagaatttgtgttaattctttaaatatttgatagaattcaccagagaagtttatctaattgtggccttcttgttgatggtaggtttttgattattcagtttttctactgatatttctcttgagataatttttttctacatttgataatgtgtatttctagaaaattttccaatttgtctagattatctaatttgttgtcatataattattctcttgcaattcttgtaattgctataatattcgtagttctatttctgattttagttgtttttgtcttctgtcttcttagtataaggatttatcaattttgctgatcttttcaaagaaacaactttggttttgtatgtagcctctatttttctactttatctttgatttatctcttctctaaactctattagttccttccttttgctggatttaggtttagtttgctttgctttttctagtttgctaaagcattaagttatgttgtcaatatcggatcctgtctttttaaatgtaggcatttatagctgtaagtttcccttcaagcactacttttgctatatcccataagtttcgttatgttgtttccatttttatttatctcaaatgatttatttgttctttgatcttattatgaactaaaaatttatttgctgaattcctaacttccagtacctcagagtatgactgtattagaagactgagtctttaaaggggcagttaaggtaaaattaaatcatatggttggtccctattttaatatgactagtattcttataagaaaatatgacggggtgcggggggcggttgcaagatggcctaataggaacagctccagtctatagctcccagtgtgagtgacacagaagacgggtaatttctgcatttccaactgaggtaccgggttcatctcactggggcttgtcggacagtgggggcaggacaatgggtgcagcccagcaagcctaagccaaagcagggcaaggcatcgcctcacccaggaagtgcgaggggtcagggaattccctttcccagtcaagggaggcggtgacagacagcacctggaaaattgggtcactcccacactaatactgcgcttttccaatggtcttagcaaatggcacactgggagataatatcccgtgcctggctcagagggtcccacgcccacggagcctcgctcattgctagtaaggcagtctgagatggaactacaaggcgtcagcaaggctggggtaggggagcctgccattgctgaggcttcagtaggtaaacagagcagccaggaagctcgaactgggtggagcccaccacagctcaaggaggcttgcctgcctctgtagactccacctctgggggcagggcatagcagaacaaaaggcaacagaaacctctgcagaagtaaatgtccctgtctgacagctttgaagagagtagtggttctcccagcacagagtttgagatctgagaacagacagactgcctcctcaagtgggtccctgaccaccgagtagcctaactgggaggtacaccccagtagggggagactgacacctcacacggctgggtacccctctgagacgaagcttgcagaggaaagatcaggcagcagcatttgctcttcagcaatattcgctgttctgccacctctgctgctgatacccaggcaaacagggtctggagtggacctccagcaaactccaacagacctgcagctgagggtcctgactgttagaaggaaaactaaccaacagaaaggacatccacaccaaaaccccatctgtacatcaacatcagcaacgaccaaaggtagataaaaccgcaaagatggggagaaaacagagcagaaaagctgaaaattctaaaaatcagaccacctcttctcctccaaaggaatgcagctccttgccagcaatgtaacaaagctgtatggagaatgactttgacaggttgagagaagaaggcttcagacgatcaaacttctctgagctaaaggaggaagttcaatcccaacacaaagaagctaaaaaccttgaaaaaagattagacaaatggctaaccagaataacgagtgcagagaagtccttaaatgacctgatggagctgaaaaccatggcacgagaactatgtgacgaatgcacaagcttcagtagccgattcgatcaactggaagaaagggtatcagtaattgaagatcaaatgaatgaaatgaagtgagaagagaagtttagagaaaaaagagtaaaaagaaatgaacaaagcctccaagaaatatgggactatgtgaaaagaccaaatctacatctgattggtgtccctgaaagtgacggggagaatggaaccaagttggaaaacactctgcaggatattattcaggagaacttccccaacctagcaaggcaggccaacattcaaattcaggaaatacggagaacgccacaaagatactccttgagaagagcaactccaagacacataattgtcagattcaccaaagttgaaatgaaggaaaaaatgttaagggcagcaagagagaaaggtcggattacccacaaagggaacctcaacagactaacagcggatcttttggcagaaaatctacaagccagaagagaaggggggccaatattcaacattcttaaagaattttcaacccagaatttcatatccagccaaactaagcttcataagtgaaggagaaataaaatgctttacagacaagcaaatgctgagagattttgtcaccaccaggcctgccctacaagagttcaggaaggaaacactaaacatggaaaggaacaaaagataccggccactgcaataacatgccaaattgtaaagaccatcgatgctaggaaaaaactacatcaactagtgagcaaaataaccagctaacatcataatgacaggatcaaattcacacataacaatattaacctcaaatgtaaatgggctaaatgctccaattaaaagacacagactggctaattggataaaagagtcaagacccatcagtgtgctgtattcaggagacccatctcacatgcagagacacacataggctcaaaataaagggatggaggaagatctaccaagcaaatggaaaaccaaaatgcagtggttgcaatcctggtctctgataaaacagactttaaaccaataaaggtcaaaagagacaatgaaggccattacataatggtaaagggatcaattcaataagaagagctaaatatcctaaatatatatgcacccaatacaggagtaaccagattcataaagcaagtccttagagacctacaaagagacttagactcccacacaataataatgtgagactttaacaccccactgtcaacatgagacagatcaacaagacagaaagttaacaaagatatccaggaattaaactcagctctgcaccaaggggacctaatagacatcttcagaactctccaccccaaatcaacagaatatacgttcttctcagcaccacatcacacttattccaaaattgaccacatagttggaagtaaagcactcctcagcaaatgtaaaagaacagaaattataacaaactgtctctcagaccacagtgcaatcagactagaactcaggattaagaaactccctcaaaaccgctcaactacatggaaactgaacaacctgctcctgaatgactactgggtacataacaaaatgaaggcagaaataaagatgttctttgaaaccaatgagaacaaagacacaacataccagaatctgtgggacacatttaaagcagtgtgtagagggaaatttttagcactaaatgcccacaagagaaagcaggagagatctaaaattgacaccctaacatcacattaaaagaactagagaagcaagagcaaacacattcaaaagctagcagaaggcaagaaataactaagatcagagcagaactgaaggagatagagacacaaaaaacccttcaaaaaatcaatgaatccaggatctggttttttgaaaagatcaacaaaattgatagaccgctagcaagactaataaagaagaaaagaagaatcaaatagacacaataaaaaatgataaaggggatatcaccactgatcccacagaaatacaaactaccatcagagaatactatgaaacacctctatgcaaataaactagaaaatctagaagaaatggacaaattcttggacacatacacccttccaagactaaaccaggaagaagttgaatccctgaatagaccaataacaggctctgaaattgagtcaataattaatagcctaccaaccaaaaaaaagtccaggaccagacggattcagagccgagttctactagaggtacaaggaggagctggttccattccttctgaaactattccaatcattagaaaaagagggaatcttccctaactcattttatgaggccagcatcatcctgataccaaagcctgacagaggcataacaaaaaaaagagaattttagaccgatatccctgatgaacatcaatgcaaaaatcctcaataaaatgctgacaaaccaaatccagcagcacgtcaaaaagcttatccaccatgatcaagtgggcttcatccctgggatgcaaggctggttcaacatacacaaatcaataaacataaaccagcatataaacagaaccaaagacaaaaaacacatgattatctcaatagatgcagaaaacgcctctgacaaaattcaacagcccttcatgctaaaaactctgaacaaattaggtgttgatgagaagtatctcaaaataataagagctatttatgacaaactcacaatcaatatcatactgaatgggcaaaaactggaagcattccctttgaaacccggcacaagacagggatgccctctctcaccacgcctattcaacgtagtgttggaagttctggccagggtaatcaggcaggagaaataaataaagggtattcaattaggaaaagaggaagtcaaattgtccctgtttgcagatgacatgattgtatatctagataaccccatcgtctcagcccaaaatctctttacactgataagcaacttcagcaaagtctcaggatacaaaatcaatgtgcaaaaatcacaagcattcttatacactaataacagacaaacagagccaaatcatgagtgaactcccattcacaattgcttcaaagagaataaaatacctaggaatccaacttacaagggacgtgaaggacctattcaaggaggactacaaaccactgttcaatgaaataaaagaagacacaaagaaatggaagaacattccatgctcatggataggaagaatcaataacatgaaaatggccatactgcccaaggtaatttatagattcaatgccatccccatcaagctaccaatgactgtcttcacagaattggaaaaaactactttaaagttcatatggaaccaaaaaagagcccacattgccaactcaatcctaagccaaaagaacaaagctggaggcatcacactacctgacttcaaactatactacaatgctacagtaaccaaaacagcatggtagtggtaccacaacagagatatagaccaatggaacagaacagagccctcagaaataataccacacatctacaaccatctgatctttgtcaaacctgacaaaaacaagcaatggggaaaggattccctatttaataaatggtgctgggaaaactggctagccatatgtggaaagctgaaactggttcccttccttacaccttatacaaaaattaattcaagatggattaaagacttaaatgttagacctaaaaccataaaaaccctagaagaaaacctaggcaacaccattcaggacataggcatgggcaaggacttcatgttgaaacactaaaagcaatggcaacaaaagctaaaattgacaaatgggatctaattaaactaaagagcttctgcacagcaaaaaaaaacctaccatcagagtgaacaggcaacctacagaatgggagaaaatttttgctatctactcatctgacaaagggctaatatccagaatctacaaagaactcaaagaaatttacaagaaaaaagcaaccccaacaagtgggcgaaggatatgaagagacacttctcaaaagaagacctttatgcagccaacagacacgtgaaaaaatgctcatcatcactggccatcagagaaatgcaaatcaaaaccacaatgagataccatctcacaccagttagaatggtgatcattaaaaagtcaggaaacagcaggtgctggagaagatgtggagaaataggaacacttttacactgttggtgggattgtaaactagttcaaccattgtggaagacagtgtggcgactcctcaaggatctagaactagaaataccatttgacccagccatcccattacgggtatatacccaaaggattacaaatcatgctgctataaagacacatgcccatgtatgtttatttcggcactattcacaatagcaaagacttggaaccaacccaaatgtccatcaatgatagactggattaagaaaatgtggcacatatacaccatggaatactatacagccatcaaaaagaatgagttcatatcctttgtagggacatggatgaagctggataccattattctcagcaaactatctcaaggacaaaaaaccaaataccgcatgttctcacttataggtgggaattgaacaatgagaacacttggacacaggaaggggaacatcacacactggggcctgttgtggggttgggggaggggggagggatagcagtaggagagatacctaatgtaaatgatgagttaatgggtgcagcacaccaacatggcacatgtatacatatgtaacaaacctgcacattgtgcacatgtaccctagaacttaaaatacaattaaaatatcactagtaaaaaagaaaaaaatatggcatgaaaatacacggaagaaaaaccatgtgtaggtacaagatggccatatgcaagccaacgctagaggccctcagaagaaaccaaccatgttgtcacctttatcttggacttgtagcctccagatctacagagaagataattttttgttgcttaatccaccaagtctatagtaattttttatggcagcctaacaaactaatggagactcattaactgtttaagtgtgttttcttaattttcatatgtttttgacttttctagttttttacagttttgcttcagtccatagtgttcagagaatgtactttgtatagtttctgtctttaaacatatcttgaaagttgttttatggataaacatatggtctattccagagaatgttccttgtacactggagaataatgttcattttgtggttgttctgtggcgtgttctttaagtgtctgtaaggtctactttgcttacaaggtttttcaagccttctattgtcttaatgctctttgttctattcattagtaaaagtagggtttgaagtctccaattattattgtagaattgtgtatttttttctttaattatgtcaaagtgtgcctcatacatattgaagctcttttatttgctgcatatatatttctaattgttttatcttgatgaatcagtagcttaaatatatcatctcagggtcctacagctttcagagttcctggtaagacactggctgtcaattatattgaaaggtccttacacatgacaagttgcttttcttgctgctttctaggttttctttttgtatttggctttggaaagtttggttataatgtgtctcagtgtaagatcctgcttgtagcttgttgagcttctttgatgtgttggttcatgtcttccatcaaatttggaaacttgttagcctgtatttctttaagtatttttttcagctcctttttctcttcttcagggagtcccataatacatacactggtatgcttgatggtgtcccatacatctcgtgggctctgttcattttccttcattcttttttattttcacactggacaattccagttgtccagtctatcttcaatagcagattcttccttacatctgctaaaatctccaggaatttttttatctatcgcacttttcagctctattatatctatttaaatctctcttcataatttctatttaaatccctatctgtttgttgatattttctctttaattcatgtttctgttgattttctttagtttctttctatgattttcttcatatatttgatcatatttaaggcaattaactgaaattgtttttctaatatgaccaatgtctggacatcctcagagatgtttcctcttgatttcttttatttttgtgaatgaatgtttctctctctgttttatagtatttttgttagaatttgaacattttggattttgtaatgtggtaactctggaattcagattctctctttcctagggattgttgatactgcctgctgagggctgtagttatcatttgttcagttacttgtccaaactgttttcataaggactgtattcattgtcatatgtggtcacggaaatctcttctattgtgactatagtcagctaatgaagtgacttgacagaaaattcctaaaataccagcctctatcttaatcaggcactcccctggacaataccagtgtttgactttacttcagagtttctcagtagttgattctgacagtcttgccaccagaatagatgttttggggagggagtgattattgatgcttcctaccatgccatcttctgtgataccattctgccaaaacacttttgttatcaaaaagtgatggtcgttttaaaaaatagtatataacacacttagattattattttagttctttatgcttacctaaaatttggcccttgataacagtttcccaagaccatcaactggtttcataaagtcccctccaaatgtatcaagaggttatttagaggaaatttctctaccacccaggcatgtgatacatcgttgaaccattactaccaactttaccatttttctgtataggtttgtagaaaaacttgtagatgtcatctgtgaatactgaaagtgatctccatgttttcttgcttttaattcttccatttatgtcaacaggagaataataaattaccaaaaaaaaaaaagccctaataagagtaggagtattcaaggaagtaattggaagctatctggcctaaattaatatataaataccaaaatgaatgaaagactggtaattacattggaagactccttggtaggtgtaaaatttaatggcattaattttagaatgtatttatccatctgcctctaccttccaccccagtcccaacccccacccctgccaacagcccttgcttaagtatttctttctataataatgataattccattaaaaaggagaaagagaatatagaatttaataaacactgtatatcaaagatttaatttattttctcaataacgtgaattaaggcttatgaatgacttatgttaaatatcatgaattatttaataacatttaataacttttaaaataacatatacattaaggccacatgaattctgtgaaaacattttatttctttaccatatatactgcaatatgtttatgaataataattctaatattagttaataataactatgtatcaggaactatgttaattgccttttatggattatctcaaataataatcatagtaaatctatgaggatgagtacgcttcaccactaacttttctcaatatgaatgtcatccacttaataatgaagtagatatgctgatatcaaagtatcatcctcctttttccatagtactaatattttaaacaccagtgaaattcactcttctctatatatttttatatttttattttatatacatttttcaaaagctcataatctgcctaaaaattccctgaagtatttttcaaagagacctaacaaatatccattctaaagaaaattcttttaaattttgttataccaaaccttatattccttttaaattgttgagggaaaactctagctggaacaggaagattggttttaaaaaatatacactatgcacacatccagtttatgatactgaaccacactaaatacttattcaactggcaattatgggatttgtgtctgatagtactataaaataaaaactgttatacaattttaaggtaatgttcttaattttgaattgctttatatatgtgggactttcaacaaaatcaaatctacagatacgtagttggtaattgattatgcaacatacttttggctattgctgtaaaaatttaagcaatagacacttagtgaggaatctaatcctatatcatctaaattgtatgaggaagtggatttgacttatatttttatttatttatttaatttccataggttattgaggaacaggttgtgtttggttacatcagtaagttctttagtggtgatttttgagattttggcgcacccgtcacccaaacactatgcactgcaccctatttgtagtctttttttcctcacccccttctgaccctttccccaagtccccaaagtccactgtgtcattcttatgtcattgcatcttcatagcttagctcccacttatgagggagaacataggatgtttggttttccattcctgagttacttcacttagaatgagtctccaatctcatccaggtagctgtgcatgccattaactcattcctttttatggctgagtagtattccattgcatatatacatgagaggtgacagcgtgctggcagtcctcacagctctcgctcgctctcggcgcctcctctgtctgggctcccactttggcggcacttgaggagcccttcagcccgctgctgcactgtgagagcccctttttgggttggccagggctggagctggctcccttagcttgcggggaggtgtggagggagaggcgctggcggaaaccggggctgcgcacagtgcttgtgggccagcgtgagttctgggtgggcctgggctcggcaggccccactcttggaagggcctgccagccccgctggccccaggtagtgaggggtttagcacctgggccagcagctgctgtgctcaatttctcgccgggccttagctgcctttccgctaggcagggcttgggacctgcagcccgccatgcctgagcctccccactgctccgtgggctcctgtgcggccggagcctccccgaggagcgccaccccctgctccactgtgcccagtcccatcgaccacccaagggctgaggagtgcgggcgcatggcacgggactgacaggcagctccacctgccgccctgtgcaggatccactgggtgaagccagctgggctcctgagtctggaggggacttggagaacctttatgtctagctaagggattgtaagtacaccgatcggcactctgtatctagctcaagatttgtaaacacaccaatcagcaccctgtgtctagctcagggtttgtgaatgcaccaatcgacactgtatctagctaatctagtggggacatggagaacctctgtgtctagctcagggattgtaaacgcaccaatcagcaccctgtcaaaacagaccactctggctctctgtaaaatggaccaatcagcaggatgtgggtggggccaaataagagactaaaagcaggctgctggagccagcagtggcaacccgctagggtccccttccacaatgtcgaagctttgttcttttgctgtttgcaataaatcttgctgctactccctctttgggtccacactgcctttatgagctgtaacactcaccctgaaggtctgtagcttcactcctgaagccagcgagaccacaaacccaccgggaggaacgaacaactccagacgcactgccttaagagctgtaacactcaccacgaaggtctgcagcttcactcttgagccagtgagaccacaaccccaccaggaggaagaaactctgaacacatccaaacatcagaaagaacaaactccggacacgctgcctttaagaactgtaacactcaccacaagggtccgcggcttcattcttgaagtcagtgagaccaagaacccaccaattccggacacatatataccatagtttctttatccacttgttgattgatgggcatttgggttggttccacatttttgcaattgcaaattgtgctgctgtaaacatgcatatgcaagtatctttttcatataatgacttcttttcctctaagtagatacccagtagtgggattgctggatcaaatggtagctctacttttagttctttaaggaatctccacactgcttcccatagcaattgtactagtgtacattcccaccagcagtgtagaagtgttccctgttcacctcatccatgccaccatctattattcttttgattacagccattgttgctggagtaaggtggtattgtgttgtggttttgatttgcatttccctgatcattagtaatgttgcgcattttttcttacatttgttggccatttgtgtatcatcttttgagaattgtctattcatgtccttagcccactttttgatgggatttttttttcttgttgatttgagttcattgtagattctagatactagtcctttgtcagatgtatagattgtgaaggtttttttcccactctgtgggttgtctgtttactcggctatttcttttgccgcgcaaaagctctttagtttaattaagtctcagcagtttatctttgtttttgttgcatttgcttttgggttcttggtcatgaaaacttcgcctaagccagtgtctagaagtttttccaatgttatattctagaatttttatagtttcaggtcttatatttaagtgcttaatctatcttgagttgatttttgtatgagttgagagatgagaatccagtttcattctcctacatgtggctagccaattatcccagcaccatttgttgaaaagagtgtcctttccccactttatatttttcttttctttgttgaagatcagttggctgtaaatgtttgggtttatttcttggtggtctgttctgtttcactggtctatgtgtctatttttataccagtaccatgctgttttggtgactatggctttatagtatagtttgaaattaggtaatggtgatgcctccagattagttatttttgtttagttttgctttggctatgtgggcttttcttcagttccatatgaattttagaatttttttttctaattcttgaagaatgttggtggtattttgatgggaattatgttgaatttgtagattgctttggcagtatggtcattttcacaatattgactctacccatccatgagcataggatgtgtttccatttgtttgtgtcatctgtgatttctttcagcagtgttttgaagttttccttgtagaggtctttcacctctttggttaggtatactcctaaggttggttggttggtttctttttttttttttttttttttttttttggcagctattgtaaaaggttgagttcttgatttgattctaagcttggtcgctgtcagtgtgtaagaaaagatacttgtttgtgtgcattaattttgtatccagagactttgctgaattattttatcagttctaggagctttctggaggagtctttagggttttctaggtaaacgatcatattgtcagcaaacagcgacactttgacttcctcattaccaatttggatgcgctgtatttctttctcttgtctgctctggctaggacttccagtactatgttgaagaggagtggtgagagtgggcatccttgtcttgttccagttatcagagggaatggtttcaactttttcccattcaatattatgttggctctgggtttgtcatggatggcttttattatattgagctatgtcccttgtatgcagattttgctgaaagtcttaatcataaagcaataatggattttgtcaaaatctttttctgagtctattgagatgatcatatgtttttttgtttttaattctgtttatgtggtatatcacatttattgacttgtgtgtgttaaaccattcttgcatccctggtatgaaacctacttgatcatgttggattgtctttctgatatgttgttgaatttggttacctagtattttgttaaggattttagcatctgtgttcatcagggatatcagtctgtagttttcttttttggttatgtcctttcctggttttggtattagtgtgatactggcttcatagaatgatttggggaggggtccctctttctttatcttgtggaatactgtcaataggagtggtaccaattcttctttgaatgtctggtagaattcaactgtgaatccgtctggtcctggagttttttgttgttgttgttgataatttttaaattaccatttcaatctctctgcttgttattggtctgttcagggtatctaattcttcctgatttaagctaggagggttgtatctttccaggaatttatccatctcttctaggttttctagtttatgcatgtaaatgtgttcatagtagccttgagtgatcttctgtatttctgtggtgtcagttgtaatatctcccatttcatttcttattgagctgttttggattttctctctttttctttcttggttaatcttgttaatggcctatcagttttatttacctgttcaaagaaccagctatttcgtttcatttatctgttttgttgctttcaatttcacttaattctgctctaatcttggttatttcctttcttctgctgtgtttgggtttggtttgttcttgtttctctagttccttgaggtgtgaccttagattatctgtttgtgctgtttctttcttttttttttttcttttttttttttttttttccgagatggagtttcgctgttgttgcccaggctgtagtgcaatggcatgatcttggctcactacaacctctgcctcccggttcaagcgattctcctgcctcagcctcccgagtagctggtattacaggtgcttgccatcatgcctggctaaatttttgtatttttagtagagatgaggtttcaccatgttggccaggctggtctcaaactcctgtcctcaggtgatatacctgccttggcttcccaaaatgctgacattacaggtgtgagccaccatgcccggcccaaacttttcgatgtaggcacttagggctatgaactttcctcttagcaccacctttgctgtgtcccagaggttttgataggttgcatcactattgtcattcagttcgaaaagtttttaaatttctatcctgatttcatttttgacccaatgatcattcaggaacaggctatttaatttctatgtatttgcatggttttgaaggtttcttttggagttgatttccagtttttttccactgtagtctgtgagagtgcttgatataatttcaattttttaaaatttattgaggctcattttgtgtcctatcgtaggtctatcttgaagaaagtgccatgtggtccatttgttccagggcatagtttaaatccattgtttctttgttgactttctgtcttgatgacctgtctagtgctgtcagtggagtattgaagtcccccactattattatgttgctgcctatttcatttcttagatctattagtaattgttttataatcttgggagctccagtattaggtgcatatatgtttagaattgtgacagttttctgttggacaaggccttttatcattatataatgtccctctttgtctcttttaactcctgttgctttaaagcctgttttgtctgacataagaatagctactcctgctcatttttggtgtccatttgcctgaaatgtctttttctaccccctttaccttaagtttgtgtgagtccttatgcgttaggtaagtctcttgaacgcagcagatggctggtgaattcttactcgttctgcaattctgtatcttttaagtggagtgtttaggctgtttacattcaacactagtatgaaatgtgaggtaccattccattcatcatgctatttgttgcctgtgtaccttggttttttgttttttaagttgtatttttgttttatatgtcctgtgagattcatgctttagagagattctattttgatgtgcaaaatagaacaagacctactgtctgtaggtctctcagccatgtataccagcacctgttctggtggcagaggtagaggggagaaatgaactctgtgaggattcttagctttggtggtttaatgcactatttttgtgctggttagcctcccgccaggaggtggcattttccagagagcatcagctgtggtagtatggggaggaacaacgttgggtggggcccttaaactcccaagagtcttcagttactagggtgggtagggaagggccactgggtgggggtagagctaagcatgtctgagctcagactgtccttgggcaggtcttgctgctgctgctgtgggggatgggggtgagattcccaggtcaatggagttatgttcctagtgagaggtaacagcatgctggcagccctcagagccctcgcttgctctcagcaccacccctgcctgggctcccactttggtggcatttgaggagcccttcagccccctactgcactgtgggagcccctttctgggctggccaaggctggagcccactccctcagcttgcagggaggtatggagggagaggcgcgagcgggaaccggggctgcgtgcggcgcttgcgggccagctggagttccgtgtgggcgtgggcttggtgggccccgcacttggagcagccagccagccctgctggccccgggcaatgagggacttagcacccaggccagtggctgcggagggtgtattgggtcccccagcagtgccggcccactggcgctgtgctcgatttctcgccgggccttagctgccttcccgcagggcagggctcgggacctgcagcccgccatgcctgagcctcccaccccctccatgggctcctgtgtggcccgagcctccccgacgagcaccaccccctgctccatggcacccagtcccattgaccacccaagggctgaggaatgcaagcgcatggcgcaggactggcaggcagctccacctgcagcccctgtgcgggatccactaggtgaagccagctgggctcctgagtctggtggggatgtggagagtctttatatgtagctcagggattgtaaacacaccaatcagcaccctgtgtttagctcaaggtttgtgagtgcaccaatcgacactctgtacctagctgctctggtgaggacgtggagaacctttatatctagctcagggattgtaaatataccaatcggcactctgtatctagctcaaggtttgtaaacacaccaatcagcaccctgtgtttagctcaaggtttgtgagtgcaccaatcgacactctgtatccagctgctctggtgaggacgtggagaacctttatgtctagctcaaggattgtaaatacaccaatcggcactctgtatctagctcaaggtttgtaaacacaccaatcagcaccctgtgtttagctcaaggtttgtgaatgcaccaatcgacactctgtatctagctgctctggtggggccttggagaacctgtgtgtcgaaactctgtatctaactaatctgatggggacttggagaagctttgtatctagctcagggattgtaaacgcaccaatcagcgccctgacaaaacaggcctctcggctctaccaatcagcaggatgtgggtggggccagataagagaataaaagcaggctgcccgagccagcattggcaacccgctcgggtccccttccacactgtggaagctttgttcttttgctcttgctactgctcactctttgggtccacgctgcttttatgagctgtaacactcaccgcgaagatctgcagcttcactcctgagcccagcgagaacacgagcccactgggaggaacgaacaactccagatgtgccaccttaagagctgtaacactcaccacgagggtccgcggcttcattcttgaagtcagtgagaccaagaacccaccaattccggacacactaggaggatcatgactgtctccactgtgttatgcaggttgtcagggaagtggggaaaagccagcactcacaggcctcacccagctcccacacaatccgaagggccagtctcactcctgccgtgccccctcgcccacagcacccagtctgtttccaggcagtgggggagcagggctgagaacttgtcctaggctccccgcctcccagctgcgaaagtaaatacggctttcctccttcccctgactgtggattctgcacgccagattcatgccctcccccaagttctgttcaggaggcttctcaatcagttcaaattgttacaaaattcaaccggaggtttccttctccctgtggacttttcccagtgcctctggccaccttctagaaggacccctgtgaggccaggcaaaaacagcttgctaggggactcagcaagcccgcagggattttcccgctgcttcctctacccctgtgtttggcttggctctctaaattaactcagctcgaggtacagtaaaaatcttctcccataatctgggccttcagttttccccctgggggtgtgtgttcaggagaggacaatctccctttcccgcttccacagtttgggtactcacagtatttggggtatctcctgggtcctgcaggagcaatctgcttcctttagggggtgtgtgggtcgtctcaggtttcctgatttattcctgtagtcattctggagcaaaaattcctgatgcaagcctccacacgctgctctgtctgtcccagtgagagctgtaatctcgtcctgcctctcgtccgccatgatctgcggatgagatcattatttttatttacagcatttttccataaatgcaaatcataattaaggtgaaacaatccttttactttggacacttgctgatgaaaacaaattttagcaataatttttttgaatagaaatacaaataagccgtgaatctgaaattggaaatctcttaattagatccatagttagagaaaattttataaaattttggttttcagtgtgttaaaataacttatggaattgtaaagagtgcctttaagggaaatggaaataaaagtttgaaatacgtgatgtatgtcactccaactcttaaaaggcctcacagccttttttttcttttgtcccacaacttacaacaaagatctttatggatattgatttttaaagacatagttcagaaattcgaagcaaacttccacatgataaaccatatgtcaacttaatcaatttttggaataatgaaagtctcttgacggcagctgctttacttaggagaaagcctttggtggttcattatctattcaaagaaaggtgaaacactagggtcgttatccagacctccaaaagagaagtgactatgaataatgactgtaattaacattcagatttataaatgccactttccaatactaacaactacttgtaaatgaaaatactgaaatttctgagaatgatcatactagtaacatatttctgtcattacaaaaaaattatgtagatagtgtaaaaaaccaatgacataattcagttaaaatttataggaagatttatcttttttcagatgatctttaactataattattcctgaagccccccaaaaagtaaaaggattactattctagtttaaaaattcttgtaaccatgtgttgtcatcctatgtatctaaaattgtgtacatttaacttactaagaagtcatcagtaatgatttctttgagttttattgtagaaagtggttttttaaatctaaatattttatacatagtaaaagcttctacgttgttagtgtatgattatattgtatcatttttacaatatgcaaattatattgctgtcagcctgaggcttgtgaaaaaggaggtttgtgaggatgttctgtaaggagtgttccttccttactttgctcaccccaaaaccattgttactgttttttaaatcaaactctttctgaaaataattgattaatctctccataaggaatgaaactatattccttttagttagaaaccacataaagttgaaactccttattctcttccgaacacaggttttctagaagcacactttccatttgcagactatagaacaatggatattgtctcggaatgttgtcgtgagggtaaacacatacacagggaagcttggttcctaaagacctacattgcaaaacacactgcaccaatttctctgattttctttccaaaactctctttagagagtttgggttctctccaattccacctttttaatactaaagcagtggttctcaaactttagctacagtagaatcacctggagagtgtgttaaagcatagattttaggctccatcatcagtatttggttctgtaggcctagagtggaccccaaatttgcatttctaacaaattccaatgacactgatgttgctatttcaggcactatgctaacctaacacatgagtctgatcattcaactcaaatatctttatggatcagtcaagagaagttaattcaaaaagccttggaaaataaaatcaataggcagtggtgagaattagataaatagaatgtgctggactaatttaaaggctttctgtctcacatcttttaagacagtgtaatgaggaaatgaaacatgtccaaattcagccttttcattatacttgaggtacctatcttaagcaatattgtgtaagcttttcttctatctctagtttgaatttatattgagttagtctaacagccaacaacttatcttccttaggaagtgatgtagggatgcaaaatgtgagtaactttactttcgctactgtcagataagattagctaattgaggcatcagcaaatgtaatgtggtcccaatatagatcctgttccttttcattgaaaactggtaaaaactggatttctggataatagaattgtcaatgaaatttcaacagcagtagtgacagaaagtttgctgttctcctattgaagtaacagagtagcctagtagcacatagtatgtaaaaaaggagaaagtacaataaagaacataacatcaatgaaataaaattatctgcaaatgaaacctctgttttgtctagaagaaatcttgagactaaaaatataggttcttttatagatatcaagttgggtatttattcctaacttataatgttttcaaagtggtagatcatataatggtcttccagacagaagtgaatagtgggctaacattcttgaagagatggaatctttggagactctattattggaaattggagaaagaactgtgccaagacatgaaagaagatttctaagggtctcattgaacttgtagatgatactgatgtgtagataagcactaaaaagttaaaaaatacagtagcaagaaaactatctgaaagttagagaacttaggttcttgcaaaataccgactcttcatttattagctttctgacatagtactttttgcttaacctgtccgtgattccatttatttacttctaaagtgagcataattccactgggttgttgtaaaaatcacttatcaaaatgatcacaggtcaggtgacagtggcttatacctgtaatcccagcacttcgggagaccaaggcttatggatcacataaggccagttgttcaagaccacctggacaacatgttcaaaccctgtctgtactaaaagaaaaagaaaaaaatcagtaaaagaaaaaatcagaaaaagaaaaaaagtagtgccagctactcgggaggctgaggcaggagaatcacttgaacccaggaggcagaggttgcagtgaaacgagatcgtgccactgcactccagcctgggcaacagagcaagactgtctcaaaaataaataaataaattaattaattaattaatatcgaccacagctctcaaacattttataaattatagaattatatgagtccaagattgtgtgatttgcattatttgtgtgactatagcttaaatgtattcatttattttaacttattcttaagccagttgaatatatataatgcagtagagaagtagatctaccatgtaatgtatatacatgagtttttgcccctggacaatatataatattctatactttagtcacccattccagatcttgcaagtgcaatgttgattctggttttttgcactttaattaatattatacttaacagtgatttttttttctctattatgttgtttgaggacaggcaagataatacccatagggaaaagaataaaggaccctgattgttgacattgattttttaaagtgattctatgcacgtgaattaaatgatatcagtacaataactacagtggaaattgtgaaattgaatagtgcccttggatataacccaaatgcaaacttcattttgttacagtagttagctttacaggaaagaatgtagcagaccgagaataaaaaaaattgctttttaaactgggtactgcatttatttttattctactttttgtattaattctctgtttgactattcctttatttagaaatgattaaatgtagtttatgagaaaagtctattaagcttatcatgatataataacatctgttgctattttgttgtataggaatagttagcaagtacattatcattctcagcattttatgataataagtttgggctaactgcaatttatgctgtgtaacatcacctggactaaaccctcttgttttaattcaaaacatcttgattccctggggagttatttgcagcagtttttcaaagacatcttccatctccttaagttctcaatctcgtttctttcaattttctctcttgcaataaaaccgtccctccttttattcttatgggaggatcaaaggagtgaagagaaggctgaacctttttactgtctctatactcattcttatactttttgttttcattttcaaaacctttatttctattatccaaaattactttatcacttctgatctagaattaatttttatcttcttcccttgtaactaactcctctattttctcttattctcctctaacattttcattgtttttttcccccctatggttcttttcttacggctttgaaatgtacaggtaccagaataggtcttgggagagggatgggatagaacaagtgagtttgaagttgcaggtaggggcaacagtggttgggctcaggttcaatgatccttgctctcaagagaggcaaaaagcactatgccagagtctccgtggtggtctaaagggtgcctgagttttgtacttgttagagaaattaagtttactataaccaaaaaggtttaatgtttagaagttaaaagcaagtgaagaatgtctcattctgaaatagaccaaactcaaaagcctaagaatgcagggtgggaatgagcagaagttaggattccaaacaggtcagtaattgaaaaaaaaaatggtggaaataatactaaaaatttaagacacatacatctctgtggccagagagaattgtgtcagggagacaggccctgagaggcaagcaacaaggaaggaatctaggaactgagctaggtcactggtgatgaaatgccagatggtggctatcaaggattcagtactgaccaagcagcattgcccaacacaaaccaaaagcagctgatcagcgaggatgtgaagccttaccaaggtcataatgcatagaaaatctgaaatcagaaagcaaatgatgaagaaataatactcatacagtgtttgatatattaatccatcattcattcaacaaatactcattgtccactttgtggcaggatttgggctgggtcctgggaccagaacagttagcaagagcaggttttccagcataagtttataagtgcataaactaggagggtaagcacataaataaataacttcacagcagtaggaaaaatgctattagaagactcaacatgctaaggtagcatctataactgatgtctgtctacgagcttctacatagattccattctattgtttactgttgaggtatagtggatacacatcaattaattaaatgtaacttctctggcctcattatggttggctgtatatggtgaactccatgtcttgtaggttttactcctgttctcaggtaatgggctctcaaaaaatgtaatgcaaggctttgatatgaccatttactttctttttttttttttcttttttagacagagtctctctctgtcccccaggctggagtgcagtggcaggatcttggctcactgcaagctccacctcctgggttcacatcattctcctgcctcagcctcccaagtagctgggactataggcgcctgccaccacgcccggctaattttttgtatttttagtagagatggggtttcatcatgttggcctggatggtctcgatctcctgaccttgtgatccgcctgcctcggcatcccaaagtgctgggattacaggtgtgagccactgcactccaccctcatttactttcaacttttattgtttcttggaacctcatttgggggaactaataaatagggatatcattttatggtaattctagttattgcttattgtgaagataatgagcccctatgaatacattatttgagtggctagtggaattatttcaaatgctttctcaaatatgtaagttaaatatttcaccttgtaatttttcaagctcattaacaatattcatttgaaatatgttcttcaaaaaattataagtttgtatgtaactttgtacaaatggaaaatttgtttctctcctcttaaattttggcatattttacccactgatattatgttgaaataaaattgattccaagatatggcttatgatttcaaaaatccatttcccatagcttagatctttgttaaaccatttagtgccccctaaaagtgatgtgaagtgtatacagccctaaccattagagtaaatagatgagatcgggtgcgttcagggtggtattgccatagacccattaaagtaaatagaaaaaactttttattttcaaagttgtttaagaataattatgctaattgatgtaattatcagaataacagtataattcattgctcatctcaactattcatactaagaatgtcctattgtcatcagaaacagtcatcaaatctgagttaagataaacactacaccaacacacatcaccgtcccttcaaaatatagaagatgaattcaagtctgaaaatgtgttcaaaagagagttgagaatcgttaaagttaacccatcatatatatccatgtaatctattatttaatttatttttaaaaggtatgtaaatatatatagactctgaggaaaaagtctcaaatacctaacctggcattaaaacatttcagtcaacaaaactgtgtgttatagtatacactgaaaaacaaaatatctgtaccccagcctctacccttttttttaaattggatcaactggttttttaaaaaatctttccttcacacagagttattatggaaatttcacggactgtaaaactagattaccaaaatttttaaactaactgaatttcaacttgaagaacatcatgaaaaaaaattccaaagcaaatctatcatattaaatgtatgtccacaatttttctgaggctgttttcatttaatatattactttttcttttctttaacaactagttactaagcacctattgtgttcaagaccctgtgacattttaattatgtttggtagaaaatctaaaaatctctaagtttgatcccaagcctttagactacaaagtccacgatttcttcccctgccatatacatatattgctttgcctatacagagtggctggagtaatgagattcagcgaaggattcaggggaatagcttttagggtggccagaggtaactaggatagtagattgcccaagaaaggcaaagtaaagaagaattctttaaaaggagggtactgtcagttatttcaaatgaagcagagagatgggaaagtacgtggactgagaagagcaaacgagctggacttatccattaagtccagctgtgacttttaagagattgtttcaattgagtagtgagattgggaagtagattgtaagatgctatagagtaaatgaacagtaagaaattaaatgaagggtgaatagaccaatgtttttgtgtgtgcaaaagtggaagtccattttttttaaaatgaaatcttgtgtgaattcctgaaacagataagaagttagatttttaatccctcctttccttacttgggtatcctggagatctcagactcaatgcctctgcaatataatttgcaaattaaaggtggaccttcttttgagatgtttaacaggctaagaaaggaaagaaatagtaaaaagaggagcactggggatgcacagtaactgctcaactggaaaagtaaggagagcttgagggatcttttgtgacacggaattgtctcaagagaaggcttcccattggaggcagcttaatgtagactcttaccctagccagatgtgtcctttttactgctcttaaagctaatcccacccagactctattctcaattcttgatctaagcttgaaagcatgcagtgaatggtggccccagagggccttacctaacttactctcaaaactttctgtccctgtcactacccccaccttcaacctatgtcatagttaccttggagcttgattgttcagagttcctggaactctttcattagcatttagttcatcagttactgtgcatctcctgtgctcctcattctatttcctttcttatcctgttaaacatctcaaaagaagggtccacctttagttggcaaattacgttgcataggcactgagtctaagacctccaggctacccaggtgaggaaaggagggattaaaaatcccacttcttgtctgtttcaggattttacataagatttcattagcgtctttaattaatttagagaagcataacataatacttctttttttcttctggacaaagattttatggtagagagcaagagccagagccaatgaaagattcacaggatattggaaacgtctgctacttaactacattttgaaatttaactttcattgtgcctcattttgaaatgtaacttttcaaaggaagttgaaattttgcacatttgctcagccattagattattcctgttgatatgaaaaggaaaatatacatttttgaaatatatttttcagtttaagaaatttgtggagtttgagaccagcttgaccatggtgaaaccccatctctactaaaatataaaaattagctgggcatggtagcaggcgtctgtaatcccagctactcgggaggctgaggcaggagattcgcttgaactcgggaggcagaggttgcagtgagccgagatcgtgccatggcactccagcctgggcaatagttggagactctgtctcaaaaacaaaaagaaaagaaagaaagaaatttgttctcctgtaaaaataagtattttttcaaggttattctcatatacttatattagcaatatattttttctttacattcctaaagttggctattcttatctgaaattaggcatttttggccttggccaaaggaatttcctccccctagggctcaaacttgtgtaaaacaaaagtcataaagaatgaaagctacttctctctcatctgccctgcaacaaacctctcctgaaaaatgaatgaggtaggtgctgggataaaggaagagaaaaagagaaaacaaaggaaggaaacacatacagaaaatctaaaataatatcctcaaattatattcatattacagatgtgactataaggcagtaagtggttaaattacttgcccccttttctcactatctaggcataaatacttccagcttttgttatgtccatgtttaatacacctaagtgtatgccttaactatgggtggggctacattttttattgtcagatggagagtgacagctgaggatttattttaacgattaagtctcttattgaattaaacatgctcatatagatcattttcaaggtaatcattatgtgttccaagaagtgtagtatggtggctaaaagtatggtttgtgggatcagaaaaaataactttgttcaatgccgtgattttctattactacttttgtaacctccggcaaaacgatatgatgtttcaaaccatattttccttatctgtacagtgaaaataataaaacccaactcatagggtttgtcagagttaaaaattaatttagggaatgtgcttgcactgtgccgcctggcagccaaaatattcaacaaatactactcttattataatcaagaaagaggaggtaaggccatacttagaagtgacattttgtttttgtttttatatatatgaacgatacatctcaaatgcactgcatcagttcttcaacatctacgagtttatattcattaaacacgtttctgcagaactcaaaatacataagaatgaccttgttcttaagaatgcattccagttggagaaacgaaatgtatgtctataataactaactagtaattcttgcacaatgtatgcaaaatggtacagagcatttctacaaatggagattgaagagccttgtttaaagagctcaataaggttttttgacagggcatggccgtttcatattcagttatcttttccagttccttgtgtagatagtgtattcaattccataaagatttgtgaaaaagagagactcgataggagcttctgatattgactttgggtagggttcttaagtttctctttaataatccttccatatcctcttctgggtttcttctttcttagcacaaagcaagttatggttcaattgactttctgtctgcttaataaatattgatatattggatacattcaagcatggccatgtgtgatccatctttaaaggtacagtcattatgcagggaggttgcaatttatttattcctcattcattctctcatcttttgagaggagtcattatgtaaatattgagcacattcataaaatgaaaaacaaaaacaacactagcacttttttaaaaaataaaagctgttgaaaataagatagcatctgcagcagaatgaagtgaatatagaccctattgtgcacattgtgttagtatattttctttagacaataggaaatggtaattgaaggtaaaatgtgcaatttctgattgtaagagctgtggtataccgcaatgattgaggaagcaaaatacacatagttccttcactagggatctggcacaggattaataactcagtcctgaaatatgtataattatatgatttctcaaggcttgtttcacacatctgactagaggtagacatgactacatatatagatgtaattaaacatattaaacatatggattattgtgttattataagactagcgaaatttgaatgtgtttactcatacacaaaattattgaacctagtatgtctgtcactattgattcagaccactggtttgattgagtttgttcattttgcttattggttgactaataattaagaaatataaacatcatttaaaatatttaatgacatttttattttttctactttattgaagtataattgaaaaatttgcctattttaaatacataaaacatgatttttaatttgtgcatacattgtaaaatgattaccacaatcaagctaatgaatatatccattatctcacatgtttatctttaaaaattttttatggtgagagcacttaaaatctattatctgagcaatttgcaagtgcacaatagaatattattacttatattcatcatgctgtacaacagatctccagagtgtatttaacctatttagctaaaacttggtgtcttttgtgcaacaattccacattctctccctgcaacctactactttttatcccctggcagtcttcttctctctcctttcatgagtctgactttttttagaatccacaggtaagaaagatcatgcattatttgcctgtctgaatctggtttattttgcttaccatgatgtcctccactttaatccatcctgtcactagtgataggattcccttcttttttaaggctgaataatattccattgtatgtgtatgtatgtttatgtatatatgtatttatatcacattttctttattcattcatttgttgatggacacaggttgattccttatcttggctattgtgaatatatttttaacacccctctaaataacaatctatcacatcttcatcttttatctatgtatttttaattttcacacatatgtttgaggctaattttctcctgttatattctaatagaaaatattcttgaaagcaaaattgctgaatgcttttgtattgactctttcatcatattactcaattctctgtttatttctttatatccaccaatactgcaacatagacatctacttttgccaaaagttaagtctacagtaacagctgtacctttctggaaaacagaaatgtggtttaattgttgcattgcatttcatttcatgctggctgaatttgatggcctccataaaactatttgtacacactcccgtgaaagtagaccagaaggaaactcaaacctatactttatctgcagactagccatatcatagaaagggataggccttcccaattgtttaataaagtttttattttctctcattttctattttaaaacttttaagatcctattttcagtcctccctactgcctttttctaggcatctaaataggtatacaaagcattgtaaaaactgtttaacttacactcggtaaacaaatagtaaccagattatagggtaaaaatattgaatggctatctgctcatccataaacatagcactgataataaaaatgtttttgaaagagacatctaactgagtaaatactcaactctggatggttattcaagttgaatgtatcatatcattattccacgaatattttctatgtcaatggcagctaattttcagccttcaaatgttaaagtagtctgaaattgaaaatagagagaaaaaataaaattgaaagattcacacaggaaagagccactttatatcttttatggaaaaacaagaaaaacaaaaagttataaattcataaatctattgaacatatacgggagtccatggaaaatattaattgaggtaatgttaaattataaaatgtccatatagcaattaaaaatgtgaaagaaggtcattattcaaactatttttcaagcagctagcatgtgcaggaactctcctggccactgagaaaagagcagtgaagatggctcctgccctttagggccatttcagaaggtgaattgggctcatcttctgctagaggaattaggtatttaacaactacatacattatttattcaattactcgtacattttataaaagggaaaccataggaggagaatttgatttggtctcaatgctacttgtattagtcagttcttactctgctaataaagacatacccaagactgggtaatttataaaggaaagaagtttaattgactcacagtgaagcatggctggggaggcctcacaatcatagcaggaggtaaagaacaaacaaagtcacgtcttacatggcagcagccaagagagtgtgtgcagggtaacttccctttataaaaccatcagatctcatgagacttattcactatcacaagaacagcatgggaaaaacccacccctatgattcagttacctcccactgggtccatcccatgacatgtgggaattatgggagctattcaagatgagatttgggtggggacacagccaaaccatatcactagcaaattgttctttgggagaataacctttggctgatgtctgtagaatgaaaatggcgtaaggtgagcaaagggtgaggcaattcaggctgaataaaagcatgtgtgaagaccctcgaaagagaaggagcagagaattacctggaatttagaggtagcaaagctgagagaacaaggagagaacggaataagtcagatgttataggaacaacaaatcttgctattttgaccacttaaagggttttgatctttatttaaaggattttaaccatgacaatgaggagataagatttactttcttaagaggttacatgggccttggtgaggctaagttaggtttaaaatatttcgagattttaaagaatatggatttcaaagcctttcttcaactcctctttctagaacatctccagtttcttttcacttttctctttccaaaagattcaagatgtgtgtgctaatggactatatgatacatgatatagtccatactgttgagtggggggaaaaaaaacaagttataagagagtgtatcaaaataatttgtgcaaaactaaggttctatgtgtgttacataatattctgaaaagataaactcataacagtggttatgtcaaaaaataatgaaaggaggttgattatatgagaaaggcatttattttcatttcatacacatttggactattttatattttgccttcaacatatattattttcataatttaagtgactgcttaatattttacactggatattgattaatagttgaatgaaatccatcaagtcttcctctcctctaaaatttctttcaaaattcatcataaaattgtcatttgttgacatattaaagtggcatggacatagtgatcttcatgttaaattagaaaaaaagaattgtctgtgagtgtaattttatcttcattttttattaacaagtaacatttctgtttaatgacttcaatctcttgaattacatttttgaaatttttttccagttcttgattataatgtctaatacataagcgatttctgaaatgtcatccgtggtataggaattaactagttattgtaatacaaatgggtaataaatttcaataccactaattaatttcaaaatgccttttttgaggaaatgggctgcctataatacttctggaaggcttattaatgtgtaattcacatattaatgtggagttaatgatggggatcacctacttaatgatgtggaccacctacttgttcatataaagagtgagttttctaaataacaaaagtctgtcacctctctctctccatgaaatgataattccaaatgttttatggccaaagaaagtagaacaagaaagccaacatgaataggagagagagaaaattacaacaaagcagctcatatacatgagcacttttctagccagcagaggtgactgaagtagaacctcatgccagttctccactttccaagaaataacacaccaatattgattcctgggaaccatgctgagaagagtaatagacttttaaaaatctccatctatccagtatcatttatacctaaaagccacatagtgtctgaattttacccaaggacagggacccttgtatacttcagacatttacaagtaatttgtgacaaagcaacatagcagaaatgagagaaataattactaaaacaaaatgatgtatccaaaatctactgtttccagaagttgaggttcttttttgctgattgtgccagaagttgtttcccttgcatcagccaaaagatttcatacagccagtttctgttttgcctgagcaatgtgacacagaggctatagacggcacttccatcaaactgttggatgagcctcccaaccaaaatccctcgtctgttctcatcaacacaagctaatcagagtcaaggactactcctcctccagaatttatcaattttcctaatgtctaaatatcctaatctgggcccaggaaggggtcctgtttagacacctttcttttatctcctatactcttaccgattgctccattttagcaccagaatgctattttcacacaagagtgaagaaaattggagatttttccatatccagatataataaccacctagataaatgttcactcatctcgcctgtctagcctgtcttgaggccggtttcatcatgagtcactccaccaattacttcaaaacactaattgcattacaattgcatacagactgtgaaataatggaggttcacagattttttttgtgaggttttgtgagacaaatggaggagagaattatatcacatgtcatattgcaatactttctatttttttcgcccaaacatgtctttttcttgaattttcttggaagcaagggcagctaggtggttgctaggtatcttgtacctttcctctctctctcttaatcccttttgtcacagcttgtgtcagtttcttacaccttctagactctcaaaatatcttcaagttatgtccccaactttggaaggaaaaactcaactacagaaataactgtagcaaaattactttctgtcattagtcacaccccaaagagataaagttgataatacttggctagatgagagaaacggtgttaaatgctttcacatatggcagttactgaatagtaactatgattctaagagtatttattcatcgtattgttttgccacttatctgttttctttgattaattaaacacagttgtttaggcattccatgtgtagcatcgctggggcagcaaatggaaaaaggccaattccagtcatgttgtgggacagaatgtgtttctataggaatgtgaaaagaaataacgctatccatctactgcaagatgtaagggaaataactgtaagtagacatctgatacattaaattctgcagatgaagaccagagaggagaaactgagtaagtgtccagaagagtgctctatttttatttttatttatttattttcagagacctagtcttgctctgccacccaggctggagtgctgtggcatgtttatggctcactgcagcctcaacaccccccatgctcaagcgattctcccacctcaccctactgagtagctgagactacaggcatgtgccccatgcccagctaattttttaatgctttttggtacagacggggtgttgctgtgttgcccaggctggtctcgaactcttaggctcaagtgatcctgctgcctcggcctctcaaagtgctgggattacaggtatgagccactgctcctggcccagaatagtgtcctcaattgagagaaattgttttaacttcaagggtgacataattagataaggtttaataaaaagtcattaacttctgggttacgatatattcggaaggttacagatggaagtggaaattctctctgggaagttctggaataatcccaggagcaagatcgtggttcctcagactaaagtaatagcagtgggactggggaggttttctgggagattcgggtaggataaattgggctcctcaatcatcttctgttttcagatgtgaataattggtaaggacaccctctcaagtttcaattttagctactttagaaactctacccagtctccctgttcactctagaaaacattctgactcatacccatagtgatttgggcatcagggtttgaaaagccccaatcatttctgcctgttgacctcctgaactctatgctttccgaagtcagttggttgtgtttgttctcaagtgtcttggtcatgggtctctgtactacaagtgtctagtttagtgaaatatgaaaacttaaggatgaaggaataagggaaacttcagagagattttcttataaaaatgtaaactcaagttttaggacaattcaatcaagacaaactgtgaaaagaatttcattggatgagatatggattggaaaaataattagtaaatgtataaggactcttttcaaactatttttcaagtgttttattttttgctgtactttaaacaaagtaaaatcagaatggaaaagatgattgctgtggtgtggtttatgcaaagacaactcagtcattcagtgaagatattgaaaaagacttggttggccttactttaaaagacttgtaaataggtataacccttacatggttataataaaagagaaaagaataagttgttcatgtataatatttaaataattccccactttaactgacttcaactaattgactacaggtcagatagaattcgatcagagggtttttactgtaattaaaatctttctgctcattgattacacttctctctttttcacatcttaaccagtgtataatgctgagaatgcaatgataagtaagagattgtagtagaaacccatgaaaaataaaaatcagaatagtaattatataaacttaaaaaaaattgctgaccaacacctttttctttctatccagtaaatggttgcgattttaattttaaatacttcaggataactaagtataaaataattgattttctactcaaaaattaggaggaaggtaatacttaagcatgacaaatatacagataattatgctttccttaatgcatcaatttctttagcttctagcattaagcagtcacattttgtacactcatatatttacttggctttcagtataattacttttttgccatgaaatgatagctgcttaagtatctagatttttaaaattattttttactaaatagctttccataaagaaaagtacaataaaactaaggacacagtatgagttctgcctattaattttactgaataagcaccgagggcttttttaatagactcaaagtaatatatcaaatgtgtaaggaattaaacaaaattatattctttctaagaatttcattgcatttaataaagcaactcaagataaattttctgaagaaaaattatatatgcatctgcatcagagttttaaaaataatattctaaatgagaaaaggggttctgggtcaaattttgatgttgagctttatttcttttatgttttttgttgcaagttacttctaattacccaaaatttttagacaaggtgtttttctcttaatcactcataaattgttcatacttctgaatgtgaaatacaatatattgtattctccataacgtgctaatgaactgttatcttttctctgcatagaatctttcttgtttattctatcttaaaataaactacagaaaattctatttcaagtcatactacaagcaattatattcataaattctcatatttctaaatgttagatatgtccaaatttacattgttattttgaccaaaaattattaatgtgcctttgtccagagccttctccaacccccagtaatgtatgtgggaagtcgcccaaaggccaggattcttgagataaaagtcatcatcatgatagatagtgtgcctttgacatcagaccctagtgtccaggggccattggcagcaaggggagggtgtttgtcatcagtctggaatgctttgcggggaagggtgggaaaagggtccaagataatgggtgaaaagagagttattcaaagttattcaaagctttctgggagtttcaggataatagaaaatgaagagaagagaagattttatgtgatttacccttcatgtgttcttgtttttaccttttccgtttttttgttttttgttttttgttttgttttgttttgtttttgagacgcaatctcactctgttgtccaggctgaagtgcagtggtgtgatcctggcttacggcaacctcagcctcctgggttcaagtgatactcatgcctcagcctcctgagaagctgggcttacaggcatgcacaatcatgtctgctaattttttttatttttttatttttactagagacagggtttcaccatgttggccaggctggtcttaaactcctgacctcaaatgatccaccgcctcagcctcccatagtgctgggattacaggcatgagccaccgcacccggccccttttctgtgtttgaaagagattccagttaacattttagttggactctgctcctctaattgttaaagcattctggaatacctcgacagtataaaaattttaagcatttcaagtttaacaaacttcaattctggtgaatgaagttcagtgaatacattatatttcagaagttaatgattaatataggtttggtggtctcctatcagaaagttactactgaaagtggtgaaaatcatattcttaaaaatgcctcatttgcctgatagaagcttttcaaatcggactatttgaaaattagatttattttgttgaagttttatgttcaagacatctttaagtataaaaatcaacttgatttagcatcttttccattcacttttaatttttactaccgatatgactgtgaatcagttgtgttgctttgagtgccgtcggtggggtgctgaaaagtattaactggcttgcttagaacacaccacacacctgaattgcagtgtttgccaatacctgtgttgtaatactgctatcacggctgatctcaaatttccaacatatcatcacttaatatggaataagggagaaatgtgtagtaacacagccttctacattatctcccccatatagacttaaataacctccagagcatagacaaatgtaaaatataacaaataagtaggaagctgtgatttttgtgtatgtattgcctttgcttttattataaattacttaattgttaagtatacctaattttttttaatgcctgtgtttaatcactggcacccaaaacccttgacaagtgccagcacaccagtggtacatatatcttaagaatagaaatactgtttctgtttaatgtgggatgcatgattccataccatcttaataagcagtaatgaggtatcaatcagttaatgttataaagttggtctttgcttctcatgttttcctgtagaattgcatatatgttcttacggtagaaatgatcacaaggtactatcattcctatatgagtccccactaatctctgaaatatttgaatagagggtagatgtggatttttgggggggcttttgtttgtttcataaatgttgttgttttattccacatccccagaaactgatgcagtatctggcagagaggatactttcagtgagtgagtgttgtttggttggtggaatgaataaaagaaagaaagacacaggggctaattgaagaagagagtagggcaaagacccttaaacattatctgcaaggttgtctctattttctcttccagctggtgggatgaagggtggaaactgaaagagtgtctcagccagggcagcagtataaacatccaggttgctttgagtcagaaaaaactgtcattaaagtggaaataatatctgttgtatttctaacaagtgaggatttgaatatgcagttgttacagttaattgttttctcactatctttttcaagattgatattattgaattaaatatacatgtattttacattgcctaaggtagaacactcctataaaaacatcaggaatcttaactgtgagctttgttacaatttggggccaatgtatttttttttccccatgataatgcatctctgaaactaaaaaaaaaaaaaaaaaaagaggaattcagttagaaaatatgaattaagatggaaatgtattctttataagatcacttacccctacctccactgtgaaccacttctcatatctaaagcatgatccacttaacacacctacacaggttgtctggcacatcagcatagcccttatatattccacataaatactgaaccttctcagggtagcattttatgattactctagtgataattgattttttgtttagtcaagtaaactaccttcttaatataataagtagcttgcactgatgaagcatacacatttgtctgttgttaggtattttcatacatttatgtatcacacatgttatacgtacagtgcatccacattgttattgccatgattttccagagagaattttcaaaaagtttaaaaatcttgtaccaaatcccattccattttttaagtcaaccagctatgaaaacaagtgctctagagcatgaaacaatatatacattagtcatttaatttgtcattgctttgtgtgtataatgaaaattattgatctttaacttcatttaccttatttaacctccatatatttttctctattttaagaatcattagcacatattaataaacagttctacttcaaagtaattaatgtacctatttttgaacaacaaattctctggtagtctgaattagaaaaaaaatgaatgcaggatattgcttatacattaggattaaaagtactgtcattttcttttgctatggctctaaagtttcttcccaagtatgaaagaaatgtaaaggcatgttagcataatgaactttcatgcatttttgcattgaacaatctaggaaacttaaattctcatctcaaatatttcacttgagggaaagttaaaatcaaaacccaagtatcagccattgtgttgactaaaatttgatataggattaaataaattttataaagacctagtttactccattgaagaataacatatttctataatacatagcataatgacatgcaggtggtttttctagctgttcagcttttacctttcaatcaatgttatgtcattttgcttgtaatttttggctttgctttgtttaaaaggccatataaatatagtcattcctttagtacacagtgttccccataagtgttttattaagctaactaatgagttccagcttgtcttttgttggatgccttatttcttaatgacccttgataagggaaaatatacttttgtctaaagtctctctttctaatcaaagcggcaaccttcttatctaaacataaggcaaatgccaaatctgattaacaactagaaaaactgtaagacagaaaattaattagggcccccaaatgtcttgaacttacacgaagttgttttcaagattttgaaccaccacatgatttatgaaaaacgactgttttgaagatttttcaaatgtggattttaaaaatcaataatgatctaccaaatatataaaccaacattcttcttgaatctttgacccttggcaataaatccctggtattttattaaatttgaaatttaatatgagttattttacttgatattagcaaattactgcagatttttttttctttcatacaatgtaggatattcttagaaactaccttcctaaaagtatgtggaagatatctctggagtaagttactcaggctaccttttaacacatggtgatggcttgacaagatgccaatttaaaaatctttgtagacaaatacattattggtttggttactgttatgctgttatagcaatgcatttctaagtaaattacacttaaatgtaagataaggaaaacacaaaaactttgaaatacataaattggaaagagctgaagttaaagatgagtctaaaatagaattattgccaggcacggtggctgacgcctgtaatcccaacacttggggaagccaaggcgggtggatcacgaggtcaggagagcaagaccatcctggccaacatcgtgaaaccctgtctgtactaaaaatacaaaaatagctgggtgtggtggcacatgcctctaatcccagctactcaggagcctgactcaggaggctgaggcagaagaatcacttgaaccaggaatcagaggttgcagggagctgagatcacaccactgcacttcagcctgggacagagcgagactccatctcaaacatacatacatacatacatacatacatacatacatacatacatacaatagaattattagtcaaatcaaattattgatgggaaaaacatccagaaacaaagattcttccttatacctttaaaagttacggtatactgattatgctgctaaatttctttattttctgttgtaattcaacttacatgttcattgcatttattttctttctttcaaacattgtagaggagtttgagaaaatatgttgtattgctggtccactttctttgaaataatttagttgtcatactttatatcaacaatcagaaataaatataataatagcaaaacagtctttgtaactttaaataatctatattttcatttcaatttataacctgagcaataattaaatgaatttattcctgtgacaaaaatttatgtaatgcatgacatataagccaatcttagaagtgcaaagaaaattaatatatataaacctgcacttgtaccccgaccttaaaagttaaataaaaggaaattaatatataacctcttttaattcaagtgaggaaactgaggcatacaaaggttaaataacttgtacaggtcatgcatatagtaagtgcagagctttagttatggctttaaaggggagatgagcaagcaagtaaccaagtagatggtgaatgggggaaaaaaaaaagttcacaaactgtgagctaacactagatctggctaaatttagggcataaaataaaaagaaaaaaaaataaaggcaaattatatgagacatttgaccacaattgtatgacaaagaaaaggtagtatttttgagaaatcttaaacatttatagtttggaaaataatttctgtagaaacctgaagaaattactggaaaattctggcattctaaacagaatgaaagaacacatgcaggctcatatgttttgttattgcttaatgcagtctcactagctagattgcatctctttgctattgtctatagacgaactgaaatgctatgaacatagtaggcattcaataaatacttataaatttattaacattttaatgtgtatgtaatgaaatatcttaagtagaaatatatttcataagctgaagtccagtgtgcctttcattgttgaagaaataaggttccatgctcaatttatgtcatgaagaaaatgatttgaagactcaatttaccctctaatgagttttgccacatcaggtaattatttaatttgccatcacaagcattatttaaacaagaaaaggcccttgaactaacaaggaagcatctgcatctcacaccaggaaaaggggagtgcagtcaagctttggatcagccctctacctgtcagggaaagagaaggaggagacaaaaaaaggcaaggaaatttatgaactacagaaaaggagaaattcaatcttactatcaatcttcccaaaaaatatataatacttaaaatctatattatataatctatatactgatttcttaataatttaacatgctctgagggaagtggtataatgaaaaaaaataagtctatgaaatcgaagaaatcacagtttcaatatcaacttcattaattactatttctgggcatacaaatgaggtacttagtattttcggtacttagggaagatatatatacaaaaatatatgtatacaaaataggtatttttccccatgttttaccaaaaaatacatacatatacaacgtatatatatacaacatacatatataaaaatatatacatatataacagatacatatatatatatgttgtgcatatatatgtacatgttgtatatgtatttttcgtaaaatatggggaaaaaatacctattaactagtttgaactgattagatgaggaaaaaatatttaaaagagctggcatgctttaggcatttaatatcttatgtaaattaataaatgtaggcatatataatatatttttatgcacattgtattatctcctcaaaagaacaatttatttttacttatatagtggatctctaatctgtctaatggtaaaacataagttttgtgtttaaaataggacttgaaaagaaagaccgaaaatttttaagaagtggaatgattgtttatgcatgattcccaatattaagaatagagtttgtaaaatcaataaatcaataaatgagtcatttgttttaatattcatatttctcatatacaaaatgtacttaaaatataattcatagataaatatagatgatatattagggtgttggaaaacaggaatccattagttatatctaatttcaagctatatgacaatgactcatatcaaaaaaataatactttacacaatttgcataaagatgagttggtttttaacagtgttcttttgcctgctgtattgtgtgttctatgttgttttgatgtagtttctgtttataaatactaacatcctcctttctcaagacattcagtcatgtcaagtgtaacctatggatttttctgggtttacttagtaaagatttatgaatgaataagtcaatgaagaaaaaatgttcctttcatgcagattttactttataatatgacagggaacacacatcatagtaaagtatgtttgcatatataggatatagtaacataaaattaaaaataatgaaaattaatatgttaacaaaagcagtatgtggtcatacttgtggaatgaatgtatttggtagtgtgaaataccaaaaacctctattgcttgatattttcaatgttaacccccaaatggtggtggtagttttcttaaacataggacaaaatgacgtgcatggtgagggataaagtacatttttctagaaacacatttgctttctgttttatgattaggtatagaatgtttgctgtaggccaacatcagagaaaaatccccatacttgaatattaatgcctgagagtatcttaacagaaaacaaaagttttcatgttttaataacgataaaatactttaaatgtctggctggcataataaataactgaaagtcaaattcaatggaatagctgtactacatatcattatgtagtatggcatatcattggtacagcatatcattatgtagtactgcatatcattatgtagtactacattatgtagatatatagctgtactatatatcattctacttattattatgttagtgacttgactttctcaacatttttgctacagtgattttagaaatctgaaaatgctatcatagatttctacctcacaaataaaaggagatggacttcgaccaagatcagttttagagtcattcttgaaatagtttatcattatcttggcacccccaaaatacttaatattctataaaacaaatctgaaaaaattataaactgagagcatgattacatcatttaatttgcataaggaaaaagtgattttgcaaaatacgtaaaatatgttatatgtttggaagagacaaaggaagattccaaatggaagtcaatctgaaggagagaacatacctttaataacttctgacacacacacacacacacacacacacacgtaggtatatatacacatatatataaaacttaagcatgtttatacatattctcagattagtaagagtctccgtatacacatcaatctaatggttttaatataattaagtggatatagaaagttactacggatcagaggaaagtgaagggacagtcaatgcctttaaaagcacatattgattcagattggataaagtaaatgaagaagatcatggagattgtaatatcattgacaccagtcaaaccgaacttgctaaatggaggcaaaacataaacaaatatccaacatactcccacagttgctgtgttattcctgtcattatatcctaaatgaatatacagtaccagagaccaattagattagctctgttgttgtgattcttaaggatgattgtattcactgtggtggagcatatcaagaggagaaacagagaagacatggtaatgggaggaagcatagggtatgtcctttcactaggcaaacagatgattggttgaacaaactgtagtagagccacacaatggaatacttcttagtaataaaaaagaatgagctcttggtacacaacataaagtggatgaatctcaagctaattatgctgagtgaaaggagttggccaaaaatctttatgatttcatttatataaaagactaagaattacaaaccaataaggagtgacagaaagaaaatcagtggtttcctatgaacgaggcatggcacagagggggtgacgttacaaaggggcctcactatacttttgggattgatggataggttcattatcttgatagtggttatggtttcagaagtgtgtacgtatgctaaacttatccaatggtacatttaaatgtgtgtagttcattatatgttaatggtactttaataaaaataagactttctagagtcagtttgatcgggaatccttgaatcacagatgtgattttaagatttttcaaaatcattgagatcatttaggtgaaaaatattatttactgtattatgtagatgttgccaccctgagtgaagaataaagctgtttatgaaaagaaaatgaaaacaaaagtcagatttctgatgttctcattcaggtgtaattctacttgccggtaagtatatcctgcaactatgataaaaatttcagacttgtacaataaaagaaagtatgggtttttatatttccttctcctctcccactaaaacttttaatatagaacctacatgtatatagcctgggaattttaaaaatttattgaaatttttctcaatttactaatatttttatagaaacttcagccagtgtgtatatgtatatgtatttgtttgctgttggtagtttattgattgttttaaaaactcataaatctattagtctttgtattatgtttacaatagagatagaacatttatacttctatgaaaaactgcaacatcaatggtttggaaaatactgttttctgcaagttggcaaactataggcacttcaataggataacatttccttttccacttgcttctactataataactggtctagttcttcaaagaacaaatgaacagggatcataacgtaagagcccagtttaatacttggttaagtcaagtaaaggaaacatatttgtctaaagtaatttgggtaattctttaaatcttctctgtgattcatttttatttttctatttactatctttttctatttacttccccaaggacaccaggtcatacaaccatctgcatcaggctctatggtcagggaggaatgtcccttactagccgtaaacatttttctcttgctcagctgatgaccttggctgcagtgaccagtgtagtctcaccttgaatactgccttcacgttttcatcctgtctccctatctgcctgagctaatctgtttcagggttctctttgttcactacatcctgagaattaatgtttatcctagtttggtgatttctagcagggaaaaatggtctctttacaaaatcttgttaatgatatttcacttcagggaccaagacctgttttactgcagtttttgcctttgccttcttcaaatcattatcttttgctcccaactgatagcaaagagccaaacgcccaggtttaatttgcaatgtccttgcttaattcaaacttgccgctatactctcagagcagcccaatttatcttttgaaaacactttccactgtaaaatactttcaactcttttctgttctcttgctgtgtattacacatgcttgtgttactatcttacacattggaggaaattagacttgtctagttcaggaaattagcatgttctcttagatattttgaaaggtaagatttacctgataatcagtactcaacctatcaaaataatggctgccttggctgtaggtcagaaggacaagttcagggaaaatggtgcatctgctggagcaggcagaatagcttgtttcatttctgcagtagctaacataataatagaagaaccagtaatgagggctggtgagggtcctaacattcacagtggtctttagcaccatcattcgtgttatcactgtgaatcactgacataattgtactatttctgatttgaaaagctacagatggctcccaatttcttttacaacgaaatcaaaacttttcagtatgattctcaaagagcccttattttgtctccaaaccacatttcttgcatcattttctcctctttctcactcacttcccaaacacagccttctcattcttccaggtcactaacagtgcaacttcttatatgtctgagagatgtttccatcttgtcttcactaagcaaagttttccctcaaatccaaagcccagcacaggcttctttgaaacttttcccagccaggcctgatcctctttgaaatgtactttttggaaatgttactgtgcttcttcagggcaaaaggagctttgcgtacacctcttgtggcactgtgatgattcatggagttgttaacaagtgattcttattaaaatgagaaccttcttgagaataggaaataggactttttcactttgtacttctagatatgtgcacatgtctggcacatcacaatagatcttcaatctatatttgtggagggagtaagtgaaaatcttatgtagtgattttcttgggtaggcaaatggagtatggcaacagaaatatctggaggactgcaaaacacaaatatacaaccagatagggagttcccaaaagggagaaaaatgcaaacaaacagaaccagatatagaatctggggtgattcgagtttttgtctatttctaagagaacaagtaagaaagatctgaattttagtcccaagtaaacaggaatattaggaaaagtatcaatcaaggtcttagacgtagaggaataagagtgaatcaattaatggaactaggctataaggttagagtggcttattttaagagaaccagagttcattgtcgaaatgacacaaggaacaaggtaccagagatggtgctccttaaagtaaccccgactaggagcagacttagcccaaggtgtccatatcttttgcaatttattcgcatcactccatgttcatggaaagaaaaacgttaatcaaaaaggcttgtcacttgaagttccacacttcagggtgttactttaggttctgcacctgtacctatttcaaattttctggtccttgtggtgttttctgtatatttatggtttggggctagttgttttcactgttattatttttaatccataattgactctctacttaggacttctgaaacaatggcatggtgcttttccctcaccagatgttgcttttcatttcctcctccttgaatttatttgctcagctgccatgcaactcctgatttgctctcttctaggttcaccctctactggcttatgccacaaactatgtcagggcttatgaccttaaatttctgagagggaagggactcagaatttaagtgagtacagtattctagaggagtcaagcagttatagtcatccttcttataacattcctcctgttcatttttgaatctctataaagaaatagctgaggctgggtaattgataaataaggcaggcttacttggctcatggttctgcaggctgtacaggaagcatggcatccgcagctgttcagctcctggggaggcttcaagcagcttttactcatggtgaaagatgaagctaaagcaggtacatcacatgtcaagagcaggaacaagaaggagagaggatggaggtcccagacgtacaaacaaccagatctcacatgatctaatggagtgagaactcacttatcaccaagcagatggtgctaagccctcataagggatttactgccatgatccaatcacctcccaccaggccccacttccaacattaagaatcacatttcaacatgagatttggaggggacaaacatccaaactatgtcccctccaaacacatatcaaggactactttggttatctcagtatcatcttattagtttctgctgccaccataagacaaaattcaaatagtataaaagttagaggggaattgccattcttccctctgtgtttattcattcactttaatttgaggagtttatttaaataaaaacatggagtttttcaatggcaagaaaaccatggtgataggattctattaacactggccaagaaaacatcacaggacagccacggttttctggcttaccaggctgtaatcaaatgaagatgtgaagagtgaagatctcccaaggagggtgctttacttcaactagaaaagcaaattgtgctctccataattgtttttgagttagaagaggctttgatgtttttcacttttccttctatgaaagaaaacacattatgacttttaagttatacaaacaaaactttttttttaaatgcatattcatgccccaagccaacttttcctaattagtcagatggagaactaatggagttgttggaaagctgattgaatacttaagagcacaggaataacatcaatcaccatttggagaaaagagaatgtgtttagcgataggttggtaaactgagaaggctcaagttgtagcctggagggaaattgtaggactgctccaactctaatccccaaattccctctcttcattggttaaaggaggctgccagtggtcgagttctgttattacctctgtttagttgtcctccaaagtcccctaacctcagttattctgaagtagtaataataacatctctggtcatatcttagaggtgaaacaatttcttgcagcaggttgggccttcatttactatttctttaattcatccatctaacaagcaatttccatgtatattgttatccttatgtattacataggattacatacattaagcaggtaatgtatgtaggttcactgtgtggaaattgcagaaatatataaaaatattcttagcattgtttccctgacctggcaagagtagaatcaggaattggaaaattgttaagagaatttgtcatttaaacctcctctaaaatgttggattttattaaaaacatatttatgtattacttttatttaagagtatttatctttcctaagagtcttgtcaattttcccagacaggacgctgaagctagagataacatattttttaggaataaggtaaaccaggccacctcttgcagaacacagagcacctaactcaggtgtgggccatggtggagccgaggtcaacaatggctgaccagcacactccaggacattccatagtggcttgctctttcctcttcttctgctttcagaacaataacctgccatcctttttatttttcaaacttgactgattctaaacaaaaataccaggcagttattttcatatttcatagctcagggtcacttaaattataattaatttttactgatcccatcatttcaaattcatcttagggaatttaacaagaaaaggtctaaatagatttttttaaatatgttaataaggatcggtacatgtcgaatctctaattacctgtgtattatctctgctcagtcttgagtgaagtctgagtgaataatttcttcaatgatccagtttttctgtttttttcccctcaatcatttaacacacatgactatatcctaggtttagtgaagcagaaaacaaagtagaaatatattttaaagcacaattattacaaaatgcttccagtttctatcttctctaaatgaataacgtctgcaggtttaagctatttcctctcatctgggtcttctctttgtctctggatcctttgtcacataatgggaagttgatgaatgccgaaatttgaagtttcacaaaagagaagactaaattgaaaaataaatagttttctcagtttttgtattcatgataatgttaattataaagcaaaatagcagcgactgagatatttagttcaaatataagcacaatatgaacactggcagtgttaataactggtaagatttcaaaatccctcctagttgtgcttcattactccaggtataaatatttactcaacttgagataaaatttttctcacaaatgattaataatatacatagggtttttttttttgtctgaatgcagagctgaatatcggttttacttcatttcatgttttatatcagcacagccaaactttttctcaacaaaaaagcagcctgatttaagccacggttgcagatctttgccagactgccacaacttttattagagatgagtattttacatgcttaccatgatgcactcagttgggggctctttattgttatcatttcaattcaataacaaaaaaaataagaaaaaatggagccctggataaaatttcaattactaagcaaagtaagaagtaattacagttttcaacaatacagaagcaattcaatgtataaactctgtattcccattttatagcactaaaaatctttaaaatattttccaaacagttcattgctaacatcagcagtctcctctccactgtcccccaaacattctcaaattatgtctttggtgataataactttgaaatccttcagatttttaaataatatattttcagaccttttggttgaatacataatgttaaactgaacttcctaggttaggcaggatatatttgaattttgcttgtgccttctgcaatatagtacttcttaatgggactagaataaacaaactgaggatatcggtttgatagcttatgtaatgtttttctgttctctgttttttacctacaagtggcttttagcagtgaggaataaagataattgacagaaaataatgttaattgcatgggatttaaagttacagggatcttaccccatcctagtttcatttaatactaatatagcctatgacaattcacttatgtggctgcctcaatccttagttttcacaattataaaactggagttatgggaacaagtactcaatagaaatattgtgagaaataatagcataatgtacaataagcaatcaacatatgttaataactattaatgctgttaatatagataacataaataaatgaacataattttcaaccacttacaaatatttcaatataatttggaaatgagttagacaaaaacagaaaaagactattgtccaataaaatagctattcccaatcaccctgttatactgaatttgattgcttatataggctctgccttaatgaaaaggagaggacaagaaagtagatactttcttttcctagaacattcattaaattaaaactgctgagacttctggtttccagttctacttataagtcatcactctgttctaacaacagcaaaaagtgaaatgactgataagtcaacttttattagatcaataaaagaggtgatggaaaacagttgtcttcactgttttggagattggagagacagacaagtgaatatattgggtcacagatttccagagcagagtctcaccagtgaaaaccttggcaggaatgagtactggggttgtaaacctgaaatatagttgataaattggtgggggcacaaagtggacaagtctcagaattaaaaactccaggggaacccacaaaatggagctcacacttttgtgagatttacctccaggaactctacccacttctcttagtaaatatcagagaaaagtctcctcatcgttctggtgtggggataggaaaagaaaccacttcagaatatgccagagcattctgttagaaaggtttgcactcagaagaaactctttaaccagagcttatcctcttgggttttatcagaacctaggggaagggaaatgcccaatttcagccacttgtatcctcttacatggaggaagggaaatacagaatctcagcccactctaaccatccacaaaggagaaggaaaataccaatctttggcctactctagtcttccttttctatttatggggtggtggtgctgagaagcacttctgaagttcacttctgatgtctggaggcataggcttaaaaaaagactgagactgaatcacaggactgtagaatgcttcctgttcctgacaccttactactgcattattgaagacccgtttacagcagtccttttactacaacatgctactagctacatcatgtccagttatcaagaaagaattgcaaggcataccaaaaggcaaaaaagagaaacaaacccacaatttgaagaggcagagcaagcagacatgacagggatattggaattttcagactgggaattttaacaaatatgattaataggctaagggctcttaatggatacataaagtagacaacatgaaagaacagatgggcaatttaaacagagatagaaatcctaagcaaaacaaaacaaaacaaaacaaacaaaaaaaccaaatactatgggtcaaaaatattgaaacagaaatggagaacattaagcatcatactggaagaaatgaaagaactgacaaaaccccctggaactaattgatcacagcaaggttgtaggaatatagtcaatcgccttctgtattagttcattttcatactgctatgaagaaatacccaagactgagtaatttataaggaaaaagaggtttaatggactcacagttccacatggctagggaggcctctcagtcatggtggaaggtgaaggaggagcaaaggcatgtcttacatggcagcaggcaagagagcatgctcagggagactgcccctttataaaaccatcaagtcgcatgagacttattcattatcatgagaacagcatgagaaaagcccacccctatgattcaattacctccactaggtccctcccatgacacatggggattaagggagctacaatctaagatgagatttggctggggacagagccaaaccatatcattctgcccctggctgctcccaaatctcatgtccttacaattaaaaacacaaaaacacaattatgccctcccaacagtccctcagagtcttaaatcattccagcattaactgaaaagtccaagtccaaagcctcatctgagacaaggcaagtcccttcctcctatgagcctgtaaaatcaaaagctagttagttacttcctagacacaatgggagtacaggcattgggtaaatatacccattctaaatgggagaaattggacaaaacaaaggagccacaggcccagtgcaagtccaaaatctaatagggcagtcattaaaccttaaagttccaaaatgacctcatttgactccgtgtctcacatccaggtcacactgatgcaaaaggtgggttcccatggccttgggaagctctgtctctatggctttgcagggtacactgcttctgttctgactggtttcacaggctggcgctgagtgtctgtggcttttccaggtgcatggtgcaagctgtcagtggaactaccattctggggtctggaggatggtggccttcttctcacagctccactaggcagtgccccagtgaggactctgtgggttgggggggactccaaccccacatttcccttcagcactgccatagcagaggttctccatgagagttccacccctgcaacacacctcggcctagacatccaggcgttttcatacatcctctgaaatctaggtggaagttcccaaacctcaaatcttgtcatctgtatacctgcgagacccacaccacatggaagctgccaaggcttggggcttgaaccatttgaagccatggcccaagcagtatgttggttctttttagccacagctggagtggctgggcacaggacactgagtcccaaggctgaatacagaaggggggccctcgtcctggtcaaagcaaccatttttctttcctaggactatggtggaaggggcttccgtgaaggcctctgacatggcctgcagacattttctccattgctttagtgattaacattctgctcctcattacctatgcaaatttctgcagctcgcttgaatttctccccagaaaatgggtttttcttctctactgctttgtcagggtacagattttttaaacttttatgctctgcttcctctggaatgctttgttgcttagaaatttcatctgtcagataccctaaatcatctctctcaagtttaaagttccaaagatctctagggcagggttaaaatgctgccagtctttttgcatagcaagagtgaactttcctccagttcctaacaagttcctcatctccatctgagacgaccttagcctggacttttttgtccatatcacctcagcattttggtaaagtcattcaacaagtctctaggaagttccaaactttccaacctcttcatgtcttctgagccctccaagtctctatgaagttccaaactttcccacattttcctatcttcttctgagccctccaaactgttccaacttcttcctgttactctgttgcaatgtagtagttccagctagcagtgggcaatttggagtatagttaagtatctttgatctcatacacactgaaaaatgttcattggatgtatataaaaatctgagtttatacatctgagctagagaattaccaaagccactgcaaatgtgctattttagaattaatttcaataaatccatgtttctacagatctcacattctcagaaggcattaaagggcaggtaaagcaaggtattttagtataacaatttgatttaaagtaaatacatattttctaatcagtaacttataattatcaggtagctgataatttttttggctatgtctttacagtgaattaaatatatttatgatgctaaatgaacacacacatacattgtaaaaacatttttgtatttgtatgaggccaaaaatatgcatggtttttgtacatatgaacaaaaacatatgagaattaacatgttagctaagtgcttacattttgtagcaaactaagatgtatctttaaatactttaccaagattaatattgtcttagtatttgatgttgtctgagtagagatggaatttttgtttactaattaaggtcacaatcaggaaatagttacatattacacatttccatagtaaagttatatgaaaatgataattatgtagtttgttttcaaggaaaccataatggtatatagtgatgaaaacaggtgaaattgtggaaagtaacccttcattcaaagactgtgttcataatataagccaaaaatgaacattaagtaagtgaatgcaatcaaaacctagagtatctattcctggttcctgaaatctgactgaatctaatttttaaaaaagagatgggaatctctctatgtcacccagactggtcttgagctcctggcctcaagtgatcttccagcatgtacaagaaagcatgtatagcggaattgccttttataaaaccaacggatctcatgagacttattcactatcatgagaacagcatgggaaaaacctaccctcatgattcagttatctcccactgggtccttcccatgacacatgggtatttttggagctccaattcaagatgagatttgggtggagacacagtcagacgataccaccttcctgtatagctctagtgaacaaatgtaattttaaataaaaaaatacaatgccatttatgttagcagcaccccccacccaaaaaaaaaaaagaaataggtacacattgaacaaaatatcttcaagatctatctgaggaaaacaacaaaactatgataaaagaaatcaaagaagaactacacaaatggagagatagtctatgttcataaataggaagactcaatagtgtgaagatgttagttcttcacaactggatcgattcagtgcaatcccaatgaaaatcacagcaagctattttatattgtcaggatgattctaatgtttatatggagaggcaaagggtacacagtagccatattgaaggagaattacaaaggagagaatattgaaagagaacaaagttggagactgacaataccagatttcaagacatattatcaagcacagtaatcaagacagtgtggtactgacgaaagaatgatagacaaatggattagtggaacagaatacagagcctagaaattgacccacatgaatatagtcaactgattttgacaaaggagcaaaggaaatgcgatggtgcaaaatagtcttttcaagaaatgatgctggaacgactggatttacatgcaaaattttacaaagaaaatctagacacagactttacacccttcacaaaaatttgctcaaaatagaccatagacctaaatgtaaaacgcaaaattataaactcttagaagatagcttaggtaaaattctagctgaacttggttatggaaaaggctttttagatataccaccaaaggcacaatttatgaaagcaataactggtaagctggacttcattaaaattaaaaacttctgctccgtgaaagaatatgacaaaagaatgagaggtgaatgcataaattggtagaaaataattgcaaaagatacagcagataaaggattgttatcccaaagatagaaaaatacataaaactcaacaataaggaaacatacaacctgatgaaaaaaattggccaaagacctcaaaggacacctcatgaaagataaacatataaaatatgctgcacattttagatcatcaggcaaatgcaaattaaaacaaccataaaataccaatatatacgtattagaatggtcgaaattcaaaacaccaaatgctggcaaggatgtggagcaacaggaactatcaataattgttgctgggaatgcaaaatggtactctggaagacagtttcttacagtttcttacaaagttaaatatactcttatatgttccagcaatcacagtacccaaatgaattcacatgaaaactggcacatggatatttacagcagctttatttgtaattgacaaaatctggaagcaaccaggttgctcttcagtaggtaaacacataaatgtggtacatcctacaatggaatattattcagcactgaagagaaatgagctgtcaagccatggaaagaacattacaggcatattattaaaagaaagaagccagtcttaaaaggttatataccatgtgattcccacaatatgagattctgtgaagggcagaattgtggtgacagtaaaaaacaatcagtggttgctagaggttggggagcaggagggatgaaagatggagcacagatgatttatagggaactgaaatcattttgcatagtgccctaattgtggatacatgttattatacatttgtgcagacctaaagaatgtacaatatcaacagtaaatcctaacgtaaactctggattttgcatgattatgatatgtcaatatagattcatcaattaaaagtagcacttagtgtgtgatgttgataatgggggagactatgcatgtgtgaaggcaggaggtatgtgggaaatctctgtatcttcctctccatttttgctgtaacctaaaactattcttaaaaaaataagtattaagtgatggcttgacataagctagatcatctcaaaatatttctagtcaaagaacaggtcatagaggtgaatccagaatatacatatatcatacatatgtatcatatgtatttatattatatattatatacaatatatacattatgctatttgattacagcattctctttttccaatgtttctttatgcttgtcttgctggtaataaagacagtcctcagggcaaaatgttttattatgtcgtgatgtgttaattttggggaattgttttccagttatgaatatttactttgataaggtttccaataagaatgccttgtgtatttgagtaatcaaggatatatttaagaagccattaagtgctttggataagacgggctcatcttatcgcatcaaaattgagaaatatatacagagaatcatgctttataacgttaactacacttctgctatgtttattccaactttccattaagaaatgaactaaatagtattataactacccaattagctagcagtgtccaatctgtagtatgattaagaatctttgatctcctacacaatgaaaaatgttctgtggatgtatataaaaatctgagcttatacatctgagctagagaattaccaaaaccactgcaaatgctgtgctattttagaattaatttcaataaatctatgtttctgcagatcttgacattctcaaaaggcattaaagggcaggtaaagccagatagtttaatataacaattttatttaaagtaagtacctattttctaatcaacaccttataattatcagacagctgattatcttgctatgtctttacaatgaattaaatgtatttatgatgataaatgcacacacgtaaactttcaaaaacatttctttcttcatatgaggccaaaaatatgcagggtatctgtacctatgaacaaaaaaaacatatatatgaaaatgagcacgtagctaagtgttcactttttatagcaaactaagatgtatgtttaaatattttactaaaattaatactgccttagtatttgatgttgtttgagtagagatggaattctggattattaattaaggacacaatcaggaaatagttacatattacacatttccatagtaaagttgtatgaaaatggtaattatgtagtttattttcaaggaaacagtcatggtatacaatgatgaaaacaagtcaaattggggaaagtaaccctttatccaaagactatattcatgatccaagccaaaaatgaacattaagcaagtcaatgcaatcaaatcctagagtgtctactctcagtttctgaaatctgactgaacctaacttttttaaaaaagatgggaatctctctatgtcatccgggctggtcttgaactcttggccttaagtgatcttccagctccagcctctcaagtagctgggacaacaggtgctttgccactgctcctggctttgaacctaaatgttaaatacatttgaaaatagttacaaaatgaaaatagtcttggattttcaagtactttaagaatttttacttggaaacattcccttaatattttaagcaatgtcattttaattgctttttctttgatttttgaaagggctgaacttgaaactgttaagatataaaataaaaaatcagacaaacgattgtattgattataaaataaaccactgctgtagcttttaaaagagcctaaatatttggcttttagacctaacaggtataacaacccaatccggtttttatgcataaaataatgaaaccatttgcctccttatattttgtactatatagcatttagtgtcatcggataggccaattggttgtaaaatcaaaaatattatctaatgaacgttattctctcataaaccactaaagcagcaaaggagttctctttaacacgtggttttcaaaattgcatttgcttactacagtccatcttcattttttttaaaatttggtaatagacatattttaagcaatctttgctggcaacatgatgaaaataatgatttttattttagtttcaggaaagtttgaataaaaagtatgtccacattctcaagtagagattagttgataaaatagtttaaaaatatcaaattacaggcatcattaaatttccataaatttttcctaataaaaaggacttctagaggctttactctggtgtttcacaataaactttatctcatcaagcacgtatggagaaaataaatttagtcactagttccatctatactgggactaatctttaaaggcatactgttgtatcatatattgtcaacttccaacttttggtaagagatatatgagagacacaaagatttttttaaattgtaagataaagattatagaagacaatatcatacaaattaatctataagattaaatgaaattatttgtgtgaataatttcaaagtaatgctataagagttttagaaacttgttttacagaaaaaaatgtaaattttcttcaaaaatatattgattgaataattaagaggtgagttgctgatgtagtaaaataaagtttgtataaaaaataaaattttattaattaaagacttagctaggtgcagtggctcatgcttgtaatcccagtgatttgggaggttgagaagggagaattgcttgagtccaggagttccagaccagcattagcaaggacaacatagtgaaacttattaaaatggtttattgttatttacataatataaaaaacgtagtatagtcaataaaatattaagaaaatctaggctgttgcgtttatcgagggggaaatctttaccaataaaaatgtcaaatgtaaggacaatacaatttatgccattatgaaacgggaaattggagcagattgtttctgagaagaaatactgttttgttacgtaggacatacaagctcataatttgccttactattatcctaaagttttcattctttaccttgatgattagtttaatatattggcttctcaattccctgataccttcaatgatcttttcctctacttcaccatcaccacacacttccagtgtcactttcatcacttcaaattgtttgattcctaaatcaggccacatcttcttacctttgcagctactttgacctattcagttgcctgctttcggtcatggtgcccactgctctgagctctactttttaatcttcactctaccttcaacaaagcactgtttctcccctggaatattgcagtagcctcctaactcatttccatgaactggctactgggggacattgttcacaatgtctgctacggtctaaatgtttgtgtatgaagttcattgtttaaacccatccccaatattgtggcattaagaatgtggggtctttgggaggtgtttgagtcatgagtcctccgccctcatgaatgagattagtgtccttatcaaaaagacctgggaaggcttgtgcacctcttcttccatatgaagacacacataagttaccgtctatgagtaacaggttcttaccagataatgaatctgttcatatcttggtcttgcacttcccagcctccagaactgtgagaaataagtttcttttttaaattaccaaatttaaggtattttgttacagtagccaaaatagtctaagacaatcataaatgattccttgaaaaatatgagtattttaattccatcctctggattaaaaaactttcattaattctcattgtttttaagataatgttctaatttctaacaaatccaaaaacatataaccactttgtattactttagctttggtcagagattcagagttctcttcagtgtatttatttagatctataaatattattttatcatacttatgtacaaatatctccatgcacttccctttcatatattaggacattattcagtaatttatattttgcctcaccatctacaacttaagatatttgtatatttaccatttccgttaaaataatttaaatagataatacatgaaactataccatagtgagatgtgaagtttgcaacaataatttgttttctgtttcatttacagagaaacatttatcttatttctaaataacaagataggtctggtagtgtcctcctttgtagttatcagaaagcactgggtgttgccacaccacttagacagttactgcaaagtgatacttcaccgtcagttagatcaatatgtctgtgccttcatcccaggaggccagcagggcaggaaattgcaaattagtgatagaatttggaagagcaagtgagattcaattgccctatattatgaaaaagcgtataatgctttcagtttgattttgtagttgtgctaatatttttgtccttaaactgctccttttattttcccttcctctgaaatggaactgaaatcactttatggtatattactattttatttttcttacagctgcttattccattatgtgagttctcaaattctgcttttgacaaactaggcaaactaggctatttagatatgaatcagaaatgtattgaaacataataatataattatcttgatttataataatgccttatatttttaaagtggacagagcttagcataatttttataaaattaaattttcaataattttttctaactctaaccacatttcaataaaatactagtggtttcaaaatcacagttccaacatttgaactgatcagcataatcttcataaattaatataaataaaatatagtgggatttttatattctgttaaaacctattatttataaaattaatttgaaacatttgatttccttccatatcaaaaagttttcagggcatatcttattatccattcctatcttctctaatctattgtcttctctgtttcattattttgggacaaatggtggaagcctgttttttgggaactgagataatagataatgaggaataatttttaattgttgttttcctgcccagcctgcttcaaacctcaacatttggggagtggggaggttagaatctaagaagaatttccttctaaggtttctagaaatacctgagactgggtaatttataaagaaaagaggtttaattgactcacagttccacatgactgggaaagcctcaggaaacctataatcatggcagaaggggaagcaaacacacccttcttcacatggcaggaggaaggagaaatgccaagtaaagaggggaaacccctttataaaaccatcagctctcctgagaactcactatcatgagaacgacatgggagtaaccaccccatgattcaattacctcccatcaagtccctcccacgacatgcagggattatgggaactgcaagtcaagatgagatttgggcggggacacagctaaaccatatcatcatctatcactgcagaattagaaggccaccctgcagaattagaaggacttcacccaaaatttggttcagatgagaagactgatgattctatacatacaccaaaattatgtaaacaggcttattactgaatgaggatttatgggagagcaggacagtcttcctaatttggtccaaaaatgactgataaaaggaaaaatactggtttggaatttttatggtagttttggggagtggtcaaagtgaggttcacaactgcaggcagggtcttacgtagttttgaacctcctgccagcaccagaggagaaagcatcaggctctctcaacagcttgcaacaatgtggggcagaaataggggtgagtcttaaaagttttccatagtcaaacttttgattacaacaactattcactaaatgcatttttcttcccaaagactgaagtttggtcttttttcatatattagctgactgattatatgatatgagaatatgagtaaacaggtcaaaatcatgagacatttgaagagaatatcattgatttcaaaagaaaagcaatatgatggattactgatttcctcagaaacacaactgtaagaacagatggaccagtacttttgaactagcataataaaaatacaacagcataatatatcaagagaaaaatgttagtaatattaaaagtgcatgaggagttaccagaataattatgatccatgaaacattcaataaattcagaatatcatagtaatataacaaaataagcaaatcaaaaaacaagaccaaagaaatatttcaaaagatcacagaaagagaagtaaaattgtgaggaagaactatgtgaaaagtaatcataatgactgttctggcatttaaaaatataaaagacagattgaatgtacgtaatataaagtatactttctaatgtatgaaagagaaaaaataactaacaacccacacatagtagtagcatttaaaagagaaagaaatggagatgacatcagcaaaatagaagaataggaagtcttgggctgcaatctctaccaactgccccaatcccccatgccacccaacacccacagaaagtatagctagcaactatataaaaaccacgcatctttttgaaaaccttgatacttggcaactatcttgagacacccacgtcatttgtggaactgaatgaaaataaattagatgagtaggaattacctcactatgatgctgtccttcatcccctctgaagtcagcacaatgccagacagaggatttccctgggcccacagtttctacattgggggaaagaaaactggaggcatccaatcttccctagcattctgagacacttcccagaaagcccacttcagtctcaactcatggggaacaatggggctaaaggcatacctaaactgcctgaggtcagatagaaacaaaggaggtagagctcttagtgaccagcctacagatctcgctggtatttttgtgttcttgacagctcaatcagtgataccagctgactttataaccactctttaaaactgagctgattgccttcataagtaaggtaagaagttcattttactttgagtctctagatagctaatctccatactttgcctcagagcatgacctaatgaccctgcccaggcagggacactcccacccccatacattttggggaagtatagaggctagacctgcttgacctgagccatcaaatggccactcagccaaaagctcaccacaggcctccatctgagtgagaggcaatcctcagtcatgtatttccaaggagcatagcttctgatcctgcctgtcccaagcagtgactgactaatctcagagcacagcccttagccctgctcaactgcagatcccatacagtagaatttcctggccaggaaatacatctgcttcctagcctgaatagaagggaaagcagtatccagccagcagctcttcctgacagcagaatcttgccagcaattctggatggcagaactcagctagcagccccacctgacattacagcaaagtcagtgaccccatgaattagagaacacataacaagatctgcctgcctgggattgtcaccaactggcctttccagagtcactggctagtttaaatagcaagggtctattcctgccaaataacacttaaaaagatcagaagaggaggccgtctcctcaaattcacagaaaacaatgcaagcacacaaggattatgaagaattagggaatcattacacttcaagggaaactaataaagctccaataatgggccctaaagaaatggagatctctgcaatgactgacaattccaaatattcttcctaaagaagttcagtaaactataagaatatatggataaaaaaatcaagtaaaatttggaagacaactcacaaagtgagctttacaacaaaatagaaacaattttaaaaaatagaaatcccagagatgaggaatgcaatgattgaactgaaaaattaaatagattcaacagaagatgtgattaagcagcagaaaaaaatcagtgagctggaaaacaaaatttacaattattcaatcaaaggagccaaaagacaaaagaatgaaaaaatgtaacgaaatcctacaggaattatgggacaccatgaagagaccaaacttacacaatagaagttgcagaaggtgaataaagagaacaaggtccatagagcatatttaaagaaataagggctaaaaaaaacttccatattctgtgaacagatgccaacatccaggtgtaggaagcacagaagtcttcactcaaatacaactgaaagaggtgttaatcaagacacataataatcaaactaccaaaaatcaaagacaaaaaattctggagcagcaacaaataagaaactcatcacatacaaagaagtgtcactatcagcagatttctcaggagaaacactgcaggccaggaaagagtgggatgacatattcaaagtgctgaagaaacacaagcttttaaccaaaaatactttaatcagaaaattggtcttttaggaatgaggaagaaatagaaactttcccagaaaaatgaaagcaaagggatgtcataaccattacgccagtcttgtaagagttgctaaaaggacttctttaagctgaaacaaaaagctacaaattaataatgatacatatgaaactacaaagctcagtggtataagtaaagcagagccatattcagaatactgaagtactgtaatgatcacaggtaattttatccctggtacaagaattaaaaggcaaaactattaaaactatagctgaaataaatcgtcaagggacacacattacaaagtgatgtaaattctgacctcagtaacataaaatgtgtgtgggaggagcaaaagtgtggagttgtatgcaagttaagttttatcagcttgaaataggctgttttatacatatatatattatatatataatatatattatatatattatatatataatatatatataatatatatatattatatatacatcttatatgtaaacctcatgagaaacacaaagcaaaaattattaggacaaaaaattggaaaggtcaaagcataccacttcttaaaaaaaaaaaaatcaatacataaaggaagacagcataagaggcagaaacaaagtatctacaaaacaaccagaaaacaattaagaaaatggtaacagtaagtccttgtctatcaataattaccttgaatataaatgcattaaattctccaaaaaagaaagtaactgaaaggataaaaaagccccaactatttgctggctgtaagagcctcaccttgtattttaggacacacacagactgaaaataaagggatggaaaaagatattccatgcaaatgaaaacaaaaagaaaagctcaaaaactgaaataggagacgcataagaacatcatatgataataaaggggtcaatttatcaagaggatataataatagtaagtatacatatactcaacattggagcacctaaaaatataaaacaaatatgaaatgattttgagagagagggattgccatacaataatagtaagagactttaatatatcacttttaacaatggactgattattcatacagaaaattaataagaaaacatcgacatgaacaacatattagatcaaatggacctaacagacataaacagaacattccatccaatagcaacagcatacacaatattctcaagcacacagagaacattctccagggtagatcacctgttatgacaaaagcctgagttttctcaagaagtctgaaattatagcaagaatcttctctgacccacaatggtataaaactagaaatcaataatgaggaatttcaaaaaactcacaaatacatataaattaaacagcatgctcctgaacaactaatgggtcaatacaatttttaaaacaataatttaaaaatatcttgagacaaacaaaagtggaaacacaacatgccaaaacttatggaatacagcaaaagaagttctaagaggaacgtttataacaataaatgtttacctaaaaaaaacccagatttcaaacaattaatcttactcatcaagcagccagagaaaaactaaacacaaagataggggaaggaaggaaataataaagattggagtagaagttaatgaaatggagactagcaaaacaatacaaaagattaatgaaactaagcgtcaggtttttaaaaattttaatgtaatttaatttaatttgagatggagtttcactcttgttgcccaggctggagtgcgatggcacgatctcggctcactgcaacctccacctcccaggttcaagcaattctcctatctcagcctcccaagtagctgggatcacaggcatgcgccatgacagctggctaatgttttatatttttagtagagatagggtttctccatgttggtcaggctggtcttgaactcccgacctcaggtgatttgcccgccttggcctcccaaagtgctaggattacaggtgttagccccgcacccagccaggttttttcttttttttttttttaattaatttatttttaaacacaaacaaaatgaacaaacctttagctgtattaacgagaaaaaagactcaagtaaataaaatctgaggtgaaatcagagacattagaactgataccacataatagaatcataagcaactattataaatatatagcgacaaattggataacccagaagaaatgaatatactcctaggcatatacaacctaccaagattgaatcatgcagaaataaaaaatctgaaatgaccaataagaagtaaggagattgaatcagtaataaaaattttcccatcgaagaaaaacccaagacctgatggcttatggttgaattctacctattttttaaagaactagtactaattctcaaagccttcccaaaaattgaagaggagggactctttctttagctcatttatcaagtcaccattaccctgataccaaagtcagacaaggacattacaagaaaataaaactacaggccaatatccttgatgaacatagacataaaaatcctccattatattctagcaagctgaatttatcaacacattaaagggatcatccatcatgatcaagtggtgtttctctcgagacacaggaagcttcaacataagtaaatcagtaactgtgatacatcacattaacagaatgaaagacaaaaaccatataattctcttattagatgcagaaaaaagcacttgacaaaattcaacattctttcatgataaaaactctcaccaaatttagtatagaaagagtgtacctgaacacatttaaggccatatatgagaagtccacagctaacactgtactcaatggtaaaaaattggaaagctttcctttaagatctggaacaagatgaggatgtccactttcaccactcctattcaacatagtattgaaagtccttactagaacaattagtcaatagagaaataaatgaattatgctaagtaaaacaaggtaggcacagaaaggcaaatacatgttctcccttacgtgtagaatctaaaacagttgaactcatagaagcagagagcacaaagatagttacagagattggaggctgggaagaatagcgagattatggtcaaatggcccaaaatctcagacagaaggaagttcttgtttgctcagatctattgcacagcatggtgaatatagttgaaaataatgtactgtaatttgaaaattgctaagagtcaatttcgaaagttctcaccacacaattgatgtgtttgagagcataagtatattaattagcttaattttattacacgttgtatatataaatcatcacatgactttttactccataaatatatgttataaattgtcaatttacaataaaatagtttttaaaagaccaagacaattcaaaaagtttagagagacaataagtcacttataaaggaataaaaatatagatatcaaatttctcaacacaaacactggaaacaaggcaatggtgtaataacttgaaagttttgatgaaagtaacagaagttaaaattgtatacaaaaaagactatttcagtataaagtcatatagccactcttctctagcctacaagtcttcagaagctttgctgcacaaatatccacaatgaaaaaattttgtacttggttaatatttttaaatcagtttttattttctatttcaataatatattacttattttaaaatattttaaaaaccctaacaaaatatacgtttttctattcagatcatcaggaaaagacaaaaaataaataacaaacgtacaaatgaaaagatactaactacatacaaagtagagattttagtgatagtatgggaatagtatatataatttttaaaaattaggtaaaattgatacacttttgaaataacacaatttatcagaatcgatttctacttaatgcatatttattaaaaatatggaataaaattacatttaatattaaaatattggaagcaatatttttaaagacagaaacaaagttatgaagtccacaatgaacatttctgttcaacattgtttcaaggccctacctcaggcaataccaagatgaagataagaatataaggattgtaattgagaaaaaaaagttatttttccatatgatgttatttacatacaaaacaaaaaagaatccacctacaaattatttgatataatacaagtgtttaacaaggttgtagataaaaattgatgcatagagacaattagtacagaaatttcagttgcatttctatacaaaggcagcaaactagaaagtttaattaaagataatatataacttaaaattgtatgagagaatatcaagtatctaagaataaatatatgatgtaaaaaatacagagaaaatgatacgaattagaggaaccaattaagacgtatcacgttcatgggcaagatgacaatagtgtgaaataatgattctttctaaattgatcagtgttgttccaatcaaaattccgaagtaattatttataaaactcaagaatgtgattttaaggtttttgtggaagagtaaagaacaaagaatatataagatgctcagaagaaaagaagtgatgagatacctgttaaaccagatgacttaactcttgagctttggttattcagtgtggcataggtgcagaaacagtcagaatgctgagaaacagaaccatgcttgtgtggaacctcattatatgacaaaattggcatgccatatcaatgccacagagaaggggctattccacaaatgaacctgaaaaacatatgaaaaaaattgaataactcatatattgacacaaaaaattaatcatttatgtaaaaatgtcaaaaaacgtggctaaaaatataaatgaacatctattagactcaagtaatacgtgttattcataaaaggttggttataacaggaaatgttgtgtttaattatattaagagaattaattcttaaaatgttatcataaactaagcaagaagctaggttacaaacttggataattgtacacaactagaaaagtattggtgttaagaacacataaagaactcttaaaaatgaataaggaaatgctaataattcaatggaaaactgccaaaagacataagtagatattttgcagaaataaaaacacatgtggtcaataaacatatgataggcaataacattactgatcatgaagattccaatcaagatagccctctgatgccattttccacctattgtatcaccaagaatattaagtctggaataacaatgttggagaagatgtgtatctatggtgtcttgatatatcactggtggaagtatacattagtaaaccagttttgaaaatagttttattttctaaacaatcaaaattaaaatatttatgcacttgaaaacccagccatatttggtatatatccaagagcaacacctgcccatgtacacctgtttgcaaaataagagtgaaggataatggaaaaaataatattgatggtggtgctgttcacaatagcaaaagtctagaaacaattgaaatgtgtatcaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccaggcgcggtggcgggcgcctgtagtcccagctactggggaggctgaggcagaagaatggcgtgaacccgggaagcggagcttgcagtgagccgagattgcgccactgcagtccgcagtctggcctgggcgacagagcgagactccgtctcaaaaaaaaaaaaaaaaaagaaatgtgtatcagtgggagacttgatgaagtaactgccagatagtcatacgatgatacgagttttgaaagaaatataatggtacacaacaacatggatttatcttgaaaaatatagaaaaagtatgttcctaaagattgcatgcatcatgaaatctttcatataaagtaatacctgactataaagaaagtaaggaaaggacaagcatgggaatggaaagattctcaatttgtctcagattataaaatggagaggtaagattgaaaggaagcttttggtttgttttaacttttctttttgagtggtagatttatggagcaaaagttattattaaaaattactaagtaaataaatataaagcagactatatataaacaaataaccagaatatatcatgcacaaaagtttaagattatttcaatgattggtttttgaggttcaaaaataaatgattacagccttagcaattttaggggatggctaaatgttgactttattatcttaccactaaacatctggtaataaatgattctctattctattccaaaacctattaaggcattttgaaattacttaaaatttatttctatagaacatgaattaattaataaaaatgttcaaaatttacaccatgcacaactaagagaagttagctgttttgaattgaaatacgtgtcttttttgtaacagtagttttttagaagttgttatatgcctaatgttcacaggaataaagttaataaatctgtctttgccactttttccatgcattctattaataagtcttgttaccaacattttaacacatattttatgtttgaccttgtcaaaacgcaagtcatcatgtggtgattacaaagtcatatgtgccctgaacttgtaggctgtaaagcttttgctctataacttgacaagtaattctgataacaagttgtactgatatacttttccacaaagaaatcacgctatttcatattaaatcatggattctttataattgctacttcctattgatacaacaacagtaatataactaagattcatacaacttattttaaaaatagttgaaagcatgttaccacaagttttgctccttttcccatgttatcagttactaacaggtgaaatagattattttgataattttgactaatcaacagtagtaatgagacaaaaacccattttgcacaattttagactaacattcgtaatttattccttaattcatcaagtattacagagaatttactatgtagctagaagtattctagtcattgatgctggcgattctttctaatggctagagcaagaactaaataagtaaacaaacatataaaactagatactggtaagattcaaaagagtgcataacactgaatgaattgggaagctactgtattctgggaggtcagagaatcataaccgatgagatgggatttaagctgagatctgactcacaaaagccagccatgcaaaaaatgggggaagagcattccaggcataagtaatactcatgcagaggtcctagcctgaaaatagtcttagagtgccagtgaacattttctgtaaaagagggggtggtattcaactggagaggagtagagtaagagaagtgactgatgatgaagggagatggaattgagttacctccttgaggagcaattaatagattgaagtaggatttatgcatattagctttaatatataatttaatattaaattagctttaatttaatatttaataatctgcataatatgcagattagcataatatttaattatgcagattagctctatgcctaaatgttataaaaatctgttattaatgaaattagtatatatgtatacatagatgtatatattttatctatttgaagaaaaattattctcattaataatttaagttctcttggaggttttgtggtttgttttcattataactggattttgaggactggaaaatcaaaattcaatactcaatgaagaaaatagtttatataaagctaaaaaaaaaaagagctccataaccttattatattttaagttatctgaggaaacctcatctgaatctgcagtattaaaacctaaggacactgctccccctgcagactctggctttatcgcccttgtcttcccaaccaccagcctggagagggagcattccttcttgatttgcattgctgcttacacaccattgagcctctgtggggcacatgccatcaaattatatcatatgttcccctcatttttacagtgatccccatgctccctgtttttcccctttatttattgaagattttgatacctgccttgctgtatttctctctaaaataatttatattccttttttgatgatttcaatacctacctacataatgaattcaacatgctgacttctttatttcttgtcccccattaacatcaaccatccactgcatgggcatatgttagattttgtcattaccaataagacccataccccaaatttcaatttcaagcacccgctcactactcaccacctccttcattctatgtctaatactgtcaatgaaactattatttgattcctctagaatctatcattcattgaccctatcatttttttttttttttttttgctaaattgctttcctcgttttcctcattattttacttagactcacatcgtctctttatgatcactaccctgaatatacaaactcctttgaccctctttcccatcatcatttctatttggcaaaacttttaccctattttagattctctaccactggccttttctttctctcacaggggataacttccctgctcgtttccaaagtcctacctggccagaactatccagtgtactcctaatgtattaacaatttaatttatttgtttgtttatttatttcacaaatgttattgagaacacacacacttagtccataacatgaccaaaatagcaaggtgtccagggtggcgggagaggaatgaaccagagaaagagatgtgggaaataagagtaggaggagggaaacctagaccaagtgggcattgtcggccctattaagttctttagctttaactcagagttaaaattagagctattgttggcttttatgcagtgctattgcagtatttggctccagagtagcaaaagtcgaaacagaaaaaccagttaagaagttatttacatattccagatcagaaataatagtgtcttagaccagaccccttacttggagaggtaagttgtggaaagttgttggactttgaatgtattttaaagacaaaggtaaaaagatttgttgatggattggatataggtgtgagtgaaagagaaggtctcagatgactctatggtattcagcccaagaaattagaaggagggaaatgtcattttcagagaagaggaaaaaagagtggaccaatttttatttattttttgctttaggtttagaggtacatatgcaggcttgttacgtaggtaaacttgtagataaacttcacagaggtttgttgtataaattatttaattatccaggtactcagtctagtactcagtagttatttgtttgatactcttcctcctccccactccaccttcaagtagaccacagtgtcttttgttccccatggtctgttatgtccatgtattctcatcgtttagtgacagtttacaagtgagaacatgtggaatttggttttctactcctgcattagtttgttatggatgatggccttcaactccatccatgttcctgcaaaggagttgatcttgttctttcttactcttgcatggtatttcatgatgtatatgtaccacaatttctttatccaatgtatcattgatgggcatttggattgattccatgtcttcgctgtgttaatagtactgcaagggacacacatgtgcatgtgtctttatggcagaatgatttatattcctttgggtatatacccagtaatgggatttctgagttgaatggtagttctgtttttaactctttgaggaattgccacactgctttccacaatggttgaactaattcacactcccaccaacagagtaaaagtgttcctttttctctgcaacctaactagcatctgttactttttgactttttaagaatagccattgtcacttgtgtgagatggcatttcattgtggtttttacttgcatttctctaatgatcagtaatattgagcattttttcatatgttggccacatatatgtcatcttttgaaaagcgtgtgttcatgtcctttgcacattgtattagtccattctctcattgctataaagaactaccagagactcggtaatttataaagaaaagagacttaattagctcatggttctgaaggctgtataggaaacttagtttgggaggtctaaggaaacttaatatcagggcgaaaggcgaagaggaaggaggcacatggccagagcagaagaagagagagaggagaggtgctacccatgtttagagaattcactgactatgacaagaacagcaagaggaaaatgtgcccccatgacccaatcacatccctgcaggcccctcctccagcactggggattacaatttgacatgagatatggggggggacacaaatccaaaccatatcattctgcacctggcccctaccaaatctcatgttcttcacacattgcaaaataaaatgacctcttctcaacagtcccctgagttttaaatcatttcagcattaactcaaaagtccacagtccagagtctcatctgaaacaaagcaagtcctttctgcctgtgagcctgtaaaatcaaaaacaagttaattacttccaagatataatgttggtatagacattgagtaaatactccctttccaaaagggggaatctgccataacaattggctacaggctccatgcaagtccaaaacccagcatggcagtcaactaaatcttaaagctcccaaataatctttattgattccatgtctcacatctagtccacattgatacaaggggtgggctcccaagtttttgggcaactccacccctgtggctctgcagggaacagaccctgtggctgctttttacaggctggcactgagtgcctgaggcttttccaggtacatggtgcaagctgttggatctactattcttgggtttggaggacagtggccctcttctcacagctctagtaggccgtgccccagtggggactcggcatggtggctccaaccccacatttcccctgtgcactaccctggtaaaagttctctatgagggccctgcccctgcaccagacttctgcctggacattcaggcatttccatacatcctctgaaatctaggtggaggatcccaagcttcaactcttgctctctgtgcacctacaggcttaaccccatgtggaagctgccaaagcttatggcttacacccttgggagaagtggcctgagacatatctgaagtctttttagctatggctagagctggagcagctggaacacaggaagcaatgtcttgaggttgtttagggcagcggggccctgggcccagtccatgaaaccattcttccctcctaagcctctgggcctgtgatgggagtagctactgagaaggtctttgaaatgatttcaaggcatttttttttcattgtcttggctattaacatttggctcctctttacttatgcaaatttctgcagctggcttgaattcttcccctgaatgtgggtttttcttttctgccacatggctaggctgcaaattttccaaacttgtgtgttctgcttttcttttaaatataagtttcagtttcagattatctctttgctcacaaatataagaatatttgctgttagaaggagccagaccacatcttgagtgctttgctgcttggaaatttcttttgctagatatcctaaattatcactttgtagttcaaaattccacagatctctagagcagggacataatgccaccagtctctttgctaaagcatagcaggaatgacctttactccatttcccaataagttcctcacctccgtctgagactacctcaccctggactttattgtccatatcactatcagcattttggtcacaacaatttaacaaatgctaggaatttccaaactttccttgatcttcctctcttcctctgagtcctccaaactgttcctacctctgcccattacccagtcccaaacgtgcatccacattttcagatgtctttatagaaataccccactcccagtaccaatgttctgtattacttcattatcgcattactataaagaactacatgagactgggtaatttataaagaaaaaagctttatttggctcatggttctgtaggctgtacaggaaacatggctggggaggcactgggaaacttacaatcatggcagaaagcaaagaggaaggaggcacatcttacatggctgaagcaggaagagagggcagaggtgccacaacacttttaaacaatcagatattgtgagaactcattcactatcacgagaacagcaaggaagaaatctgccaccatgattcaatcacctcccaccaggaccctcctccaaaacttgggattaaaatttgacatgagattggggtagggacacaaattcaaaccatatcactcagtttttaataaggttgtttgttttttttcttgtaaatttgtgtcttataggtgctggatattagacctttgtcacatattttgcaaatattttctcccattctatatgttgtctgtttactctgttgatatttccttttgctgtgcagaagctcttaagtttaattagatcgcattttgtcaatttctgcttttgttgaaatttcttttggcatctttgccaaagaatttgtcatgaattattttccagttcctatgtccagaatggtattgcctagggtgccttctagcattttaaaatccttaacaaaatacttgaaaacccaaactgaatctagccgcacatcaaaaaatcgaatccatcataatcaagtaggctttatttctgggatgtaaggttggttcaatatatgcaaatcaataaatgtgaatccatcccataaacagaactaaagataaaaacttcatgattgcttcaatagatccataaaaggcttttgatagaattcaacatcatttcatgtagcaaactctcaataatttacatattaagcaaacatacctcaaattaataagggccttatatgacaaaccgacagccaacatcatactaaatgggtaaaagctggaagaatttcccttaaaaactggcacaaaacaaggatgccccttctcaccactcctattcaacatagtattggaagtcttgatcagagcaatcaggcaggataaagaaaaaaatggcatccaagaaggaagagagaaagtcaaaccatccttgtttgcaaatgatatgattctatatctagaaaaccccatagtcttagcccaaaagttacttcagctcataaacaacttcagcgaagtttcaggatacaaaatcattttacaaatatcactagcattcctatgcatcaattttttaatactctgacccagtagataattagcactgtattgcagagagcaaataaatagcgtatgttacaaaggtctcaaatgtaaatgcctatggggcaacctagtcacgtaagagagatgtgagcttgacataaaataacaaatgacaattcaaactcagcctctatgccagggtgacaacaaggaatgctggacactgaaatcagaactattctcttagttgtagcagatggctgccatatggaaatgcagccattgtcgctgaatctgccatttacttaaggaaaacaatatctccatttttatggaaatattcttaatttttaaaaataatggttgctaattcaaataaaggaaaaaaaacaatggatgctaaagaaaacctttggtcacatgaagtctacatgccacagcttgaaacatcttgtgggtcgggttggggggacctgtgaattagagttggaatcagaagacctaactttgacttctatctgatcaattctattgctgtcttacctggacccggtcatttagcttgtcactgacttggcctcctattctggaaagttaaaaaggtagttaaattctaaagtctttaagttgctttaagatatatggatctagattttgaccaatagccagcctgtgggtgatcaaagctagcaggcttatgagagagcatgagttgagcgggtaagaaaggtttttctgttcccaaacacctgtctactagtacatcagtgtctgaggaggagtggaaaatgggacttagtgggtgggtttggaggatcaaccatcacagagcacttgagtactgagatgcaggcagctaaagaggaggataagattcttgccttttaggagtggaaagactgcctgagaagaaagagggtgctgataatttatcaataaacagaagccaaatatctggctcaagaaaacctcaacagattatacaattatatgtaatgactcataagtggattagctggtaagaaaagtcttacttctcagtgttctgcttggtgtttctttacctgactggatgatagcataagaagctaatgacctacagctaacgagcttttgtaacataaatgtaagacacccaggtttaaattcaaattttgacttttttctatagctcttaggcacatttaaaaaaatcctgtagatgcagattcatatcaaccatgatactaggatcaaaaataagaataactattattactactattaactctttagcttgggtaaaagtcatacagataattaaacaatatcttactacttcatcctctcatttacccagtgaaagttttccatgttttataacttcaagttgttgtttcagatatgtttgttgagtttgtgcatccattttgcagtgttttccttttttattagactgtaagaattgcttcttttcaaactgcgtccaagtccatggataaagaagctggtacacagtgggtattgttattatactgaaggaaattagaagtcaagacaaatttatggaaacattataagtgaaacttttgataaagggttaaaagatcctttggtcttattaagatatgacaacaaagagactattactagctcctttcagtctccaacaagggaggcaaacatgtttgaaaaactatggcaagattttgttctatgacgaaagaaattgaagaaaattccagttacctgtctcagttataagtgagggttatatatccttcttttgtgaccactgtcactaaaaattcttcccctgcctttgaaaatctcagcacataattcacctcagcagaggcataggttttgatggccctttggtttctcccattgccaggaacccaagtgcaagtcttagaaggtcttgaaaacataggaaacattttcctcaggcttgaaaatccatttgcccaattttacacttctcttcaggttaaaaacaaatctctgtgttgttaggggtaaagaatatctccttagttctttggtcaatattactttaatgcaggttatttaacatatggcttgtgcttccacttctgtccaaaatagattaataggggccttggctcactgcctggagttttcaggctattgcacaggacgggaaacctcgtcagagcctgacagtcttgcagagttgaggaagaagagattagagtttacagaggccaaaatggccagcatttgtggagcagactaccagagaggcaggagtttcacagtcagaaggaaatctgaagagagaatccccttaagcctttgggtcaataatgatttgcaaaagcatgagaggtaactaccaaaagtggggctgggtgttggggggacacttaaaagtaataaaacaattcccacagggctaggaatagttgttgtttccaccagctagagtaaaaatcttgtaatacatgtgttactgggctactggatagaattgtcagaaggttatcatcttaagaatttggccctagaccagaggtccccaacatttttggcaccagggaccggttttgtggaagacaaattttctgcaggacggagggtagagggagggatggtttcaggatgaaactgttccacctcagatcgtcaggcattagttagattagattctcataaggagtacacaacctagatccctcgcatgtacagttcacaatagagttctctctcctatgagaatcaaattctgctgctgatctaacatgaggtggagagctcagtggataatgcttgcttgtctgctgctcacctcctgctatgcagcctggtaccagtccagggcctgggggtttgggggacccataccctagacaaaagctatttgtacctgctttaataaaacttaagtgcaagccttgaaacatcacttgattttgggtaacttaactgaatgccagaacaaaggttaacatcatagagggcataaaaatccagcaatgaacaatgtccagcatacaattataaatacagaaaagcaaagaaacagaaaaatattatgtatattcaagagatagatgatagttggatataaacagatgtagagctgaaaaagatgattgaactaagacaagaatgccgaaacagtgattataattattcctcacatgtttgagagagtagaggaaaacatgctcatgactaggagagaaattgaagatgtatatattttttaaaagagctgagaagaattttattaagcatataaattggtaaattgaaaatcaagcctaaaagagaaaaatctagctacactgtatgtcagaaattatgaatactgtggaattcagaggaatgcatgggtaatagtctgcaaagataccctacagggtttatctgaatatatactaatttatcttttgctctccagtgaggaacactatacatgatataaagttaagtacccaatattttctgaagaaacgctagaaatacacaatggcaattgaattatttccagctatcataaggtgtgaagtttgttttaaaataatagttttctaattttcataagtcatagaagacactaagttcagatcttgagattatgacatatttgtacttttgagatttagcattcaagtttaaaaggcatttttggccaggcgcggtggcttacgcctgtaatcccagcactttgggaggccaaggcgggtggatcacgaggtcaggagatagagaccatcctggctaacatggtgaaaccccgtctccactaaaaatacaaaaaattagccgggcgtggtggcaagaacctgtagtcccagctactcgggaggctgaggcaggagaatggcgtgaacccgggaggcggagcttgcagtgagcctagatcgcgccactgcactccagtctgggtgacagagtgagagactccgtctcaaacaaaaataataagtaataaaataaaatacaataaataaatgaataaaaggcatttttatcttttccacctttccaataaaggatttagcattgatcttaaataggtttgtaagagacttgctatgagtcaatgtttccctttgtttttaccaatcagctccatgagaataagtaataagaaattggtggtttgcaagttttgtaaactcttttgtacacagttcaaagagatttccttaaactcttttcctctgtcatagggagtatatccccatgtgaataatgacacaaattatattctgtaagcaaaatacataaatacagttacgtatcacttaatgatggggctaccttctgagaaatgcagtgttaggcggttttgtcactgtgtgaacagcatagagtatactgacacagaccttgatggtgtagggcactacgtacccaggctgtgtgatatagcctgttgctcctatgttacaaacctgcatagtacgttattgtactaaatgatgtaggcaattataataaaatggtaagtatttgtgtatctaaacatagttaaacatagaaaaggtacagtaaaatatagtagataaaaggtgttacgggtatatagggcatttaccatgaatggagcttgcaagactgacagttgctctgggcaggttaatgagtgagtggtgagtggatgggaaggcctaggacactacactagacttttaaaatatctttctttcttcaatgataaattacccttagtttactctaccatttttactttctaaacttttaatttttaaaactttttgactcttgttataacacttggctgaaaacacaaacacattgcatagctgtataaaaagattttctgtctttatatccttattctacaacctttttactatttttaaattttttcttttctttttttttttactttgtaaattttttgttaaaaatctaagacgaacacattagcctaagtctacactgggtcaggatcatcaataccgctttcttccaccttcacatcttgtcctactgtggggtcttcaggggcaattgcgtgcatggatctatcattacctacggtaacaatgccttcttttggaatacttcttgaaggacttgcctgaggctgttttatagttatcttaaaaaaaaagaaaaaagcatgcactcaaaaataaccataagcagcacagtataacaaatatttaagccagtaacatagtcacttatcattatcaagtataatgcactgcacatcattgtatgtgctatagttctatacaagtggcagagcagtaggtttgtctacaccagcatcaccacaaacacatgagtaatgcatcctgctatgatgtcacaatggtcatgacatcactaggtgataggaatttttagctgtattatgattgtatgtggccactgtcatataggtggtctgttgttgaccaaaacattgtatttggcaaatgattgtagatattacaaaagacaacaagtaaagctttgagattattcattaaaaataacatttgtagcagcaagattctctgtattctaattctggtcttgcccggttctctcatttattctccccactatgatctgagagattttccaatttaaaaatatttttgtattccacttgcctagcaactcagtactaggaggaatggatccctcatacataactttgatacaggcaaacacaactaatggcaatctacagtaaccttagcattattgcatgattaagaagtttatttttctgaaattctttacatcttgagtgcactagtagatgttaaaacatcttttaagggtaattcagatttctttatttttaaacatgtattatctgaacagatattctcagatttgggtgctatcgtggctaaggccacgagcatttacagctacggctgttccattaaatatttgtcagagaaaaagatagaggatcactttccttcatatgcctagtaacttcatcactacacttaagaaaaaatgtcacttcaacatcaacacaaatttcattttttgattgaaactctgatagtgttattcagacattggcattaacacttcaagactagtgcacatatcagagatatgaatacaattttcttatttgaaaagtaaggggattttggaattgacctattgcaaaaatatttaatttgcagattacttggtgtactttcagcattattgttacctaggtttatttttcttcaaagcatagtttgaatttgtccagactgaattcttattttatacctatttcagacaggacagttatgttaaccatctattcaatttgttaccacacgtcaaagtctgcactagtaaggcacaccaagaaacaactaaattcaaaatggaaaatgggaaaatcacattaataaaaaaatcctcgggcagatagctggttatactaagctatctgcttttaaaacagggagtggcattttcatagctatgagacttcatttattttatgttccatgttattttgtatattttgtaaatgatcttaatattacatgcaaacaatatttaattttaataagcatgatgctttcctttagagtgaccttctagaagatcttagatcatttacacagaaaagcctgttgccataaaacacctctgtgaagaattttctttgtaatggatttgcttaccaatatcttcaacaacaaaagcattttgttattttagcttttgtccaaacttttgccattttttacctgtttcatattagtgatgtaagggtgagattggtaagagatattttgtacccaatatatgacaaagttagtgataatgccatttttatctgccgtttttatctgctgaaaataattttaccatttttaccttcatccccaaagatctaaaaactctaaatttatatctttatctaactgtgtaaatagaatgatttaacgtgaagaagtaaaagatttaaaaacatattttcccattccctccctcacttgtaaggcaattttgtgaaaaacacaatttcccttgagtgttagtgacctggaatgaaatataaaaaattggaaggtgctgagttttcctcagtactggaaatgaggacggtgcaggtgggtggagttccaagatagtccttcttctgaagttgatcagttacacttttgggaatggtcaacagtaaacccttcaaattactgaagtacagacttttgtgtctgtgtgtgtggcgggggcaggcggtgaggcagagtttcactctgtcacccagcctggagtgcagtggcatgatctcggctcactgcaacctctgcctcccggattgaagcgattcttctgcctcagcctcctgagtagctgagattacaagtgccctcagccacgcctggctaatttttgtatttttggtagagatggggtttcaccatgtaggccagtctggtctcgaactcctgacctcaagtgatccgcccacctccgcctcccaaagtgctgggattacaggtgtgagccaccactcccagccctaaaaccttttactatcaccagtaaactggaggctatactcctagcctcagaaatacaactctaaagattaaatagggctgggcgtggttgctcacacctgtaatcccatcactttgggaggctgaggcagaaggatcacttgaggtcaggagtttaagaccagcctggctgacaaggtgaaaccctgtctctactaaaaatacaaaaattagcccggcattgtggcaggcacctgtaatcccagctacttaggaggctgaggcaggagaatcgcttgaacctgggatttgcagtgagccaagatcgcaccactacattccagcctgggtgatagagcaagactgtcttaaaaaaaaaaaaaaaaaaaaaaaaaacctgaaagttaaaatgtggaaatgctattttattttgaaattttgatctcaattatgaaatttgtgatagttttgaatagtacatgtgcaaaatacaactcaaactgctgtaaaagattgtattaactttatgttcctttgaaggcctggtatatgactaattaagttaactgaagccgggcatatgcatttttgtaggaagaattccctttggttttctagggagaagggtagttattggctttctgttaccattttttaagtatgagaagaaaaactgtgaagtggtgcagtcaagcatgagtctattgcattttctctccagctgtatactgtcttactggtatttgtcaaggtaatgtttggatgtattcattcacaaaagaaattcgttcacaataacaaataagatgcaatctctattctcacaaagatttcaattagtaaaaaagatatgacagttaaacatcagctgtgaatatatcatcaatgcacctttagaactgtatttagtttctttttgtgtatgttgtgtgtttttgagacggagtctttctctttcacccaggctggagtgcagtggtgtgatttcagttcactgcaccctctgccttccagtttcaaacaattctcatgcatctgcctcctgagtagctgggattacaggtgtgtgctaccatgcctggctaattttttttgtagaaatgaggttttgccatgttggccaggctggtcttgaactcctggcctcaagtgatcctcccaccagggcctcccaaagtgtgagattacagatctgagccaccaccttcagcctagagctgtttttaatgttttagttgttgttttctctttggtattaaatatagtaaattgaacagtatgcactcaataagcaaagcctgaatgaatgatacagtggagatgaatattacaagctattgtaggaaaactgctttatgaggcttgaactattgcttgatgaatgtcaatataaatgaataagtggtaatgacaccaaatctcagatcttcgtatcataaaaatgcttgcaggttactgcctaatcacacaccattaacatttcctttccttacctttgcctgtgttgtattacatatagtaactggaattaatttttatagtgtattttttcaagataccgaaataagtcctctaccaaaggccaacaagaatttactatctacttttaaatgttaactctacaattctattaaggaaagtcaacaaatagttaataaacctgtgcagtatggtgcttatatatgattcatctcattagtgtttttaggcaggttcacttttaagaccactttagtaatactctccttaaattgctccttctctgttagaatcactaaaaccatctttcaagtcaaggctgattggtttcttagaaaattaatttgattaaaacaaactcagaaatacatacaaaagatgaataggaaatatcttgatgaaatgcacaggaatatctgcaaggtcaatgtttcatggacatttatttaggagaagtcattaaaaatgtattttttcctagtccgttgtgacagtatttggttcttaggtgcatgagttttagcaggaggattgcattattcaccttctgagccttgacagaaactgcttattttccgtaatgtggtcaatacatgtgtagtttctgaactgtaaaatccacagagaattaatactttgcagttattgctagatgggataagcaagcctattatgtcagcaaaattgatgattccttaatatgggctaaagtctccacctacttaattttctctaaaaccaagacattagtggtttgctttaaagattcaaagatacaaagaaacagaaaaaaaaaacagcttgtcaatcatctctatctaatattctgttaaatggaaaaaatatatgaaaaattaactcagagtcacttccatatatgattgaaaaaatagtaaattttccatttactagggatttgtttagatgttttactcttttagaaggcaactactgtacatagtacattgaatgtatcatgactttacccaaaagagtttaattttttataagatatattttatatgattagtttattatattttgttggaaattcatattgttttcttaaacatgaaaacttatatttcagaacacatttcttttggtaaagatcttcttggctgggcacagtgggtggctcacacctgtaatcccagcactttgggaggctgaggcgggcagatcacctgaggtcaggagttcgagaccagcctggccaacatggtgaaactccgtctctactaaatatacaaaaattagctgggtgtggtgttaggtgcctgcagtcacagctacttgggaggctgaggcagggataattgcttgaacccaggaggcggaagttgcagtgagctgagatcatgccactgtactccagcctgggcaacagagtgagacaccatgtccaaaaccaaaccaaaccaaaacaaaacaaaaagaccttcttgtttttcatcaccaaaaactgtttagcattttgtttctttgcatttagtatgttatttcattgtttgtgaactaaatgtggtaggcaggattttggcttccatattctttatcctctgctgttatttctgtgtatgatacattacatggcaaagggattttaagaaattatggtgatatcttagaatgattatcctggattatctggtgggcccagtgtaatcatatgggcttgtaaaatagaagaagaaagcagcagtatgctttcagagtatcaaaaataggggtgtattagtctgttctcacacttcttataaagacatacacaagactggataatttagaaaggaacgaggtttaattgactcacagttttgcatagctgggaaggactcaggaaacttatgatcatggtggaaggtgagagagaagcaacgcatcttcttcacaaggcagcaggaaggagaagtgctaagcgaagggggaagatccccttataaaaccttcagatctggtgagaactcactcactatcacgagaatagcatggaggaaaatgcccccatgattcaattacttacacttggtctctccctaaacaagtagggattacaattcaagatgaggtttgggtggggacaaaaatcctaaccatatcaatggatgtcagaaagatgtaatggaagaaatagcagcagggtctcaaagaataagagagactcaatcttccattgctggctttgaagataaaggaaggagcttgggacaggaatgcagatgacctctagaagtggagaatggcccccaggtgacagccagcaagaaaacggtgaccgcagtcctacaatcacaaggagcttccttctgccaacaatctgaatgaacaagaaagaaatcctcccctaggttctccagagaggaacacagccctgccgacactgagttcagccttgcgacactctaggcagagcacctagcagaggcctctgtacttctgacccaccaaatctatgagatgatcatgtgttttaagaggctaaatttttggtaatttgttacagcagcagtagaatactgttacagtggctttcaatttttttaagaccctagattgcaaacttttagcaaaaagtttatcctctgtgaaacagaatattatataatttttaaaatgtgaaaatcgatagattgtttcaggatattacaaatatctgtaaacaaccttcatcttccaaaaacattactaattttaaccaagctttttatactctttttatgatatcagtgacactcccctcaattaaatagaattattttgagtcaaactactgcttgttgtgacgtttgaaaattataatatagatcagatattttatttttcattcgttggattccacttccctttactgaaaatatttgaggtgggagtaaatccactaaatgccacatgccaaatatgtgaccacaaccttgaccttgatatatttctgtcctatttttctgtagagtatctttttttgtgttgaggccaattgtattgggagacagagaaactaaaaagcagaaacattgtttgagtactgtgggctcaagtaattactctcaggctgaaagatcacttcagtcattgttaagaaaagctatctgaactgggtgaactccatgaacattttcagttactatttttgtgcctgtattatgttatagaacaaggaaataactccattattacaacatgttgtctgctccttgttttaaagtttgtagataatatctgatataaattatatcactttgggattatttggaagcagaatatttacactgtttatttcacaatgtaagtagtaaatagtaattggttttaaatctagggcagctgtttaagtatatatattattttgttcccatttccaaagctaatagattacatgtgagtaattccttaatatagctttctccaggcttcacaaagcacaggtgtcaacacaattggctaggtcaacacatgaatacctagaacacattctagttttattatgttaaagcacatataaaactagtgtgaaagaatgatttaaggaaaaaatagaaaaatgggtagtatatttgttatgctaatgtgcactgcttttactattctgttgcagatttctatgtgatcgataccagtatttctccataaactatagattcatgttctctctgtagaaatgctagccattgtccactgaaccaactgaagccagtaaatcctaccaacagctactctcttatctttgccatcctgcaatgattctaagttctcacatgagaagcccagggagaactcctgggtcttttgagtccaaacttcttaggaagcttcatctttgtattttgttttctggtagatgctttattcatattctgtgattataaatcgctgtctaccttccaggcattcatatccctgataatattctgttgttgaacatatctcatggaaaaattcttctacagcacagcatgaggttataaaactgaaattgtatacatcacaacatccattcaaatgaaaatttcaatatagattaatcgtaatcagctccagctagtttcattttactctttctaaaagggacaaattctgccacaactatccaaggtcacaataatgtcctttcatctgattaacagtgtaggaaagagaatggttagtgtcataaaactgataaataattcatagtaatgattggtataatgttgctagatgtagttactaaaatgccattcacattttcttggaattattcaataattctattaatattatagcatactattttgaccttgagttgccatatcctataaatgaaacaaaacctgagctttgaaatgaactttattttattaactctccataactatagaatcgaacttgataaattcttcctttagctaaaagaaaccatggtatagtttcaaaccttatttaaaaatcacactgctataaaccagtagaaactttcagaaatagggtaacattttcttttatgagtttagattccttattaagtgaatatatcacaccttgaattggatgagatttaataaaatgagctctcttaccctggtatttctattccatagctgggagcagtaatgggagactctgatttatagtatatactgatttctgtaatgtaaatacttccaaagtgactgatttcagactatcaacatgatgtcactgaactctagttaataagatatatatatgcacaattggctcttcctacctagtaggagcttcctcctggataaaaagtacaccatggaatactatgcagccataaaaaatgatgagttcatgtcctttttagggacatggatgaaattggaaatcatcattctcagtaaactatcgcaagaacacaaaaccaaacaccgcatattctcactcataggtgggaattgaacaatgagatcacatggacacaggaaggggaatatcacactctggggactgtggtggggttgggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaaaaaatagaaaaaaaaaataaaaaaaaaagtaaaatggattgttgattttcttgcagtagcaagaatctgtttaggaagattctatgggatggcagccttaaatagttgccttcccttagaatattatatccagatttaaggatataatacttgagttcgttgcagtattttgacatgtctgcctgtagcaggccaatgcctattaccagctaaaatcccaaagcatgggtattttacttacaagatcaaaggtagataattaatgtgttccctagggggtggattatatagtcctaaagactagtgagagtatctttggctaagggagcatctttgaaagttttgtaaattttaagctaaagatattgtcttcattgcaaactttacagaagattatgggtgacaaggaaatgtcattttgagtaatgtcttacagagtctcatagatttttttaaggcgacttccttggtgtgtgtcttggtcacttgatatgaaagttgaaatattctagcttggaaacacaaaattaagcagcattttggtaactgtaaaggctgtagcctttcagtaaagaaatgcttcaactcatcttaaaaatagacatacaataagtaaaacctcatggagaatagaagctggataaaatccatccgaaggtgttcaaagtgcctcagcaggctttggtttctcgctgtatcaatcatagctcaaccagagaaacaggcctgtatatgatatatattaagagatttgctgaaaggaattggcttactcaattgtggattctggtgaggcaatctgaaatctacagggcaggctgtcaaaaacggaaggcttggactctcaagcacaggctgaagctgttgttcataggcagaattttgtcttctttctgctcttaaaaagctattcaaatacttgaatcagacccactgagataatttggtatagtcaactgattatggcatttaatcacatctgcaaaatacctctgcagaaatacctaggttagaatttgattgactacctgagaaaggtaacctagccaagtgttacataaaaaataccatccattgtcaagtcttcctattataggttttttgcggagctatgctaatgggagacacattattggaaaattacctcacatgtctttttaaagttgatttaaaatagtaaccaattttagtgtgtactatgatgggtagtttcattgagaaactttgataatacccatttgaaatcatctggtgccagccgggctctgtctatggagtactagagttgagctgaatgaaggacacagccatataatttccattcatccttttcagaatctggggctaaactttgatattttataatagcatcttttatttcttcagagatttattctttgaggatttagttgagatttatgaggttggctaagctgttttgcataacgatctggtggagcatattctttagcttccatgtcatcaatttttgcatgggcttctcatctgtaggaggtaggagtgcatgtaaagataacttgtcaccttttgaatggggatttcagcagaagcgagagaatcactttgtttccaaagcatcccaaattcatgtactactccaaaagcatgcctagtgtctgcatagaggtttattttctggtcttagactgttgacgagctctattaagtgcagtaagttcctccatctgagctaattttacctcaagtagaaaactgtattctaaaggagagtttaagttaatgacagtatattgtgttaataagtttcaattttgaggttggatccaaaaatggggttctcaataggatttctgataaacctaggcaaggtacagaaacttccctgactgggctgggcgcagtggctcacgcctgtaatcccagcatttttaggagattaaggcgggcggatcaccaggtcaggagtttgagacaagcctggccagcatggtgaaaccctgtctctactaaaaatacaaaaaattagccaggcatggtggcacatgcctgtaatcccagctatttgggaggctgaggcaggagagttgcttgaacccaggagcggaggttgcagtgagccgacatcgtgccactgcactccagcctgggtgaccgagtgcaactccatctcaaataaaaaaaaaaaagaaaagaaacttccctgactgaagtaagacagtcatgtggtaaattgttctttatctttcaaaccttagttcctgaatcaatgccaccatgaagtctttctaaaggcctccaaagggaatgaatcactcaatgctaccatcatattttgcctacgcttgcagtgctgtagttttcactatgaagtttcattacactttgcatgcctgtgttccctactatactgtgagccccttgaggacagcacaagattagtacactgtttagtaagtgtatattgaattagatttgaattagcatagtattctaaggattgctaaggattgttggctaggattggaaggcctagattcactgtacacatgaggcatacatttgaaatatcaaatgatatggaagtaaaggaataaattaattgtctctgtgatataatatggaagttataactagaaaagtttagtaataatttattttcaattgttcagcttttccagcttggaatgcatcgagcaaggatttatcagcacctaatatatgtaaggactgcaccaattgctagaatatgctagcctaagcaaaagcatactaacttatgaaaaattcatatgtccttatctgaattttctacagccatatatcacatattatttttttactataacttaataatagattatgtatttgattaataatgctttttgtttgttttcttttgatgattaataactcttgatgatcaaagaaaacattaaatggccaaccaagacttaggtttgaacaattcatttttctatgggtcataataattgtatgtgaatatacgcatatattcacatgtatatgtatgcatagaaaatttatcttggaaattaggtataaaatagtttacttcttgtatcctgaatatgagctgtaaattttatttctaagaatttggaggttgaatctcttccatgtagaagtttattctctcatatattctctctctttctctttaccatatctttttctctttctaatgacttattctcaggcatatttccttaaagtttgaaaatatagccaccagatggccactagagctctaggcttaaatcattgtcatgtgaagggatccaactcaaagaaaatgccactttcctgctagtcctgctagtcctgtcagtcccagagactgccctgcccttaacaaatgacagttatcagggtattcttgataataaatgtgaaattaaggggtagggattaagaaccaactaaaacatattaagaatgacaatgagacgattgtattatacaaaggagtccactacaaaatccatgggtgttcatcatttcatcatgaaaaggaggttggaattactcttcacatatccttagcttctcttaacccattattaaagaaaacaaatacactttttaaacaagttatttccaggctttagcccaacttgaggttataaattggatatgtgacacactattttgtcttgagattatgattaataatgtaatcagaatagcgtggactttggagccaaggagacctttattcaaaaccatgatagaacttttcttagtaccgttacctaattttatcatctattaaactaaaacttaatgagacctttttatagagttttaatgatatatgaaatggaaactatgactccatcattgcattcattacaattaaaacataattatctatgtgtatgtttttacctctacattttaagcaccctaagcactgggatattttttcccaagtgtataatatagtttatggcatatagtacatgagaaaaaaatgatggatattccttaccttgctttgacttcttaaaggtttttacttgatgaagggctctaactttctgcagtgccatataatagaactgccagtctctaatcatatattgtgtctgaagaacatcagccatatgatatgcagtcatagagattacataataaatgtataaaggtgtggtactagcacctcagtgttttaaatgaggtaacccagttttgaagctcagtgatattgagtaactggtcaaagattacttgtgaaaccagtttattaatttggtggggctcagacataactcatttatttctgcaggcaatatttgcagagacattctcttgaaactccctttcccacacattgatgtatgcgaggcagagatcttttggttttctggtgaagttcattttggttaagttaatcaatgtcccttctaaatcagagctcatattattccctctctctgatgccagccaggccccagtttgagagacctgaaatgcagaagagctgcacttttttatttttcttacccctcttctctggtcctgattcctccattgttggggcaaaaaggagggattagagaaaagaggcaaaagccatttgcacgattagcactattaattctctctctgtcctctgcacgttagttcctctctctgtcctctgcatgttagttcctctctgtttcctctgcatagttcttccctgtgccccttgcatattagttcctctctgtgccccctgcatattagttcctctctctgtcctctgcatattagttcctctctgtgtcctctgcatagttcttccctgtgccccctgcatattagttcctctctgtgccccctgcatatttgttcctcgctgtgccctctgtgtattagttcctctctgtgcccactgcaaattagcactattagttcctctctgtgtcctcaaatgttgcctctctcacttacacatggctcacagcaaggatcctctctggcttgatattttcttgttttgccgcttcttgtcattcagctagtggctacctattttggcagcccgtcacctgattagtagcaggtactattagtttgcataccagaaagatggctcaatcctggttattgtcaacagtgttcactttacccatccaatggtcactcatccttcccatgtcacttaatggtaaaaaccacaattacttttatgccaacctaatattatcgtgcaggctgctttgatgcaaagctacccttcagcctgccattttaatctaattaatttcttcttagcttggtagagtacaaagaattagcaaggctactgcataagcagacttccaataggcaagtgagatattggtgctcttttctccagcagccccctttccagtaaatgatgctcttggtgtgccctcttcattcgcttggccccttggagaggcaaccctctccatccccaaataatctctcagtgagaagttacattcctgaaaactcatcaaatttcctttctcctcatagctctgctcatgtagactggaggagtgttgtctgctgctggtagcagggccagctctgccaacttagcaggttttgtggagatgggtctgatagttccttaatgctctttagaatacaggcgcattgtttgcatgtttgtggcactattcacaatagcaaagacttggaaccaacccaaatgtccaacaatgatagactggattaagaaaatgtggcacatatacaccatggaatactatgcagccataaaaaatgatgagttcatgtcctttgtagggacgtggatgaaattggaaatcatcattctcagcaaactatcgcaagaacaaaaaaccaaacaccgcatgtttgagaacacatggacacaggaaggggaacatcacactctggggactgttgtggggtggggggaggggggagggatagcactgagagatatacctaatgctagatgacgagttagtgggtgcagcgcaccagcatggcacatgtatacatatgtaactaacctgcacaatgtgcacatgtaccctaaaacttaaagtataataataaaagaaaaaaaagaaaaaaaaaagaatacaggcgtacctaaggatttcacttttgagactttatcccctttccatgaccacatgaaaacctccttttgacattctgttacagaatatggcacccttgtttaaatagtaagctgtgtaagtccattcttgcagaaataattaaatattttaatgtgaacacagggttactagagtaaatcactgtagggctagtaaggaaacattcaaaatatcagtttcttcctggtctgagcattgtaccttaaactttgtttttctctactcataacaaagtttcacagaatgttacaggaggtctagggtctgccatatactaactgcctctagttttgcaaactacatttgttctcaggtgcttgatttcctgcattgatagtgacattggttgtatctttcctacctggcagtgatgttaaatggatagatgaacattagaaaggtctgatttgcatttccgtgatcattaatgctgatgataagaaaaatgcaaatcaaaaccacaatgcaataccacctctgtcctgcaagtttggccataatcaaaaaatcaaaaaacagtagttgttggtgtggatgcaatgaacagggaacacttctacactgcttgtgggaatgtaaactagtacaactactatgggaaacaacgtggagattccttaaagaactaaaagtagaactaccatttgatccggcaatcccactactgggtatctacccagaggaaaagaagacatgattcgaaaacgacacttgcatatgcatatttatagcagcacaattcacaattgcaaaatcgcagaaccagcccaaatgcccattaatcaatgagtggataaataaactgtgatatatatagatacatagatattatttcatatataatcatatatattatattgtatatgatcatatatgattatatatatcatatatatgattatatatattatatataatcatatatatgatatatataatcatatatatgattatatatgaaataatatctatgtatgtatgtatctatctatctatctatctatctatctatctatctatctatatatctatctgatagagtactatgcagccataagaaggaataaaataacagcatgtgcagtgacctggatgagattggaggctattattctaaatgaagtaactcaggtatggaaaaaccaaacatcatatgttctcactgatacgtggaagctaagctatgaggacgcaaaggcataagaatgatacaatggactttggggacttggggggaagagtgggagggtggcgagggataaaagactacaaatatggtgcagtgtatatactgctccggtgatgggtgcgccaaaatctcccaaatcaccactaaagaacttctgtaaccaaataccacctgtacccccaataacttatggaaaaataaaaagttaaaaagaaaagcctggtttcgcatctgttctataatgtgaatggggatttaggttgtctcactaatctaggaattggttacaatgatctgttgtattttatactttaattgccctgttactgatcaccatgaaaagagcatattcttgggtaaatttaaataaatttatttctcaaaacttctttgactgaagttgttcacaccagactccctatatcaacaacaattaaagttgaactgaaagcaaacatgttggtaaagtgcttatacaagaaaactgtacccacagttagctctcatcagttaatagaacaggcacattataatgcacatcataagaaatcgcattatggccgggcgcggtggctcacgcctgtaatcccagcactttgggaggccgaggcaggcggatcacgaggtcaggagatcaagaccacagtgaaaccccgtctctactaaaaaatacaaaaaaaaaattagccaggcgcggtggcgggtgcctgtagtcccagctactcgggaggctgaggcaggagaatagcgcgaacccgggaggcggagcttgcagtgagccgagatcgtgccactgcactccagcctgggctacagagcaagactccgtctcaaaaaaaaaaaaaaaaaaaaaaaggaaatcgcattatatggagaatactttcataattgcaagatagcagacaaaagcattcagttcattggccataaaaaggacaatctcatattaatatgtatgatagtcattgttctcacatcctcttcatctgtcatttcatttcccaaaggaaacattaaagaggcaggcttattattattttttaatgtaaaagatgtttaagccaacatctgatggagaaattaccatggtgtgtaacagaactaaatgttaatattcaagcatatgctcataaaatgattatagtacttgtttttaaactaaatgatagattatttgaataatatagcctttcaaaattaacaggaaagaggacctctaatacatttgtcttgtctttagtgctgttgttcacataattgtataacattataaacaaaggaaatagtgatattatttaattttgcatacctgcaagagtaaatgatagacgactaaaacatattacgctatgcttatttttggtttaacacacgggtatatggactcttcttgcattctttgataatatgactattacaaaagaaaagaaacacagaggaaatgctggaacaaacagttttagtcaacaatctgtttcagtgatatcctagtagctgtcatgaatatctctttatgtaattatttcagcaaagcctgctttcaagcacatgagaaagatacatcaattaatgactcatgtcctaagtataactaataaattatattttaacttaaaatttttttctatttaaaaagtttttgagaaaaaatctcagattacaaagcataactgcagaaataccaatagtaactctaagaatgcaactgtcagaatataaacacttttccccagagaatgaaattagatactgagagaaatttaaaatttaaaagtgctaagtactcatcagctccactacagtgcaattcagttaattaaggccatttgttcagcagtttctccagtttgaaagttaaaaaatacaggatttagtgcagcaaagagagaaatactttcaattaaacatatacaaagattggcatattaagatagatacacacattgtttttataggtttttttttttcactccaggttattttcgttgctatctgattggtaggtaactagaactaattggtaacttggccaagtctcacaggaaatggggcagctatttgtacaagaaatggatgattttgcaaatacagcatttgtgcccagtttgtaatcaatcccatcttcctgctgcaagactctgaaattcacttggggactcaggatgagatatcacaagcacagaactcatttgttcttataagtttttgtttgttttttcctgctatgttggacaaaaattcacttttaaaaaatcaaattattttagttctattaagacacagtatgacttaaaggaaatcgaattacagtttcatcatttatgtaatcaacttatagttttattctatgatattttgctgaaacataaatatctcagtggtacaaaggcaatgtgtaccttttctcttcctttaaacaaatcccgccgagtgatcttaaaagcagacaattccagaatgtaaaccttgagattggaggggaataaggtagcctcacatatagcattaccttcatctgagcaacacgaagtggtaccaaatgaatagcagcaggaagtgtgagaaatttagagagagagcagcattttccccacaaatgattgttgtcttctttcacccgtgtgccattgtcatctagatggaatcatgcattaatgatgtctctgattggatggtgttcataaaacatgacctctaaaattgctagatatatattcagtgatgccagaattctcttacccatcaccacctttgactttgaaagcactcctaaggaaaattgcacacaagatctgatctacctggaccttcaatgtaaagacgtaatgacttggtgattccagtttgctgcacctatctgtattacagaatggctaaaacaaacaatattttatttttttctgtagaagagatatgaaaactctccccagatatgggcttcccttttccagtcttcattttaaagtgttgaaatattctgatggtagcctacgcctggccaattaattctgaataaaaattctatataaatacattttattatatttcaactattatgacaatagtagtaagttttgaatttggctctcatgtatccagtggactgtttatgcagtatagtcctattcgtaggcacttcctatatatatacatatatacatatatacatatatatacatatatacatatatacatatatatacatatatacatatatatacatatatacacatatatacacatatatatacatatatacatatatacatatatacatatatacatatatacacatatatacatatatacatatatacacatatatacatacatatacatatatacatacatatgcatatatacatatatgcatatatacatatatgcatatatacatatacgcatatataatatatacgcatatatacatatatacacatatacatatacatacacatatatacatatatacctatatacacatatatatatacatatatacatatatacacacatatatacctatatacacatatatacacatatatacatatatacatgtatatatacgtatatatacacgtgtatatatatacgtatatatacatatatgtatatatatacatatatacgtatatatatacacgtgtatatatatatattttcagatgaaaagaaataaaacataaactatttcatttagggacctataaaaacatacccaagtgactcacgtaagctttagcagacagagtagtctatggtcttataatgaagagcttataccccataaaacaatcctatttctagtgaggataatgtaatgaagcatagaatatccattgatggtaactacctttgcctacttcatcaaattaaactgagcctatttaaagctttgcaaacctagcaagacatagtttcttttaaattcttagttcaacatatgaggaaagttatggtccgtgaaaaatctaggaaagctgtaaaaaggtatagcatccagaagcatttttaaactcatgatggagaatttgttaatgtgagcttcaggcaatttgctgttcttaaagtataatatgagcttctgaaattttggctgaaaccttttgcaaaactaaacttgttagctctacatagagaaacaaagcaatcctaatcatatctcttttactggtttcataacttcatagataataatacttgcctatgaccaatgtactttgaatgacacttagatgtgaatcaaaccatgaggtctaactatagggttaaaaggtagattctacaagtcatgcataaatctctaccctactctctgtgaatggtaactcacagatggtgaactgtgttctggcggacttatttttaatataccaattgtgtgtagcacaatagtcatttcataaaaggtcttcaatgtgttgtaatcactgaatgggaaataaatttccatcctcttttgaagggtgcatttgtgatgttatacttgctgcatattgtggtaacaagcagtcattcccaaaaatgaacatgaccctatttcataacaggatattgattttgcatgcttaaattaagtttgtatttattattactatatatctctccagttagtttccatttttacttctaatccggttaaaaacttactatattttaaaaatactctctgctatagccatctaattatttaaaatagaatctcaggttattaggcagtgcattgcttcctacatccaaatttgagcttgaacattttgctaactcttttggaattcaatttccagtttactcacctctgaagaagtatggattacttgacttgttcactaactttagtagaattagaactcacactcatgtgtcctaacatcaaattttcattgaagatcatgtgctgcatgacctatacagatggtccccaacttgagatggtttgacttagttttttgactttatgatggtgtgaaagcaaatgcattcagtagcacttgtacctcaagtgctcattcaaccattctatttttcacttttagtacagtatttaataagttacatgagatattcaacacctttgtataaaagtggctttgtgtgacgtaatttcccccaactgtagggtaatgtagatgttgtgagcacgtttaccatattctaggctaaactatcatgttgcgtaggttcgacataattatattttcaatttacgatagctctatcaggacataacctcatcgtaagttgaggaatatctgtaattatcttgattgcaaatgtatttaataaggctgtagccagtgaggcagaagagtgcataccaggctgtaagttgtacagcctcacagagtagttgctttccgacttcttgagagggtttaatgttgcgtcaaaagagctggttctctaaagttttaaaatccctattattgtatacagagttacctgtgtgtgggaatatatgatgtttctagaataaatttgaatccttgagaagttaaaaagtgattcttaattaagcaagtggcactggaatcagattttatgggtgtgaattctaactctaccatcaaactatataagcttcaacaagttaattaacctatttaagctctggtttccttactagtaaagtggagataattataacttctaactcaaacggttgttttgaaaattaattaagatattccgtgtaaggcatgtgaaatagttcctagcagataatcagtacacagttgatgtaaggcattattactatttcactgattaaagggtttgccccaatgcagcctgtattttataatttatgtggttctgctctaaatttttcatacttattgatgattgtagtatattaaattatcattaaaattaaaattaaccttatttatacttttcctcttaaagtatatccttttcttaagttagaatttaaattatagctttagtattgttttaaacctatttctgaactttatttttttactgtaaaattctcacattaaaggttcatacttcgtgattttttccattttgctaatatcttgcttgcattagtgaaaaataaaaagaaattgattaattgttttgatctctaattcatatataagagtggaaatggatttctatatctgatatttttgctagaaaaaatgataagcttagtattaccttactgtaatctctggtaactaagtttatgacatttaactggaaagatagactatctttaatgaagtgattgtgacccactcagtgactaagacagcatggatattaacatcatctgtcatcatttccgacaaaagggttgctccattttggaaagttccctggtatttgctccagccaaagactaccaggaatatacccgcaattaaacaggttggatgtattgttcattgcaatgagaaataatacacaccatgaggaaccatggagtatatccgtaagatgatacagtaggaaaacttacaagatttgggctcacattaggtgatttgtgggagtctctggagaagcagatctttgctgtggattggttattatcagcaagcaaaagtaatatcttgactgagcattttaataagctttattgagaaggggcaagactaggatggaactaaactgtaattggtaaggagatgtgcagtctttcatattagccaggacagggagatgtttggttatttttttgatttttaagaaaagtatgtttttgtctgtgttcaaaaatggttatgggatagtgctgtttttgtcttgatcaaccagagtaaccttgtctgatgttgatattctgtgaagttgtttatttctacagaaaaacaccagtctagatgtcagtgatggaaagcagccagacactgcacttctctttcttttcttgttcataatacacatagtcggcaaataatgacaaataacactgatattgatttaatggtagctaagtgcaaggaatgtgctggttgtttcaaatacatgaccacatttatactgtacaaaagtcttagttttatttatagcggaggaaacagattcaaagagataaagtgatatactttggaaggatgatatttcaaaattatcagagagataaagtgatatacataagatcacaccctttggaacaatgagttctcaaaacaatcttcctccaagatgtgtcctgtttctactaggacatacttcctttatgagtttcagttagcatgctggagagactggggaggcacacacctttcacacaaagcaacccgggcaattctcttcaaaaatgcatcatgtatcatggaatcaagggctcatatttagaaacattctagctctctttggaatctatttattcttttttagatattgatctgataaacttactaccagtagtcctagctcacagaaaatgtgtaccaaaaacaaaatgaaagcttggtgagggggtgtttctacacattcagagttccacactgctaactactagtagggagactatggaacagaaaagcccaattaatagacacttaacttcaaagagcaaatcagtttggaaccactaaatataaagacaagcaggacagtcagtgaggccatcaatgtatgaacacactgatattagtcattatgataatcctacatttttacagaaatgtaaaatattattcatcttactcagtttttcagtccatacatttaagaaagtatatctaaaaagtatgaactacaagttggttgctaaacaggtaaaattctgtaattcagaaaatttctgcttgtcatttctaccactttgccaaataaaactggcactatggtaatatatttaaagtaggaaccaaattataatcttatcaccattttatgacttcattagaattttgtcttgattcaagggatttgttttaatgaccataggtggtcaagaacgagagagaaaaaaataatttacagtgcaaaccacaagtctaatgtaatagtttgtcctgaaggcagataaaattggtattaaactgaagaaagattattttatatcagaccttataatatctgatgaagataatgctgctagtattagtcccagaagatttatgttaggaaagtgagttatatgagccagtgacttgtctggattagaggtggtaaaccatcagcctataaaaaagaaaatacggtttgtgggcacgttttgtttagtctgcagggtattgatccactaagggatttttttcaaaaacataagctgatttctacaaagataaacaatgaaccagcattagggtgatggagacatttgtgtgttccacttttctgcatgacataatcggctgcagcaaaggagcagctgccttttatgggtttgtggtcaagcgagtttaaacacctggtgctttttacccctctgcactgggctcctacagacatttctatgtatttatgatcctagtcgtgatgtttacttagatttccttttggttctgtgattctttgtatttatcgtatgtttctcttgccctcactcactttttaatgcgtatgtatgtgtgtggccaaaaaagagaaaaaaaagcaatttttcagaagatgaatatgtgttttatcaagtatatataactttaacaaggaagttttattttaaaagtagtatatcagtagcatatcagtatatatttgtgtatcagagtctattttttgcaaaacctggcatatatttagggctttggttcaactggtcacataatcaatgtgtagattaattttatttttaaatctgataattagaataggatttaaattattatatggtttcacttcaaaatgtagagataaaattatgaaattatacaagaaattaatgttcatttattttcttcaggtacttttttgactttttaatttgctttgtataaacaagattattgtcttccttgaattgctgtagaggcatcacaaatcacatttagaaaaatctcctcattaatataattatttcagtatttattaaacagagaaaacaaattacattttacattaatatcattaattctccaacccatttttttagttgccacttttgcaactataaatactaatttctcaggtacaaaggatatgtcacaattctattagttttgaatttttaccagtaatgagataggattgtgcattaagatacagtccaactgtgaacacaaattatactattgtgagtaataggctacaataataaatttcacacagtaatttgctcaaaatgtaagatgatttaaaattttttatttgactaagacctaaccttttgtatttcatcttgctggggaactttgatgctgaataccttcagactttatgtgcatcattatgatccttcccaagtataatggaatattccaaaggctctattttgtagttgaaatgttatactatagatcaatttatttgctactagcatgatgatatccatcttctggattctttatatgaataatatatattctaatttttactttaatatctaatactgcatttattcatgacctttgcaaatactttctctactaaaattggccaattttcttctggcttccttatttttaagaggccaccaaaagtcctttaggggaacacatagaatcccaggctactgattatcactttctagaaggtcatgtctggaaagatgtaggtcagagaagatttctcacagcaaagccacatgcagatggcaggaatggctggattttggtggcaatcaggctataaatgatcttattaccccggctttaatgacttcatacaaggaaaaagttatgtaattttaataaaaaatatacttgtgaaacttttgcctgcgagagagcagatatgtggcctgttctatatcagagaatagaattaagcaccaaaattggcaaaaaattaagccaagtatgttctagtttagcagctgtcatacttttacagatctgatttctaaacagacaattacttgtttttctaaatcccagaaaataacttaccacttttaaaattcaaaccataattcttaaccttgtcttgtggcccatgggagacttttgggacagatgtctatagtttgatgatataatgctgttttctaagcaatggggaaaaggctccctattcaataaatggtgttgggagaactggctagcaatatgcagaaagttggagctggacccctttcttacaccgtacacaaaaatcaactcaagatggattaaagacttaaatgtaaaacccaaaactataaaaaaccctagaagacaacctaagcaataccatcctggacataggaatgggtgaaaatatcataacaaagacacccaaagcaattgcaacaaaagcagaaattgacaagtgggatctaattcaccttaagaacttctacacagcagaagaaactatgaacagagtaaacagacaacctacagaataggagaaaatatttgcaaactatgcatctgacaagggtctgatagccaatatttgtaaggtacttaaacaagtttacaagagaaacaaccctattaaaaagtgggcaaaggacaggaacagagactgctcaaaagaagacatacatgtggccaacaagcatatataaaaaaagctcagtatcactgatcattggagaaatgcaaatcaaaaccaaaatgagatgccatctcacaccagtcagaatggctattattaaaaagtcaaaaaataacagaatattttgagcttgcagaaaaaagggaacacttatacactgttgatgggagtgtaaattagttcaaccattgtggaaagcaggttgacgattcctcaaagagctaaaagcgtaagtatcatttaacccagcaatcctgttactgggcagattcccagaggaatataaatcattccatcataaagacacatgcatgtgaatgttcactacaggactattcacaattgcaaagatatggaatcaatctaaaagcccatcagtgacagactggatagagaggatgtgctacatatacaccacagaatactatgcagccataaaaaagaatgagatcatgtcttgcagaaatatagttggagctggagatcattattctttaaaaaaaaactaatacaggaacagaaaaccaaatagcacatgttctcacttataaatgggagctaaataatacgaacttatgaacacaggccggtgcagtggctcacacctgtaattccagcactttgggaggacaaggtgggcagaccacctgaggacaggagttcaagaccagcctggccaacatggcgaaaccctgtctctactaaaaattcaaaattagctgggcatggtggttcactcctgtaatcccagctactcaggaggctgaagtaggagaatcacttgaaccgggaaggcggaggttgcagtgacctgagatcgcaccattgcactgcagcctgatgacaagagtgatactgtgcatgaaagaaaacaaaaaaaacttacgaacacaaagaaggaaacaacagacactgggttctacttgatgagggagagtggaaggagggagaagagcagaaaaggtaactattgggtactggacttaacacctgagtgatgaaataatatgtacagcaaacccccatgaaatgtgtttgcctgtgtgacaaactttcacatgtacaccgaaacctaaaataaaaatctaaaagctgttttttatttcagttaaaatttattattttccttgagatttttttatcttgttatagtctttaattcagatgaactttgttggtattcaaaaaacgtatgtagtagaggctttctgtcctccttgttatcttctcagaggtctgccaggaataattttgtagtattcagtttccaaacatcagtgggttacttcctgaagagagtttcccatccctggaggtatctaagcacaggctgaatgacaggggaatgacatgaaggaccaagtgaaatttaggacctccaaagattcaatcatctaagggtgtatagtatattattatacttatctacatatgcaaatgaaagcctactaaaattgttcatttgtttttcatctatacatattttgtgtgtgtgtacgtattgttgtggactgaatatttgtgtcctctcaaaattcatatcttgaaatcctaactcctaaagtgatagtgtaggaaatgaaggctttgagaggcacttatgtaaggaaggtagcactaccatgaatggggttagtgccctaataaaaaaaagaccccagagagcactttagctgtctttctcccatggaaggacaaaacaagaagttgacattctgcaatatgaaagagggtcctcaccagagcccagccaagctggaaccctgatctcagacccccagcctctagaactatgaaaaattaatttctgtttttcatgaaccacccagtctatggtacctgtgatagcagcacaaactaagatacataatattcatatcatgtatacacatcttcaaaatacttcatgtcatgaaagttacttctatgttttaaacaaattaaaagagaaaaatgttttattatcatatgtatatagttctttaagagaacaattttatctttatatacttctacaataaaatccatttaataaattttaaatagtgttagtttatggatataatcttaactttttaacccaaagcttttcttaactctaaaaaagtagacaaatgtcattgctttgcaggaattattttataatgactatgtcgtttattgcaaccatgtcatttattgggttaaatttttaacctatttaattgtaaccatcagagtctttatagttaaagtacatttcttggagaaaatatataattgggccttttaaaaatttacttaatgatctctctcctttaattggtgtattaaaccattagtacttaaagaaattattgatgtagttcatttaatatctaacatattcaaaactgttctgcttgttacatgctcctctccttttatatattctctgattttcatgtagcattttatatgatccaactttatcttctcttttagcatatcaattataaatttttaaaattatttttacggttgtcctagactttccgatataaatgttcaactaatttaactccaccttcaaataatatgataacacttcacatgtggtgtaggtttcttataacagactattcccaattcccccgttttgtcccttatagcactgttgtcatttattttccttatccctatgctatagttacccaatacactgtctttattattattttaaacatttatcttctaggtacatttacaaaggaaatagagaacatgttgtcaaacctttattccatcttcaacactcttccttatgtagagtggagtttctgacctatataatttttttccctttaaataacttcttttggcattttgtcttagaaagtctttattttgccttcacttttacaggaaaatttcagtgaatacagaaatccaggctggtttgtgtgggtttttgttttccccttttcaatggtgcacatatttccctatatcttcttgcttgcatggtttttaatgggagtccactgtttttctcatccttgctgtatcagtaaggtgttccctccacactgacttctttcaggattttctctttgttttggttttctgcagtttgaatatcatatgtgtaggtgtttgtttctgttttttttttttttgtatttttctttattagcttctttttggtatttatcctgttgggtgttctctgagctttctgtatctgtggactgatatctagaattaattttggaaaaatctcagccattctgacttcaaatatttcattctgttgtttcttttttgctcgtgtttgaattatacatgttatactatctgaaattatcccccagttcttggatattctgttcttcttttggatttatagtttgtttttgttttccattaacttatctgtttgcatttttgtttgggaagtttctactgacttatggcaagctcactgattctttcctcatttacattcaatctgcttgtaaagccatgaaaggcatttgttatttctgttacaatgttttttatttgtagcatttcctttccattctttcttagagtttccatctcttttcttacattactcatatgtgctttcatgtcatgtttgcttttttcattagtgcttttaacatattagccaccattattttatgttacctatctgatgagtccaacacttgtgttaaatctcaatctgattttgtttttgttttttgtgtttttttttttcatcttaatgactttttaaaaaattttattttaagttccatgatacacatgcagggcgtgcagccttgttacataggtaaacatgttccatggtagtttgtcgcacctatcaacccatcacttaggcgttaagccccacatgcattagctgtttattctaattttgatagttaccttgactctttgcactgtgttgttatcttgccttttacatgcttcagaggcctattagtgggaagctaagcattctataatcttataataaaatcgctgtcttgtagagggcctctttctctggactgtgacctttgcatagctccttatcccactttggtgagacaggaaggtttgaataatctgatgggagcaatgtctttctccagctgagaaaaggctctaataaagtcttttcccctagagaggaggcctttgctatggaaaacactctgggcatatttcacagtatttatgatactgtttccctccatgtgctaatgccaagaggggagctttcttggatcttcaatgttagcacttggtggtgtacctggagataaaaccataaaaatgtagatttctagcaggagtttctcactgttaacacttgtcccactgaacctctagcaatttgtcaaagttaccttatgcatgtgatgtggttcgtttgagtccccacccagatctcatcttgaattatagtcccgatcattcccacatgttgtgggaggggccctgtgggagataattgaatcatgggggctggggggggttcccccatactgttcttgtggtagtgaagacctctcatgagatttgatggtttcataaggggaaacaccttttacttggctctctaattctctcttgcccgccactgtggaagatacgcctttcatcttctgctatgattctgaggctccccagccacattgaactgtgagtccattaaacttttttctttataaattacccagactcaggtatgtttttattagcagcgtgaaaacggactaatacagtatgtttctatctttgtatgatttccgcagcttctgctccaggtaagcaaatctttgctgtaattccgtgaatctgcctctctgtctaaatttcatggtgatggtttcctctgcaatctcagttctctgatgaaaccaaaaaaagtcactgattttctgcttgttcatttttttttcttcttgtaaggacagaagcgacagcttacaagttgtttacttattggcgcggaaacagcaagtcattcctttgtccttgttgtaatgaagccctaagaatatttctcacctacaaaatttcattttgtatacatctcagatggttgaaagatattattctattatcttgcagtttatataaggtaccataataggtacttgataaaaatacaatgtactatatcaaaatatacaggcagattaccatgtctttgtgcagtcaccatttcagctagttgttcagggcagagtgaggatctgagtgcagggggataggaaatcttaaattgcaggctgtgtctggataataagttttagattaccaccatattttgatatgtgttctacaacgtggcctgatgcaagaatcagaaaaagttaaaaacaggattaatttattttaaaaaattattccactccacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaattattccactcaatttgtttaaaacaacaataacacaatagtttgaaattttactcattatttctgcatctcccaatcccttcctcccttttctttagatgtttagaataatattctttgtttatcacagctgtgctttttactttcatatattttctctggaattttcaactccctggtaaactcactcctcaagttaaatctcaatagattcttactcttctataaatacatccagctaaatatatcaaatgttcctcaaaatccatatgtccaaaactaaaattatttcttcgaataaaaccttttttttctattcctgttaatggtacaaccatagttgcagttccaaaaactcaaatattttgcttcaggtcatcctgtccttcttgactacatacccagaaaatcaccaagtccagctgaatctactgctataatctctctttctctcccccacctttccatcctaacctagatcctccttgtcagcctcctacactcccagtagcctctcatttacctctcccattctttacttccttccccagcctgtgtttcatgatgttacctgattaatctttctaaactagagctctgctcaagcctaaccaccacccaaaagactctacagataagagcctacccattcacattcaatatgcttcatgatttggtcccacatgtttacttgtttcacaaacttttattgatttcacacgctatctatgtgtgctgagtgtactgcaggctgaggttacagagatgaataaattagggtacctactctaaaactcacataatttagataaaatatagacccttaaaataattaaaatgtaaactgtgatgagtataatactagagaccattattaagtgctattggacaacaatctacgacaggactatctgatctcatatagattatcctggatagtcccttcatagaaatcaaatctagaagggactttagacattatttcacccaactttctccttccagatcattcctcaagtaaaagctcaatggcctcttactctattatacctatttacccccagccacctcacgccttaacacacaaacacacacacacaaactaaaaccatgacgcagaggcctgttgttcccgtaatgataaagagtgttgccacattggattccaggcaaaaggaagggatcatgtgcatttctcattaggcatattgcaatattgagcacagcttcacgagaagcaagttattacccatagagcttgtgggagacccagtttagaaactgctgctccttaagacttattcgtgtctatcgtatatttacctaagcatgtttcctcacttactgttatttaactttatgtgcctgtgtctcatttcttcaactaaaaaactaagttaattcagtgcagtcatcacactggatacttacttgttttcccaggagtatttgacatagcagctcattcctagtgggtagtaggaaattatttgtggttgactgactgtaggctttcatcactcagtttgtggtcagatattggtggaatttatgaaaaagatcattcaaatttgcagtcagccctggcttgtgggagatgccatggcttgctatttttcttcgtgaattgcctcttgctacagagtccgttttaaaaaggactggagtaggagaattggtgtggaagcaatcttcttaacataatctatgagattctggaccctaaatgagataaagcataaagcggcactaatatcaattaatagtgtatgaccaagttgtgtttgacaaaactacaataaagatatgctccaaagtatctagagacatgcttagtctaaaaagctccctttttgttagaataacgtaaaaacagtagcaacactacagcaacagcaacagaggggaagatctcatctatatgtctatgtagcacttaatgatttacctactaacccaagaacattgtatctcattatttatgcttatccgtgccatacagcactaatcagggcatcctatgaaaatccatttgctttttcaaactctatccttttgcttatgttgttccatatcctaaaattttctcttaccctttccatatatccaaattttagtgcttttaaagatgtaacctaaatgccatggcagccatgaaactcccttttactctgcaataagaagttgtctctcctgccttttgaaattcacgaagcactcaagtatatatttcctacagcagttatcatattgtcttacatcacaattgttttgattctgctagtaagggttcagaaatatcttttatataatttggttaattaaataaccttccaaataaagagataactgtgccagattcatgtttcctttctacatttcaaacttacaaatgcttggcaaataaaatgttgtctgaacatttgtatatggtacattaataaaaagaggatatcagttcttgggatgggtcttttttttttgcccccttgggacagggacaaatcctaggtatgttctgaggcagatggaagttgttgcctttgatttcaaaatacccctgtaatgtgatttaggaaatacaataatgtaaaatcatgaaatatttctgttcccaaaatggagctttcagtgacagacctgtacagtagactgttgaattggccaataatttatacactggctactattttttttgtttctaattcttctttgcctagccatctattttttttttttttaggaaattgaaggaaaaataaataacatatcttggtcttctccataatacttaagttctttatggaaatgatagaagtctttatatctcctgggtgcatagtactatgacctttcctgtgtagatgtatattaaataagtaatgaagagttaatcaaaatgactacttactatattagaaatcgaagtaccatattgtacttcctttcgctaatgtatttacttcaattcgataaaaccaccatggattactatccagcaatataataattcacatcaaatttcaatatttaattatttcatggataacaaaaatttgtataaaattcgtaaaaatagaaaaatttgaagccatatatttatttcacagaggttattttggtgtcctgcaaaaattgtacttaatttttgaacagtaaaattaaaattcaaaagagaaagtcttaaaagactagaaatacacagcaagctttctggaagttatttcattatgaaattcttacagaaattcaaaagaattgaaagttgatgtaattatggttacttttactggagataccaactttttggctttaattacctgagcataaattgagaaggagagtctatacactaaaaagacattacattgttatgtataacagaacacgggtctttgctccaatgctcggttgcatactctcctcctttgtcaagaggtaagtggcttaaaatgacatcttgcttagtttacaatggcaagcttcctaggtttgtaggaagaataatttgaatgctctgtttgctaaaagaaaaagtttttaatagtatttaattgcttttactaagccgtcagaaggctcctattgaaagcaattgaaatagttaattcctttttcccggaaaaaggaattacaccccgcttctactttgttgagtaggagtgaagttggtgagaataattgtttgactagatatgactctagccagaatttaaattagccagtattggataatattattttatttgtattctacctccttaatattgagatcaaccgtcacttattaatagcagcgagtttgggcaaacaaaatcacaaaatagcgtgtatacacctgaattttattgttttcaaacaataataacaaactcgtaaataagcagtgacatagaacctttttttctctttccacaaagcaatcaatatgtgagtctaagcattcttcacattgctagtctacaggtttctgagatactttgagccacattagtattttataacataatggtaatacacatttttggttttttgttttctttatgatattgatcccttttgcaccttaggattgtcagtataatgtccaagaatatcgaagctgtgttgggggatggtttcaggatgaagctgttctgcctcagaacatcaggcatggaacatgcagcctagacccctcacatgcgcagttcacaatgtttttgtgtgtgtttgcttgtctttgtattttctatttggttaggcttgtggcttgttgttgagtcaaagtggaagccaaaaagcttctaaaagtcagttagaagctcttgacaaatctgtaagaattttgaagtcaattaagagctatccttgagttaactgtgctcatttggaatatctcatttgtgccatagatgactcatagggggaacagaagctctcttcatgcttttcctccactcaatgcaagttttgagatttattcctcattgcggcagcatagctctgcttgtttttctctaaagaagaattgactcatgcctcctcaaatctttcgaacgattacctgagaatgttaagtatgtcaaattttaactcattattttcaaatcaatagacaactgtagctacaactcaaattttctatttcaatgtagaagtgctgtgctatattctcatattcaactttgcctaacgcatttctatgctattaaatttgcaaagtttaagacaagatgccgaaaaaatggtattggaccactgaaatattaatggtggatgtttaaggatttaatggctacatgaactaccttaaagcaatttaaaacatatgtagtttttcaaactatgcattaagtactataaaagcaacttggaacccattagcatgttaaatcaggggaccccaagccatggccgccaactggaactggtctgtggcccatggcctgttaggaactggtccacatcacaggaggtaagcagccagccagcattaccacctgagctccgcctcctgtcagattagcagtggcattagattatcatgggaacacaaaccctattgtgagctgcgcatgtgagggatctaggctgcatgttccttatgagaatctaactaatgcctgatgttctgaggtggaacagattcatcctgaaaccatcccccaacagtctgtggaaaattatcttctatgaaattggtccttggtgccaaaaaggttggggaccactgtgctaaagcattctagagccattgttatatggttacacgataattattcatttcttcttagtgagtagacgagaagatgtagattcctatcaataaactgcgaaggtgtaatacaaatgctaatagagattttgtaaacattctccttattgctgattttacattattttgctgaatcataaagggactattcatagagctaataatttcttcaaaagaaacaaacacaaatacatatattagcaactttattggaaaaaatatttcattttcttttaaaaataaaaggtatttgaaattattattattttgtttgtcaaaaacaaattagttagcagtattgtattacatatgagttttccaaatagaagtttattcatttaactgcattatgaacttgtccaatattcataatgttctataattgctttatatttgaaatgtgagtgatttcaattgtaagaaattactagaaaggaagttaaacagaaaatgttttcagaatagctaatctttccccctttatcctccttttttagttaccttattttttgccttttgatttttactcatgttttctgattgttttactgttaaattcaagcagttgaagataaatgtgttgctgagagcatggacattgttagtcatgttgacgtctgtgtcaccagaaactagaaacagtgccaagcacagaaatgctcaataaaaagttgttgaaagacaactgaaggaagaaaatcttaggaccatctgcccaatgatccaaagcttattttcacaaacaaaattggacaaaagcaagataattgaactctgtatccagcagaatgccttgcacaaagtgagtgcataatattccttgtattcatacaataaaattttattaatttttaaattgcaatacaaattaagaccttgaacaaatattcggttaataaataatcattcacagcaactgggaaatggtttacattcttattcctaatttacagaaggaaactgaggcctatactgaatgtctttcctggggtcttggcattccaaaactgggaattgaagccagtctttgacagagtccagtgttttttctactaaaccaacgtttccccgagatagctcaacagaaggtgtttaatagggataaatatattacccctaagtatgatcatcttaaattatttattaaggtggtactttacaagtacatcaaggataatatactgtaaatgtatagacaatcctcacttaacattgtcaataggttcttggaaactgggagtttaagcaaaacaatgtataaggaaaccgatcttgccataggcaaattaaattcctatggcatatttctggttacaaaaatatcactacacttctaaataaagaccaaaacacttctaaaattaaacattgaaataaatgtgagctatacatgcatttaagaaagaataataaaaacaagataattatttacctgctaattccatccagttcaggggcatgggtgtcccagcagctgagaacacaaggcaaaaaccaaccccagagaggatgccatccatcggagggcacagtcacacactccgtgcactcgctacgactgggacaatgtagacacaccaattaacttaaagtgcacatctttggaatgtgggaggaaactagagtacatgtagaaaacccatgcagacatgaggagaagtgcaaacaacacaggcagcggccccaactgggaatcaacatttttttgtcatcataataactaaataacattgaatgaaatgtctttattagaggacttgctgtatatttaagtgtatagaacctatttttaatattcaaaattcttatattcaaaattttcacattcttccttaacatgaacattgagtctgcaaagtcagataagtgaaatttaaacttaaattaaaaagagtgaattcttttcaaggctatcttgtccttgtgcaagtatttaaagctcctaatattctacattatatcttatttatgataactgactagggatatgaaattagtaatatgaaactagcatttaaaatctctagactctcatctcttttttgagtatttataaagtgtattcaaccactgggaaaaaaaagtctatatttacacgtcctctgaaatcacacgtttattggaaagttaggcacaaatagttaagaagaaggtgactgaaaatttctggtgttttagatttgacctacttcccttattcttctgtggtatccttccaagtatcagagagaacagatggaattaagtgtatacacacaaaatagattgatagagaatagacatatttatatagattatgactaaagtatataccaggtttctttacctaggaaatatttgcgtatctaaggtcattttttctatttaacctactgttcaccctttgtgttctgcactgatgccatgcaaacccactttacatttcccaaatgggaactaacgactgtgaattattctaccataaatttgatttcacttcacataaatgggtctttttattgtatataattaagatgaagaaggtcattataatcaaggcaatcaccaggagagatgcatgtacagttaaactttgcattcattgctattttctgtgaaactccaattttggatcccattacctaatctgtttcaaaacaatgtctgtgctaacccattaattcctcctaaattttctattttaaccctttttaaatttattaaagcaatgagaaattttcttccactaccaaaatatacgtggagctatatcaacttggagatcattttacaactgggaaaaagacaccgagtctcagttcatgaagatttttctgtacttaatatgagccaggtgctctgctccattgtgtgggggtcattaggataggtcggttggatgggaaatctaacacatagaggccccctcacagcataaaagtgtataagttaactcatatcatgtttactcaaaaatgtataggcaagtaaagtcatagttttcgcagtcaattgtgtgttttcttatctcagagacaagtatctcaataattctcactacataaagccatataaatttcagagtactcaatatgataagtagtcaggtgaatataaaattcagccacatattggagagagttcaccctcctgtatcctgataagtattcttgaagaataaaattttaatatagacagcttctcaattactggacactgaaaacaatttactggccattattcatctctttgcagatttttttaaatctaattagtagtaacttctactacccattttctagttaaggtttgaataataaatttgaagctaaaaaatgtgctcttgaaattctctataaggtaaaattttagtttatgggcaaatacccaatagcaactgaattaaactatttttctgtgagtgtgatgctaaatcagccctttgactcattttgcaacagggagacagaaaattgaattcatcaacatttctttcatctgtttctaggctgatatacaagagtaaaaatttattaacaaagatacataatccaaattatgtgtgaaagaggaagaattatcataagactgcttttaatgacttctttgaatggcttcattcctttctttaaaggaaaagccaacaaagttatgtttaaccattaactgataaaatagcccattggtagcctcgacaagatattctctatatttttctaatgtgattttgtgtttgagatattaagccaactactccttcattaaattaaagagaccattatttcaaatatagtcattatttatttcctttttacgtactaagtccaagtttataataagaattgctgagtttattctcttaatacaaccttttgagacatgtgtcacaataacgctttttctctattattcttcaacaaaattgaatatgtagctatatgtagctatacatatggtattcttatgtagctatacaaattggtacatagcattgctctgcatttggaaaatgcaaattactctcaaacaaaattcttttaaagacttgaggaaaaatagaaatctaatataaaatattaagacataaaaaatgtgagtaatgattatttgattagtctgattttattatataataaatttaaagagaaaactatgaacaagataaagataataactaatgaaaagtaatagaagtttaggaaaataacttcaatttattttacgtgagtaaaagattggtctataaagagaaagcccaaatgtaatgttcacttggaacccattagcatgttaaaccaggggtccccaagccatggccgccaagtggaactgatccgtggcccatggcctgttaggaacttgtctgcaccgcaggaggtaagcagccagccagcattaccaccacctgagctccgcctcctgtcagagcagcagtggcattagattatcacgggaacacaaaccctactgtgaactgcccatgcgagggatctaggttgtgtgctccttataataatctaatgcctgatgatctgtcactgtctcccatcatcccccagatgtccaagccaagtggtttctgaatttccattgagtagctggatcaattatgccattaaatatttgaattaagtaacagacttcctttcttcttatttcatgctcaatcaacttttctatcataatttgtgttcccctgtagcttgttatattgagacaatataatatgtagaagacagtgggacttaactcactcatttttcctttccatgagaagtttattagcattatgttttatatatttaagtcatctgtaactaagtctctgtattcaatctatatttgtgcagtgatagaatggcatcttaggcctagggagcaagtgattggcatctggtaaagagtgttttagctcctgcgatctaccttatatatatatatagacacacacacacacacacacacacatataatacatatatgtatatgtatttatatatacatgcacacatttttctatatgttcagtgtgataccaatcaacagccaaagtttttttatgaaatatgaactgattgcatatttcatatggataaaaataaagaataactaaggtagttttgaaaaaccaatacaatgatggtggtattctcttataaaatccccctaaggtacattaacctataataaacagtgtgccatatacatgaatgaaaataatggacctatggaatacacattagattaccaaacagtcttcatcaggtatatagcttgtgataaaactggaaatttactatcgaaggtttgtacagtaaatgatgttttgaatattctttataaattgaaatattaataaataattttaataaaccctttccttatactacacacattcacacagtatagaatcatatgtgcatttcagattaagtcaagagctaaaattaaacaaatatatttaaaaataaatattagtggaaaataattttacgatatttgatagggaagatctttctaggtaagaacgaaaccccagaaggcaatattgacagatttcattaaacaaaaattaaatatccttcaatgctaaaatataattataaaaatacaaagaacaattaaaagaaaatatttttaataaatatagtagacgtagaatcataacgaaggtaaccatgacagaatcccaatgaaaaaatgaatgaagattaggaattggtagttcagtgagcaagaagtatagaaatttccaagaattataaggtgctatgccacactaatatttaaataacttcaatatgaactaatgtatcattttaatccatataattgaccatcatcaaaaagattaatatctgttgtgaatgataatacataaaatataaacaagcagaagctgtataagtaaagcacttctgaaggaaaatttagcactattttcagacttcacatgtgcatcccctttgacctaggattttgtttcaaagaatctatcctagagcaacagtcacacattacgaccaagatgtatgcacaagatgttcactgaagaattgtatattctgtactatctacactatgaaatggaaaacctaatttcccatcagtaaggacatatttgaataaattatgatacatttatggtccagcttttaaaataaatgccacagagctttaaatactgccacagagcaactgtcaagatacgactttaaggagaaggaaaagacaagaaagaatccacaaagtacactcctttttatgtaaaaataaggtgtgtatgtgtgtgtatgcacacgcatgcctgtgcaagtatgaagagtggttttcccagttatcttgatatatttcatattatttgatatatcgcaatgattcatgtattacttgaacacactttttctttaataactgatgtttttacagaacgttgcagtataatgctcagacgaaaataagcactagtggataaaaggtacagagaagcaatgtagagggtttctgtattgtgtagttgacctgaatatactaattttcaggctgggcagtaatctaacagcggctccatgtaagggaatgcagtatccaggggcacagatgacagttgatactctctgattctatgattcaaaatgcaaaaccttattttacattttagataattaatctgcatgcattacttcaatctgttgcctaacctacaggtgccatttactaggcacacctggcatgactcaggtatttttatcctgttcactcatttgaggacaactgtactaccagaaagggaactagatgttaatttaaatatgttgaaagcattgcacagaactttctttatttaacccattcatcttaatgcctttttccagttcaaaggaaaaacaactactgaattttctaagctctctagctgtgataacagaaacacaaaaagacgatgattgagaactgttgtgatgcaaaaggagtgccaaaatgttcgcaagacttttgttgcatataatataaaaccactttaattaacttgagttaaaaaccggattaaattgttctcctcaagcatgcaactctaacagtagatttgcaacttttaaagtatgattttttgctaatattatttaaataaatctcacagcagtgactccattgtataataattttaagaactacttattttttctagtactgaatttattaaagaaaagctacaattctgacagcagaatgtattacatcttttcttaacaaaagattacttgaggccaggcgcagtggcccatgcctataatcccagtactttgggagaccaaggcaggtggatcacttgaggtcaggagtctgaggccagtgtggccatcctacggtgaaaccctgtctctccaaaacaaacaaacaaacaaaaaagaccaaaaaaacaaaacaaaaaaatttgccaggcatgatggcgcacgtctgtagtctcagctactcgggaggctgaggcaagagaatcacttgagcctgggaggcagaggttgcagtgagccgagatcacgccactgcactccagcctgggtgacatagcgagactctatctcaaaaagataaaaaaaaagaatgcttacttgagatatggatattatgctaagttttctctaacattatacatgaccaattggtctataatagaaaacatccattcaaaaacatttgcagatgatattacttgttaaagattgactccacacttgtattttattatattttcctgagaattgttccatgtaaatattattgtggagaaacatttctcttttcccttctgccaccaatgggaattttgatttatggtaaatgacttggaccttatgtttatcaggacaaacatagattcaacaggacacttgactttgtcctaagataatcacgttgcaatgtgtgtgttttaaaaagaaaatcaattaatctcagtaattttaatagtgttagtttttctaaggttaatgttttttcagtttgtgattaattggtgtcattacaagttagctgccctaattaaacaagtatcatactcaactaatttatatgtgcataatgatgtatataaatccatatgtaaattatccgcgtcaaatgtaggtatcaaaatagagcttgtatatatgtataaaatggttatgtgtatttatgtccatttaccgttatctttctattaggttggtgcaaaagtaattgcggttttagtcattaaacgtattaaaagtaatggcaagatcacaattacttttgcaccaacctaaatatctatctctgtgtaggtatccatgattgcacacactctacccacacacaaatagattattaacctttgacatacggttctcttcctaccatgattcaaattatcacactagtttggagtaataatcattaagtcaaaatttaccttttgacatctttgatcctctgtgtctgtgagaatagttgaaaaaactcttaaaaatgcttgtagtgctagaaattcctattttaaaaagtttgcaggggaaaagaacattgaattcattggttctttcacagatatttactgtctacctgatgctagtccatcttacactagtcactgtttaagaaattcagaatatatcagtgagtaaaacagacaaccctatgcctgaggatcttatgttttaggaagtatggaggatcaacaaaaataaacataacaattcagtaaatgatatcgtgtgttcagtaggaaactactatctgtgtacccagtcaagcttgccactggtgtctatatggcacgtgagccaagatttattttatttaacattcttaaaccgttggaaaactttgcaagattttgtgacatgtgataattatatgaaattaaaattcctgtctccataaatttttattgaaacatagccatgaccattggtttaagcattgtttataactgattttgcactgcaacagaagagttgagtagttgagacagagacagaccatatggtccttaaagcttgaattatttaccatctagccctttacaaaacaagtttgccaacccctgagttaaataacttagtaatactttacctctctactgaaatatcgatgtgtttatatagatagatacattaatatctagatctcagttcattaatacattactttgctaaaagcttttccaaattaaaatttaaacatggaggcagttgctggtaagaaatataaagatagcctgtcaaatctcctaagtatcttcattaatagacacattactgtcagataaatgcagaatttaaaatatgatttgcattaaactaacaataatagaattcctatgtgccaaatcctttggctacactaagttctcaaagcaacccactgaagtaggtttttctatttccattttatagacaaagacgcaggaagtttgagtgacttgcccaagatcagagcaaacctggtgggtggttgaaccttgattatatttcactctcttgactctaaatacagtgctattccttctaccctagagttaactctaagccatgcattatactgagtgttgttggttttacagctccttaacactgctaagcaatcaagcaacactgagacttaaatgttatcagcaatttgggttgaaacagtttgaaataccatctaaatccagaatgaagtgaataaatcaagattattttattgaccaggcactataaatgggcatgttccctacttaatgatttagactacatttattataagaacaatgtgtacacttgataaaaatcaaaactccatctaagcttttttatgtttacttagggatatcagttactttccattttcgtaaaccaaattttagaatgaattggtggaatgggtgagggaatagtgggacagataagaggttgtaaatttaaacaaaatgaggatcaagggtagtgaaaacagaattgattttatcaagaactgcagctttgataaccacagataaaagtgagctgtgagcttagataaaaatagagaactcagataaagaggctgggtcgaggtaaaggatataaggtacacataccaaggaccacgaaggtttacctttgcaaaagcaggatgagaagaggggctgagatgaggctatttgagagattaaataataggatgaacacttagggctcctcacttttaagaaacattaaatatgtttgttattatgtgtgttctaaggatgacataatctatcaaaattttccatttttgatttttcatggtcccatttttctaattttttctatttcattctataactaggagttataagttaaatcaaatgattagtggagtgaattggagggttactcattcattaattcaaaaatatttcttgagtgctttttattaggtcagatgctttgctagtcggagaatgcagtaatacagaccatcatggtcactttcctcattaagcttacattttattgcagagacagatagcaaactccttatttcataattatgtagttaaattctttgggctgggtgcagtggctcatgcctgtaatcccagcacattgggaggctgaggtgggctgatcacctgaggtcaggagttcaagaccagcctggccaacatggtgaaaccccatctctactaaaaataaaaaaattagctgggcgtggtagtgcatgcctgtaatcccagctacttgggaggctgagacaggagaatcacttgaaccggagaggtggaggttgcagtgagccaagattgtgccactgcactccagcctgggcgatagagcgagactctgtctcaaaaaaaaaaaaaaaaaatcaaacttttatgaaggggaagtacagagtgctttgagagtatataacagggaattgatctattcagagacagatgcttgagggtataatttttaggctaagaaatcaaagatgagtatgggtgtctgagtttgtttgggttgttataacaaactaccttagactgagcaacttataaacgacaaaaatttatctcttacaattctagaggctgggaagtccaagagaaaggcagtggtagattgattgtctagtgagggcccactttctggttcatagatgtcttctagttcggtccaccttggtggaatgggtgtgggacctcaatcccattcataaaagctctgcccttttgaccttgttacctcccaaggccccacctaatccttatcacattggggattaagtttcagcatacgcattttcggggatatagacattcagaccatagcaaggggtttctccctaaatggggctaggatgtatcagaaaaagaaatatttaacaagccctaaggctgggaggagaagcgtgcacctgttcaaataactgaagggaatgaaagaagctggaatgtggagcagcaagtgggagatgcgagaaacataaagctggagagctggacaggagtgaaactatgctctttgacaacatgttcataacttaatgtttcatctttctggcaacttcaattaattgattttaaacagaagcattatttttaaaggacttttagtgcaacactccagagagtggagtgaattggaggaagccctgaatggatgtgaaagaccagttagaaaataattaatgtggtccaatggagggtaaaataaaggagcaatggtcaagccaggaaaaagtagataggtgtgaggtatgtttagaaaataaaattgcttgtatatagtccaaaattgggtatgagaagtgaaggagtttaggaattatcctaccttctatgactggatccatgaattcactcttgactgagaatcaacactggctgaggactagggttttgcaggtaatattatgagtagcatcctgcaatagtgagcttgaagtgtctgtgggatatctaggccaagacgttgagtgagtcttcaattagatatgagtctgatgctgagaggaaggttccagctggaggtaaaaaaaaaaaaaagaagtaatagcagcggaatgataatataagtcattgtagtgagctacgcagaacagactggatgaggagaacctatctaggtgcatggcctgaggggctttgatcatatcaagaaagatgaaccaattttgaatgctgatgagggttcatgcaaatgaacacagaaaaaatacctcttaggtttagtgacatgagggtttttggagaatttgccagacacatttttgtggaaggatgcagattgaagacatatttaagcataaattacagatgaagacatgaagaaaacaaatatagacagctttttaaagaaatgtagctgtgtgaggaaaaggagttttgataagcagtgacactgaaggaggtaattttagctttggaacattttaagatggaagatactggaaaaagtatatttgaatactgctaagaggctttcagtagagaagtggttggagcttcaataaaatggcattgtatcctagtcttctccaaaaatttagattgacatttgtttttactgccaacttatttatgatgactctttctcatcacagagtgtgtggatttagatgatatatggtcacccgacaatgtttgaagaaagaagggatagtttaaggtgtaagaagggatctggaaaatagattggaagaggcatgttagcatgttagaatgaggtcagaactctacctacttgtgcagatttgatagtgagaattgatgcttcaatttgctgtatgaaataggatcaacaagagctaagacaaagcaatggagatagaatagtcttttcaacaaatggtgctgggacaactgaatatccatacacaaaaggattaagttgaatccctacatcacaccatatacgaaaaattaatccagagtgtatcataaacataaagtagtatctaaacctattaaacttttagaaaaaatgtaggaataaatctttgtaatttaggattaggcatagccttattagatatgacatcaaaagcacaagttccaaaatgaaaaatagataaattagacttaattaaaattcaaaaagtttgtgcttcaaaggataccatcaagagtgaaaaaacaactcacaatgtgggagaaaatatttctaaaacctgtatctgataagaaactcatatgtaggacatacaaagaaattatacaaatcaataatagaaaataacccatttaaaatacaaatgtatttacatacagatgtaaatacagatgtaaacttgggttactataagtcaaaaaggcactttaacttatattttcaacttacgatggtttattgggacataacccatttaagtaagcacactccactgtatttaaccctatttaagtaagtacacttcgtgtaagtcacgccgttgtaagtcaaggagtgcactgaatgcatatcacttttgcaccatagtaaaataaaaaaaatcataagtcaaactgtaattaagttggggaccatctgcacaggcaaaagacctgaattttttccaaaaaattttttccaaaaaatcatactcagatgaccaataaacacatgaaatatgttcaacatccttagctgtcagtaaaatgcaaatgaacactccgatgagataccacttcacatagattaaggtgggtatattcaaaaagataataaagtgtgggagaggatgtagggaaattagaacttccatacactgctggtggaaatataaaatggtgtagcttttctggaaaacagtcttgtagttcctcaaaacatcaaagttatatcaccagcaattccactcctaggtatatatgcctcaaaaattaaaccatatgttcatacaaaaacttgtgcacaaatgttcatagtaagattattcataattgctaaatgagtagaaaaattctaggactggtgtggtggctcatggttgtagtcccagcactttgggaggaacaggcaggtggatctcttgagccgaggatttcgaggccaacctggacaacatggagaaaccccatctctacctgctcccaagccccacagaaaataaaaaaaattagcctgatgtggtggcatgtgcctgtggtcccagctattcggggggctgatgcgggaggattgcataagcctgggaggtcgagggtgcggtgagctgaaattgcaccactgcattctagcttgggcgacagagtgagaccctgtctcagaaaaagaaaaaacccaaatgtctatcaggcaatgaatgtctaaacaaaatgtaatataatcatacaatagaatcttattctactataaaaacaggtaaagtagatacttgctaaacatggatgaatcttgaaaacattatgctaagttaaaaagacagaaaaggtcaaatatatgattctatttatatacatttttagaattggtgaatttatagagaaagaaaatagattggtgatttccaaaagccaggaatggatggctgggatgtgggaaagataatgagtgactgctaatgggcatgggatttctttttggggtgaaaaaaatatgccaaaattgatggtggtggtgcttgcacaactttttgagtccactggaaatcactgaatacttcaattgtgagaattatatggtatatgaataatattttaacaaagctcttatattttttaaaaagagaacagattatttgctgatagcacagagttgggagatcacgttattgaggtttaataagatttggaaaaggtagtttagggaaaaagagagtgagttgattttaaagaatctccatggagaacggagggcttgttaatggagagatgcaatatagtgaaaggacaaagatagagatcctgagatcattaacttgatcaaattcctaattgtataaaatactattaggtaaaattacaatatatgtaaggttataatatatgctcataaatttttgtcttaaaatattatctttagcttgatggcatagtgttaaagtttagataagactaacccagtgaatttagtctgagtctctcagtaattgttttgtgtgcaagaaaattagacagatcaaaattaagcttttaattactttgctttcatgttcagcttttgtgtgatgaacaggaagaaaggggagttaccagaaatattttgagaaacaggtagaaaaataggtgtgggaaagcactttatccacagtacttttgcccgaagaaagtataagatgattgctaggaaaatatcaacccaccttaccacctcttcaccacagcctgtctgcaaccctggagagtaaacattgcttgtctaatgtaaataggaggtaatcaacttcttctcacgtggcttataagatgtgcaagggacgagaagactgtgcaaaccaaataaaatgaactgtcaatttcactcagggaagcatttaagactagttatgcatataagctgcagaaactcatttactcataaaaatcaataagactgccacctgggtcatcaaagggaccatcaccactgtgggaagacaaatcttagctctcatgacaatgagacagaagctgcattcttcattagaccgcagcagctacagcccagcagtattattttttttttccagctgagaaacttttcagcattgcttattctggtcatagcaagtgatttttttcttcctttcataacgcatcactctctcttaaatggtgctttcttgctggaatactttgtagagtgggaaaaggtaaatgaccagaataagaatttcagattaatcgtgatcctgtggtcacactgtaggtgaaatgactagtgttaaatattattacatgtcatttctgagctacagtttcctcagtgaagagtgaattgaatactgtcaaactcacgtttgtcttgacatttcatattatatacataaactctctgaccagaactcaaaaaatgagtcatttgattcttaaaatatttgacaattattgaaaatggtttctagactagcatactgaaatttctccctagcccaccagcatggtttaacatttataaacccttctttacaccaataactcaaagggaaagattaatgtattgagtttatttaagaaaaactgagggatcccactcattttctttcttcttcatctcttattcctatatttttgggtggtcagagcattctttccttcaggaaagtcatggctcctttaaaagcatttcgcacctgaggtctttgtctgaatgggatggatgaatagcctgaagccctacctttgacctgctgtcaaaactccagccattgtatagttattctttttgacctctccacctagttcttttcaatcagggcaggatctgtctccaatttgtttccaagcctcaaatctacatcccttattaacatatttcctccaatccagtcagaggcttaggggtcaaatgtctattggctaaactattttaagtttttctagatatatatggtataaataacactttataaatcaatgtattattttctgctgaaaatttcattgtttagcacaaaattatttttgattcattcatttcaagccaaaatatactcagtatccagcctaaacataggtaagattattttaagtattcttctaagagaatttcttacagaatattatttggaaattttctttttttaatttttaattttaatttttgtggatacatagtaggtgtatatatttacatggtacatgctttgtaccatgttttgatacaggcattcaatgcataataatcacatcttgcaaaatgaggtatccatcccctcaagcatttatccttttattatactcttttagctattttaaaatatacaattaaattattattgactatagtcaccctgttgtgctatcaaatactagatcttattctttcaaactgtattttttgtatccattaaacatccctgcctccctctcacccccttactacccttcccagcctctggtaaccatccttctattttccatctccatgaattcaattattttgatttttagatcccacaaataagtgagaacatgagatgtttgtctttctgtgcctggcttgtttcacttagctaatgacctccaggtctatccatgttgttggaaatgacaggatttcattccttttatggctgaatagcactccattgtatatatgcaccacattttctttttctattcatctgttgatggacacctaagttgtttccaaattttggctactgtgaatagtgctgcaaaactagttttttatttcctgattgctaaagaatgctaactagccacaaatggaatgataccagtttagtgaaaagtcccaaaccactaaggtataaacgagacatggcttgatagttttccccaatcattcctttcatttgtacaatcaaatttctttttaaccctgtgaagtacatgctttaatgacatctttgccaagttccataacttgcctcttctagtttagagcgcaatcccttttctaaatgtaagagacagtactttggtattagagaattcacaacacacaattcaaaatgtacctcttgctcctcccaagctgtggtgctgactggagtggagaaaagggaacatggactgtgactctatgtcacaaatcagacgggagaaagggagacactgtgttaatctattctcacattgttataaagaaatgcctgagactgggtaatttataaagaaaagaggtttggccgggcgcggtggctcacgcctgtaatcccagcactttgggaggccgaggcgggtggatcacgaggtcaggagatcgaaaccatcctggctaacacggtgaaaccctgtctctactagaaatacaaaaaattagtcgggcgtggtggcgggcacctgtagtcccagctactcgggaggctgaggtaggagaatggcgtgaaccctggaggaggagcttgcagtgagctgagatcgcgccactgcactccagcctgtgccacagagcaagactccgtctcaaaaaaaaaaaaaaaaaaaaaagtttaattggctcacggttctgcaggaagcatggctggggaagcctcagggagcttttactcatagtggaaggcaaagccagagacggtgtcttcatatagccagagcaggaggaaggtgagcagggtaggtggtacacacttttaaacagccagatctagtaagaactctatcacgataacagcactgtctctctttggtccagcttggaatacatacctcagcattctctcagtatttgacttcctggaggtcaacacttcccaccactctactaacccggaactcctggcatcatcactggaactgtaaaactaagtgaggagatgtttttgtctctccaaggctgtggagaatatgggacacagactagagatggcttaatattattcccaaacaaatcttgccaccattttttttcaagccctgcttccattccaaatacaccattccaaatactcctgccttcagaagtttctgaaactgaagagaactttagcttgtttaaaagacccctgtaaacctcaggagatgcatgtaaaatgtctccctctttgctccttaatggcagacatactctaaataagtacaatacactttaggcagatgttttccgaatagtcttccaagatctttctgtaccagggtgaacctgagggttctgtggctcagcaggcttccagcccaaaacaagaggtcaatttcctacagtgacctgcaccctcaaattttatgagatctttctgtaagcaccacccatcaccatctcacacacacacacacacacacacacacacacacacacacacacaacttcttggaaagaaaagtattcccccattgtagtcatgacgagaggtgagattagcctgtcatgctgtcttagttctccccactgttcaactgtcttcttcccatattaggcaaaggtggattccacacaaggctggttctcactagtctttcagtgaaccctccagaaaagtgacaacctcagtggctggaggcactaattctagaggaaaaaaaaagttgccatttttctttataatttctaagaccaaaagatatattttatacaagctatttgattactttaaaaaaatttgccacatggcaacaatatgagtcacaccatcaaagctagttagctgggctgggtcacctacttctattttgagaattctgtattttgcattaattagccttatcgttccttcaggctgttttaacaaaatgttgcagactagacagcttataaacaacagcaatttatttctcgcagttctgaaggtggagaagcccaagatcaaggtgccagtacattgagtgtagagtgaggtcccgcttcctggttcatagatgactatcttctgtgtagtagaaagaggactaagggctctctaaggtttcctctataagtacactaatctatttataaggggtgtgcttcatgatctaatcatctcccaaaggccctacctccaaatgccatcacgctgaagattaggtttcaacacatgaatttgttgggggcataaacattcagtccattgcaacacttacgaaaacatataattcagaataagaaaatatttttaaaatttcttgagtagtaggtatgcacagcaaacagtttttgagtgttttaactgtttctcctaatttatttaatttcttatttttccatcagataacattatttgcttattttgctaatagtgaaatgggaaaaataaccattccacaactgtgtagtgtattaatttgttaatctcattaagcaattggaagaatgaaatcactaactgttattgttgtttggagagtgaagatgtctccaccaaagcatagaaaaggatctgtagatgtacagtaaattcaacctgatgctgctattagtttaaatgccttagctaaatggtaccagctgagatcattaactttgctttcatagcaattttcttaatgttacttagcaacttcactttgaaaatacccatttcacatccctgtagcctaaggagcatcattagtagtgaaattacatgtttgattgcatagccagagaagagttaatgttatgacctgaggatctatcactggctgctagaagattgctcagacagcatgcttttaatgcatactacgcagactcagtatcagagccgcgttaaacagataaaaatttatccaccattaattcagaatattaaagggagcatttccatgtgtagtatgttgtaaaatatcaaattaatatttctgcattattgtgtaatgagtaaaaaaaatcaagttttgtgtaagatgaagagtatttgaaacctgagaaattaaaatgtaccaaatgccctttccccttgagaaatgtatgaatgtttcctaatataacctagaaatgatcatgcctttaacaaattaaaatttcttccatgatatgaaaattcctctagggttattgcttctccagaaatgaatgcaatataagaactacagaaactcaaaagtaatcaaaacattacaataaaaccaattatttattcttctttccaattttctgtattttaaaattgttttaattaacatgggtagtattttaagagataagtgattttattacctttgagcaaagatatttaatttaatccaattaatatttattaaatagctatgtacaaataagcattcaatatgacagacaatatttattttttaactcattaaaaaagaattttaagtattctcctctttattctagaaacaaaatgcctttatctttttgggtacacagacattttttgttcaatttgtcttttcaaagacaaggttcatcatattattaagagaagaaagcacacagatatacttcattattattaaaaagttacatctgttcttccatagctttatgacttgatctctgtatttttttttttaattcgtgggtctctcttccactagtctcaccttttttgattacttttatttagaaatggatattcctcaagacttgcttcctctttctttgcttacatactttgattgcttcactgtcatttctatagttgacacaaatcaatattcatctattcattcattcattcattcattcattcattcattgaacatgtactgagtcctactatattccagacacgtgaactaggtggtggggattcaaagatgaataagatatagctcctgcttcaaagggcaagtagatgttgagtatttctgtcttgataggctgacatcttctcatgcttaacacacctaaaatgaagccttttgttacaccaaagtgcatctccaaccagcattttctatttttgtttgttgttatttcatgtttctagtttctcacatttaatttactgactctgcccttcccgtgatgcccatcaatcaatctccattgatgccttttttcaattctctgttcctttgtatcaggacaactcagtctgtaaaagacctttatttataaaagacatattttaaaatttgtattttggtaaattgtgataggaaaaatatgtaagttaaatacaaatgtaaatatgtaagttaaatataaatagtttctagatgtagtaaaagtttaccatctcccacctctaccctctcccacctctaccctctctaaaaattatggctaatgtttctaacatttattgattggtttctacatgccaagtactaaggactttttattccttatctgaaaaaaaattaccacgacagtcctatggcaaagattctatttttatcacccctttagagctaaggaaacaagtgacttaataaaatcaaacaactaaggagtggctgtccagttttaaatgcagagtcagattccagagcctatgtccttccttcactcttctcctgttcaacctttgtaagagcagattatctttgggcttccttcttttggttatacccataatcctaagcaatatgcctttattattttttaatcaactttagacagtgcctcttggctcctcactaggaaagataattgttcatttcatttccctgacacccatgttcactgcttctcccttcaaaatatatgtatatattttagctattttgtagtttatatgttatcttcattttaagttgttttactcaaacactagcatgttaggcaaactattctatgccttgcttttttcatctaaaaatatttctaatatcatatttacacatttatagttggtgttgttaatagctctctaacattagatcaacatacatttaatcattcccctgttgataggtatttaggcttattctacttttctgttaaaacaatacaacaccgaacactgaaggcctctgagattccagatttagaaatgctttactttgacataccaaggttcacaatggaagcttcagttttccccagaatttgttcattttatttagagaatacccctcttctccttccctaagacccatgattatatatctggccatcagtcctatgtgtataggtgggacagagcactgaaagtcactctatattatacccatggtgaatacccctgttgagtcttgattctcattcttaccctttctacagccaactctgagcctgctctttgcagatcctacaaaaaagattggccacctcttctatgacagtgacctcctctgctgtactgcttttctcagaaatttcaatcagctttccatattttaaaaaatatttctcaaatagtcctgatctttctttcagtctctttataagttccatatacccttagatgggagactagctaaaatgtcaaggataagacttatgatgcaaaattatatttattttaaaacaaaatgcataatcaaagtgttcattggaagaaaaagagcaatgagaatctttccctgtttttagagttcttctggcttattttatgtatttgcttatgtgtttagcttcactcagtatagctcttatgctttgattacatataattttatatacaaatcaaaaataaaatgaaaattaaaaattaagaaactatggatggaggacagagggcaaaaagtggtaaaaattagaacatggatccatagagagcacaggttataaacatgtaaaagtgcaatagatttatctacttaactgtagagaattaaactataggagacctgtgaaaacaagaagaaaaagagagaactagttaaatcattcaggaaattgagccatcagtttctataatgagcttgtgatgagagacgaatctgttcttctgaccattacataggctcactcatttcctggctgcctattttagttaagaacatcttgctgtaaatagtgtgaaagtgaagtctgaatatttattgaaaaaaaacatttcacctagtgcttacccaaggaatagcaatcattttcaagattggagaagacactggttgtgtttgatttatcagaatatagcaggtcgatttctaagttggaagctaagaaggagattttcagggatgaatctgactctgtgttattgtggttttatgctgtttttaaaacctaactcctctacaagtttggtctccattgttttgcagttgactggtaaataacatacgagataactggctctcccagaaaatgataactgatacgattcttattttccaatagaagaaatgcacaaattcctcaggaggagcaaaatatttattggaacttagctcggatataaaatcttaaatggctctgcagtgagggaatggtgagagagagagtgaacaagatgattgacagcagtttgaataaaaacatgccacgttactctattgcttctgatagtaattgtagaaaaatgtctaataacgggattaaacttcttgtatttttagggctggtaaaggctcaggaagtattcattaaagaaactgttgctgggtgacattaagaatatttatttttccgatgattccattgagtcaagtgatcttgtgagatacactttgaagttgattaacctggatgtgcaagcctagcccaataacgtttgaagtatttgtaaaataaatccaaagatctcaattagtgataggaattcactttgatctagctccttagttgctaacaaatgcttcttatggcaaattaagtaaggaagaagtgtttgccaaaaagtaactaaaatatatttgtattgttttagcaaaacatagatggaaaaatttaagtgatctttcaagacaaaataataatgtggaataattgagtagttttcagacagcctgtatcattttttgttttccacttgcatgttttattgatttttgtcagcaaaatgttttattgagtattaatcaacaaaaaagagaaagagtcctattactaccgtggtcaacagatataaatacatagaaatgattccaaatatcttctctttatttcttcattcctggcccccaacctatggcggacacatggtctctatcagaatggatgtggctctgctgatgtcatcgtaagactctcctgtcttggatgatatcctggttgagttgagccacatcttcatttggttgtttcgctttgacaaagaaaatcattcaaattgaattatctctgaaagcatcatgtgaacaaagaggtagtaccctgtgttatagtcacttcctcccaggaccttggcctttttatagtatccacccataaatcctcatcatccagacgccagcttgcctccgattggtccatatttttcagtactgttacactaacagttctcttactggtttattttctgcaagtatctagtcagacgagtgggtgtctgatcattgttggctcaaatatatcttgctcagagaaactgagtttgaataaaaagaaacatcaaagcactccaatgatcagttggtaacagcagcttagagttctctctagtttacattatattttgtgccaagtgtgcccaaaggtttgtgattttccacaggaaaattcatgcacaaggcctgacacctattttattcattctgacctccagggtagaatttaagaatgcttctgtagagccaaccattactaatcaatcgtactgattcatgttttgaatgtaaaatcatgctattaaacaaaaatatatatagctggagaagtctggcaaatctctggcttcaagaaatcatgaagaaacaatttccctccacatgtaaaagcttactatataataaatctgtgacgaaagaataaatcaggattgcaaataaatgatttagggagtattggctagctttggggggacaaaatactttagatattaatttcatgcattacaacaaataaatcttacataaattaaaagttaagatttgaaaaaattaaagtcaaaggagaatttaagtatattgttttcaccataaaagataacacttcctatgtacagtattaatgggataaaattaaaattaaaagatggacagaataattcatatgcaaatatctatcatgaaaaaccattcaaaattaaagtaattgtgacattttattcatgttataaagagaatcattaagttcctccccaagtaaccaaaactgtatgcaagatagtcgccacatttcatattccaggaagcacattcacaccttcctatgactactcaggcgcagaaaaatggaaataataataataatacacaaaatattaactatacttaatatactaatttaaaaaactaatttttaaataatttaataatatttctctacataatacattcaatttttataaaatccaaattttataatcacaaaagattttttatttatttaaatatttacttgtccccaatgggaaatgaaacctgccaaatcattgcttctagaagcaaaaatggtcagcaccattttcacatatcatttgctgtttgttttctatcaacctctctggaaattttacttttcagaagttatataaaaatctagaatttggatgtatatttatttgcaaagatgtgtattatacattctaaatgttgaacactagatggataggtaagaaagttaaggtctatttatgcaatgaaatattttgtaatcattaagaattactgggagcgtaatactaatttttttacaaagagagatgttggtcaaggaatataaactttgagacaggatgaacaaattcaagagatctattgtacaacatggtgactatttaataacaggtattatgtacttgaaaattgtgaagagagtagattttaagtattgccatcacaagaaataagtagtgaggtaacgcatatgttatctaggatgatttagccatttcacaatgtataactatttcagaacagcatgttgtacataataaatagatacaacttttagtcaattaaaaaatttagaaaaaaaaatttaaagaaaaaaaaagtgcttatatagctccctgagaggaggatactttccatcttgctcatttacctatcctgtttagaatgcttggcatataacacatgtttagaaaaatggggggaaaaacactaagaaatgtatatgtgctaaagttaatagtttttacctgaggccataggattactattgatatttatcagctatttatttgtatgtaactattcaaattttcaaaacaaaataatgtattccttgcagtattggagaaaacattatttttaaacgttctgcaggcagtaacgaaactcttcagagtcaatctcaatgaagttatttgagaattaaatgcaatctcacctgcatctgaatcatttcatgtgtttacttgaaacagacatatctgagccagggtgggagtgggccagcatttacatttttatcacattttggtgcctcttcgctagactgtccagatgattcatgcccacgttacaggtagagaatcactgggtaaggaagataatcaaaattcagaaaaattcaagagcagaaatgtggcttttaaaataagtttcttaaaagcctgctgaacgtggctagtaaattggtgtagcaaactttctgaaagagaatacaagtgggtgagggacaatgggaacccaagtcataagagtaaaaaggagttgccagcagtaaacctcattaagcttgcaaagaaaaatcaccatagataaacaaatgtaaagctttacatttgttttttcaatgatataaatgcaaaaattagctctactagtaaatagtgacttctaacatggcaagtaaagcatcagacacaatacaataaatatttctagattagtagtctttgatgctgatgagcactatgcaatagttgtctggtaaacacagaatttagatatctttttattctctttcccaaaccaattactctactgatattttgagattctgcattttagattatcgtaacatatgtaaaccacagagtgtcaatcagtcaacaaacacttattaaccacttcctatgtgcagacatatttctaggtattagatatgtaatgatgagcaagaaacaacattcttgctctcaagaaagtttcattcaaatagttgaacacaaatggtaagcacataaatatatacaataaaagataatttaaggtaatgattactacaattaagaaagtaacacctaaataacacaggacaacatgactatatgtgagacattaaagacacagcttttttttttttttttaagctaaagtgatcagaaaagtctctgtgaagaggtaagatttaggctaaatagttgaggcaactagaaaggttctataggaaaagcacttcaggaagattaaataacaaatgtagaggctctgaaatatgaaaaacattgatataattaatatttagaagcaaagtcagtgtaaagaagatggagatgggatgaaatagattgtctgagcaaagactacagaggccatggtgaggaggagagcttgtgggaaagccatcggagaggtttagcagaggaataacatgctaacatgataacatgatcttgattagagtaatcaaacagatcactctgaccatgagttgaaaatggactattgttcaaatagaagggagaaggaagactgtttaaaaggctgtttatgtgtcctagataaaataatttatgtgacttgaatggctgatgaggcgagagttggtgaaaagtaaatttgtaaatagtgtcagtgatgaatttgtaagtagtgctggcagattgtaggaagttgtcaaaaatgaaggcatcaaggatacatacttggtgcaatggactgaattgtgtcttcctcacaatgtatatgttaaagccccaatgtgattgtatttggagatgaggcctttgggaagtaatttggttcagataaggttatgaggctgaggctctcaagatggaattggggcacttataagaagagaaaccagagagcttggcttactctcccatgtgaggacacagcaagaaggtggccatctgcagggcaggaagagagcatcaccagaaactgaccattctggctccctgatatcgtacttctgcctttcagaactgtgagaaaataaagctcttttgttgaaacaactcagtcaatggtatttttttatggcagcctaagctgactaataaactagtttttttattgttggtggtgggttttttttttttttttttttttcttgagatggattcttgctctgtcacccaggctggaatgcaggctcactgcaagctccgcctcctgggttcatgcctttctcctgcctcaacctcccattttcaactcatggtcaagtgatctgcgtgatcatcacaggcacccaccaccacgcccggctatttttttttttttttaaatagagacgtgatttcgctgtgttagccaggatggtcttgatctcctgacctcgtgatctgcccgcctccgcctcccaaaatgctgggattaaaggtgtgagccatgacgcctggccataaactagtttttttttagcttcagcaacctagtgtttactttttttaagttagagaagtcttggaaagcagtaggtttagtatgaggaaacatcaagagtttggttgaatataagattccaattaacctctaagtagcatgattaaatgagttgggtttcttttccttttcctttccttttgtatgtgtaggacttagaaggatcctctggaaaaagataaatatttgacagtcattagtatgaaggagatgtttataacctgcaactaggtgagcttattagagaaactgtgaatagaatagagaagaatgcaaaggactattattttgcaaaatttactttgatgaataaaaagaaattaagcagttgttgaaggagaatgagtagacaaaggataatgttttaagatagttaatactaagcatgtttatttgctgatggaaatgaaccacagaatgggaggaatgtatgatacaggagaagaaaaatagaatatttgccaaagtgaagacaccgagatggtgagaaagaatgagatttgaagcacagatgaagatcaggttacattcttcactgtagcctgagaagaaggcagaatatctagatacagagatagctatggggatgagtttggtagacaaaagaggaggttgttttatatgattatgaattaggaagtaaagttatcacctatgagtggaacggtggggtagcatcaataggttgaaggttctaatgagatgtgaaatgtgggaatattatagtgcatcagatggaaaaataggaattactgatctgagagtggaatgcttgagattataatggcagagctagtgttgtaattggagataagagttcatgattcacgtagtatggaggagcagacagttgatgccgaggatgtcaagcagctcagatatcaaggtgatagatgaattacttatatgaatgttatgcctgcaataataatacaggcacagtagtagagaaatcaactaaactgatgcaatcagtacatgaattataaacaattgactaagaggtgagtaggttatattaaaaaggagaaaaagcctgttgccgtgtgttgagaaagtggcagagtttggaaaaagtaagagaaagaaatggtttgggtacagaaaacggtgacacctacctctaggtcctaaagaagataagatgttcctccaaaaacaagctttacatgattaggattctcaagatcagtcaagcatacatttgaagagaaaggtgaagggatgaaacatgtaacttggaaaactggagaaaaatgaaaagggatatgtcgtacttctgtctgataacattgagaaaatttttggaaattatgatttaagaaatgagtacagttagcaccactatgctgtagtcccaggccaaaccaaattcaaaggcaaggaacatagaccttgccctcattgggagaaatgttgacatcattgctgtactagtaaatgttctacttttaatgcataataactgtagcagggttattcacagtggccaacacctttctaatgtgcaagcctaaagttagtactggtagataaaaacaatttagagaaccataacaaccactaagaaatgactatttttcttgagtcattcaagaaaaaaatgtcttgaatcaagaagaggtaaagcagaggaagtaataatgaaataatttttaaagtcccattgcaatagaatgtttttttcttcaggaaaaggtttttatcagtcagttatagtcctatatactacaagagaaaaaacatacctaccttgataaagagaaaaatacatccataatggaaaaaatattggaaaaatggcttgtattcaagatgaccttttctttaatgattctacaagtttattacatctcgtgatatcaggaaataatggtgctttaaataatctcattgtggtttaaatctgatactatacaggttaaagaaatatcttgaaggtaatatccctttgcagtgtgataaaaatttaaagttaagagaaatatctgtgtcaagccccttattaagaaatgataaaactatctcccagaggtattaaaataccctcctaaaggtcacatttggttaatcaaagacaggagcagagctgggtttccacagaggaacctatcgtattatctttcaaggagaccatctattcactatataacagatacaatgcgttttgctatcaatataaccattaaactaatttgtccaactaatattttttttgagacatagtctagctctgtcacccaggctggagggcagtagtgccatctcagctcactgaaacctctgcctccctggttcaagcgattcttctgtctcatcctcctgagttgcttggactacaggtgcatgccaccacacccagctaatttttgtatttttagtagagacggggtttcaccatgttgaccaagttggtcctgaactcctgacctcaggtaatctgcccaccttggcgtcccaaagtactgggattacaggcatgagccactgcacccagcagtccaaatgaaatttgagaaaattaaatgacatatagtatccccttatttttattttgacttacttgaattgcaaatatagaaaatgaatcaagaccaaaaggggttgaatgttttaaatataaaaataaatgtattttgacaatctgggagaagagggattcaaatgacataatttctatggaacggttttcaaaaggtctgaaaggcctaaaagtattgaatatatcaaaaagaaacagaaacttttgttagagataaaagatcattctattttgggcaagaagaacaaaatacactcattggagaatttaaaaaggtactgacatcctgtgggaaatatgatgtgagcaaaggctttacaaagacaaagtttgaaatgtctgaaaagagaactgagtcatgggccaacaactatggggagggatatatgtacaaagtaaaggttaacactgggcattgattacaaaggaatgaaaaagaacaaagactgaaataccattattctggtcaaccaaccatatttatgattatatgtgtgaacgtttgtgctcatggacacaggcaattcagagatggtccatatttgatttaaaataatgaacatgaaatttaaaaatagtctgaatttggtagaatgcattcagggaattttaagacacttaattcaactcaaaacaacttcgaattcacatatatctaaaatacagcacttcatttgccaaaagtacatgtaggaactattaatgactctctttaagatttatatttttaatcagtcttttgtcttataaagttagtagcagcctattgagtaaattaacatcttactgactattctgttattttgatattaaaattattcattcagaccataagttaccatctagtcaaataagactctaatgacaatatcatccattaatgttgatggaaaaatggcacagattttagttttgtgtgtaaagacttattttgtttgtgttatgaattgaactgtttcttctaagtgtggctaaaactcctggctattgtggaaagtctcttagattttacacaatctggtatatgaatgtatgttttatgtgtgtaaacaaatatgaatactgtttcagctgtaacaggactttgtcattcatattatacttctgggaagaaaagtgcctttctctcattctttctgattcagttgcagtcttgtatccttcgctggcatccatgaaactgtggtaagtttactcatttgcttacaatatgcaaaatctcagctcttcacagttcttggcactattttcccaattccatctcttgctttctatttcccaggctacatgacacattacatcactcatccttccacaatctgaattgtaattctataccttaatttatagtttgctctcctgtaagcctccaataaaaatagttctatccacattctttttgaaatgttgtattcaaaccactcatcacacaaaatttttgaacgtttagtatttaattcatattattaggttaatacagtgtctgctgcttttattttgcactaaaatcagtcatgtatgagattattcaataggtgatgatcattgtgactaatttatccttttattcctagtgcccagcactgtgcctgacacacttaaatgtttctgtaaaaacataaatgaatcaacacaatgaatatttcaaggatttacctacattttcatttaaaagattttataactttaattatttaaagggaaaacatgacaaaatataaaaaaggatatcttcttatcaaaggaaatgttttgtaaatagaatgagactgaaacagaaataaatgccagcaatcaaactgcaatcccagaacagcaggtggtttgaatacttgctttgaaaagcagacatccaacattgctctgacatagatttaagagttgcctctgggaaagatggcaagtcaaaacaagaaaactaagacagtcacccagggatgtatgtgggagacaaaaacatcaatagaatcggcccttttaagaccaatgacaagcactgagtgacagatctatcattgtcttactaataatactgcaggtatcggagtctttatttagttttttgatttatgcattatgtattctcttacaatagacttgttaaatgtagtttaaattgagaagctcctggcctagagatactgcttcaattacccaggcaacatcaactgaatcaattttagaaatgaatccattattaacctgtaaataatatacacattataccttaagaagaaaaaaatatgtagttgtacatcaaaaaatagaaaagtttacagctttttaaaattcttatagttgcgttaaattcaatcatttcacacagttgaactccaacttgttttaggaagtatgctatattatttttctattacttccataataattaccacaaacttagtgtcatacaacatcacccatttattatctcatagttcttaggttgtgtgtttaactggactcaattgggtcctctgtataaatctcacaagactgaaatcagtcaagttatccaacaagctgaactctgattggttggttatgagaaggaattccaacttccttcaggttattagcagaaatgggatgaatccttctcctgctgtaaatctctctggatctctcctctacaataagctagagaaaactgtttttaaagtgttcacgaattacagtgggcccacatggataatctcccttttgattaacatgaagtgaactgattattgattttaattgcatatataccatataatttaacaatcacagacatgatattgcaacatgctcatatcttcaacccaccctccaggattggagattatacagggtggtggtcattgggagtcatccttagaattatgcctaccgatgtgtttagtgctgggaataaaattatgagcaaagtagactcagtctacttttcatacaataaaatacgagctgtataaggaattatcatgtacctatgaacacataaatggagaaccaacccaatctacaatgttgggtaagtgttcccaaagaaaatcacacgtaagctgtgtcctggaggtagcatcagcatttatccagtaaatgacctttttaaggtgatagagtagaagaacgtttaaagcaaaataaatatatatatatatatatatatatattacgagacatgccttgaaagatggtcagcttaagcatgggtgacatagttctcaacatttgcagcagggagagtagtcaagagatggcttgcattgagggagagaagagcaatgggaaaacctttaaagcttttaatcaagatgctacatgattaagtgtatgttttaaaaatgtaatcctggctttaacattcaaaaagagctttcagaggtatagaacttgagcgagtgagaccatttacaaggccattagacataatccaaattgtcaataactgttactgggacaatggtcgtggcataaaggatgtctgtaagttgacatattgagggaattttggaggcggattctaaaacaattggtagttaaataggtataggtgtgaaggaggaaaggaggtcaagaatgatgcctaggtttgtagcttgagccactggaaggatgatgggctattttctgaaattaagaacttggaagagaaagtaagcatgctggaaaaaatgagtggctccatttcaaacatgaaaaatttgaagttcctatacacagccaagtatagatgtttattatacagttggatatactggtctggagctcagataaaagaccaggactagagaaatccatgtgacaaacctcagtctgtaatgttaattggagttacaagagctaaagctgtaccctgggaagggtgtggagtctaagaagagaagacaatctaagatataattatctggtccactgaggattggctcaaggaaaagaagtgcataaaggatactgagaagaaataactcccatatctagaggaagaaccaggcaattgcagttatgcaagaaaagaaatagcaatttcagaatggagagagtagtcaacattttcaaatgctatagaaaagtcctataaaagaggattattaagtggaatggatttagtgataagggactcagtgactttgacagagcattttcagtggtccagtgtaaatgcaatttaaactaaaataggcttaggaataaatctgaatactttctttttctataatattttttcataattaatattctctgggtgtcaatttccagttaacactaagagttggaggaacattccaaaaagaatttgacaatagaagggaatttgtttttcataaagtgtgggtaccagagagcagagtggaagggtattggatgaaagtagtcctgtatcactggatgaagaaaataaatgtatgtttttaaaaataggaacataaaagaacataaaaatctgtgttcaagtctggaaaaccaaagacaatgggggtctatataatgtatttaatttagttgacctcaaaattaccagctatggccagaagaaaataagaaagaagacagaacacagagcccattgtaatagtcagctagaagttaggtagtcagacctctcaggattcagttaggtacttgagggagttcacacttctggtagaaggagaagtgattttccctctagaagggaatggaactggctgcagtctggcttaaatgaaacgactctaaaaagagattgattccttgaaggtattggcatacaagcctccaggaattaattggatagggagctctgtatagcaaggaactattgttaatccattggagccactggtgaagacaaaagggaatgatgggacaagacaatgttttcttttcagcttttattttatattcagggggttcatatgcaggtgcattacataagtatattgcgtgatgctgaggtttggaatatgaattaacccattccccatgtactgagaatagtacccaataggtagtttttcaacactttacccctccctctctctccattgtagtagtctccagtgtctatgcttcccatctttatgtctataagggcccaatgtttagctcccacttataagtgagaatgtgtggtgtttggtttttctgttcttgtgttaattctcttagggtaatggccaccagctgcatctatgttgctgcaaaggcgtgattttcttctttgtgtggctgcatagtattccatggtatatacgtaccacattttctttatttagtcaccatcaatgggcatctaagtagattccctgtctttgctattgtgaacagtgtggcaatgaacatacaggtgcacattctttttggtagaacaatttattttcctttgggtatatacccaggaatgggatttctgggtagaataatagttcagctcttggttatttgagaaatctccaaactgctctctacagtggctgttctagtttacattctcagtatatataactatacccttttctccataactttgccagcatctgttattttttgaggttttaacaaaagccattctgactggtgtgaaatggtatcttattgtggtttcgatttgcgtttctctgatgatgagcattttttcttatgtttgttggccacttgtatatcttcttttgagaagtgtctgtccatgaccttttgttgatttatttaggctccttatagattctggatattagacctttgttggatgcagagtgtgggagtattttctgtaattctgtaggttgtctttttattcctatgatagttttctcttgctgtgcagaagctctttagtttaattaggtctcatttatcgtttttttttcttttgagacaaagtctcattttgtgaccccggctggggtgcagtggcacgatctcggctcactgcaacctctgcctcctgggttcaagcgattctcatgaatcagcctcccaagtagctgggataggtgtgcaccaccacacctggctaatttttgtatttttagtagagatggggtttcgccatgttggcaaggctcatctcaaactcctggcctcaagtgatctgcctgtctgggcctcccaaagtgctgggactacaggcgtgagctaccgcctcaatttttgttttggttgcagttgcttttgagagtatctctctttgcctatgaaatgattctatactaagaaaactctaaataatccgtaaggctcctagaactaataaacaacttcagtaaaatttcaggatacaaaatcagtgtacaaaaattagtaacatttctatacactaataacattgaacctgagggccaaatcaagagtgcaatcccagttacaatagccacaaaagagtaaaatacacctgaatacagctaaccaaggaggggaaagatctctattacagatactatgaaacactgctgaaagaagtcagtgaagacacaaataaatggacaaacattccatgcttataaactggaaaaatcactatcattaaaatggccctacttgcctagaacagtttacagagtcaacactattcctatcaaactaccaatgacatttttcacagaattagaaaaaactactctaaaattcatatggaaccaacgaagaatccaaatagccaaagcaatcctaactaatcaaaaagaacaaagccagaggcatcacaaatatatgttaaggcaagtggcctagaggcagtcaggaccatatacttggctatgaaaagtacttgaatttaatatgcattatttaagaggcaaaaaacccaatagtgtttgactcacaaaataaacacagcatttggctggtaggagtgtataaagtgaagtgaaatctcgagacaaataaagaaaatttaaaataccattctgaaataattgctgaaggctaggatggaatcaaaatgaatatatttgtgtaggcttgttatgtgcaaaaccctagctatctattgaaaaatcaaggatgattcttctggataccccaaatttatgagataatatccaactctcctcattaggttatctcactctttcttgctacataacatatacaggtagacatcctaggattaggaaatgggaaacttgagtggatacaaaaatataatgtagactcattacacagacacttatttaaaactttgcagtaaatagtaccaaataagactataccatagagtgaggtatgcagagatcctgggacccataatattcagaagattactaggatgtaaaagaaaatacaagtcaattatttttagacattatttttaaatgtatatatcaactgttttcactcatcaatagtaccaggatataggattcttcaaaaatagtagataagaatggtactaagaaaaaaagtaatattggaatccttcagaagtcttttaaagtgaatattgtctcctggttcaattgtggtggtttcaggaagcttacaacattctgtgaagactgttctgagctactccaaaaaaactcaaaagcccaactgcataggggttcgtgcataagagtatcaggtctacatgatcctgagaatttcaatcctcctaaagtagaaggaacaatatgaccacatcacaataaattttttttctcacatttgttccagatagctctatacccagtagccacttgaataaatagatgtcctgatccttgttagaaataaagtaaaaaatagatatgcaactgtgttagactgttttgcattgcaataatggaataccggaggctgggtaatttataaataaaagaggttaattttggctcacaaccctgcagactgcacaagaagcatggcaccagcatctgcttctggtgaggcctcaagaagcttataatcatgatggaaggagaagggggagcaggcatgtcacatggtgtgagagcaagcaagagagaggggaggaagtcccaggctctttctaacagtgagctctcacatgaactcatagagtgagaaaatactcattactgagagtatggcacaaagccatccatgagggctctgcctgcatgacccaaacacctcccaccaggcaccatgtctaacatgggggatcatatttcaacatgagacttggaggtaaaagatatccaaaccatatttccagatgaacactgtggattacaacattctataattggtggtttaggataaaatggatatagaaacaaattagaagttgtgaaatcaccaactatgttcctgtgaatatttactaagtttattgttgaaaatgtttcattgaaaaagttgaaaatatacttgtgttacaaaaaaaacaatttttgagctcctaacagtttatgaaacaccttgaagataaggaataaaaataaataaaacacatatgtggttgcaaatagttcaaggtataatgagagtgacaaaggggcaaggtagtaatgataatatattgctgactgactgcatgcatagcagcggtatgtagaacatgttacaacagtacagaggcagcaaaaagatgcagtagcctcacatttctgaaagcattagtgcaggtggccatctattgaataaggaaggcagggaagggatgtgcaaaaaagtagcagcacatctgtttctgaggaaaatgaatagctgaccagctgcaaagaaaaatgttcttgatcattgttgagggcccagctgagatgagaaaccacacatgtgtggattcctattatttcccagtcatgctcagctgctacatgtgggagcatacacctggaatgtaggattgccaattttgtacgatgagtgaaaaaaagacttgaaggtaataatggagtttggtcgacctgccgtgtggttcaaactctgtaggaaaggaaatgagcccaaagatgtgataaaatgggaaattggacggatcctgagattggaatgataaatttttaaatacatacataggtatagaaggaatgcctacacagcaggtattgtctggaagagggatattagttcaatagatgtatatgtttttgagagggcacagtttgtgtcaggaataacctgcagaaatcaaaagagtcagtttgatgtgagaagcaagaaaaagggaaaagttatttatctaataaatatttattgagcagcctctgtgtgccaggaattatacaagctgctggagttacagaaatgagtaagactcaattcagggtctcaattagatcagcctgctggaatgattgatgtttccagccttgaaatcactgtggttgagaaggtggcagtttcaaaaggcagtactaaatattagtattcatttaataagagaactgatgtaacaaaccaagtggtaatacaaaccagacaagccagatagaatgcttaattgtgaaaagaagtattgcatacggaaaacctaggagagtaataataggatggccctctagtgagtacacagaggaagaaaagagaagagtggattcctgaaatctaaaaaaaaaaaaaaaaaaaaaaaaagtctaaacttaagggatgggtagagaaagaaagaaaccattgaaagaaactagaggtgagaccagttaatttgcttctaagacaaattaagagggttccagaataataaaatggtcatcatagtccagtgactcagaggtcaagctgaaaaagacagaattgtttgaatagatgtggcagttagaaaaatatcaatgatcttagcaggtgctattttcaggtagttcaggtggcatacatagtcctctggttagaagaatgcctgaaagatttataaaattatgtataatcaatggatgatcagcagttcttaggttgtctaataactaccaactataggctgtatcattggtctttatttttctctgtatttcaatgagtgcaaattttttctttcatttattccttcctctcttttcctttcttcctttctccttttctttccttgctcctttcccctcctctcccctctctctcctctcaagagatgtataggttcctttcctttctctctctctctctttttttttttaacaaagattctctttttgtgattttttttgttttattttattttattttattttattatactttaagttttagggtacatgtgcacattgtgcaggttagttacatatgtatacatgtgccatgctggtgtgctgcacccattaacttgtcatttagcattaggtatatctcctaaagctatccctcctccctccccccaccccacaacagtccccagagtgtgatgttccccttcctgtgtccatgtgttctcattgttcatttcccacctatgagtgagaatatgtggtgtttggttttttgttcttgtgatagtttactgagaatgatgatttccaatttcatccatgtccctaaaaaggacatgaactcatcattttttatggctgcatagtattccatggtgtatatgtgccacattttcttaatccagtctatcattgttggacgtttgggttggttccaagtctttgctatcgtgaataatgccgcaataaacatacgtgtgcatgtgtctttatagcagcatgatattctctcttgcccaggctagagtccaatgccaagatcatagctcactgtggccttgaactcctagcttcaactgatcctcctgagtagctgggattataggcatgagccactgtgccaggcagtatcattggtcttttttttaaatttttaatttttctgagtacatagtaggtatatatgtttattggatatatgaggtattttgatacaggcatgtaatgtgtaataattacatcaatgtaactggactgtctatcacctcaagcatttatcttttgtgttacaaaccaattatattcttttagtttttaaaatgtacaattaaattattgctgactatagtcactttgtgctataaaatactagattttattcattctttctaactttttttttacccaataattatccccatttcaccttctctgccttaaccccctggtacccttcccagcctctggtaaccatctttctactctctatccctgtcagttcaattgttttaatttttagctcccacaaataagtgagaaaatgtgtatttgtctttctgtgcctggctcattgtacttaatgtaatgacttccagttccatccatgttattgcaaaggacaggatactagatccatgttgttgcaaaggacaggataccattctttttttatggctagatagtgctccattttgtctaagtaccacattttctttatccattcatctgctgatggacatgcaggttgcttctagatcttggctattgtgaatagttctgcaataaacatgagagtgcagatatctcttcgatataccgatttcctttcttttgcatgtatacctagcagtggaattgctggttcatacagtagttctattttgagttttgtgaggaacacccaagctgttctccacagtggtggtactaatatacattcccaccaacagtgtatgaggattaccttttctccacatccttgccagcatttgttatcgtctgtcttttggatacaagccattttaactggggtgagatgacatctcattgcagttttgatttgcatttatctgatgatcggtgatgttgagtatcttttcatatagctgttttccatttgtatgtcttcttttcagaaatgtctattaaaatctttagtccatttttaaattggattgttaaattttttcatatagagttgtttgaggttcttacatattctggttattagtctctcatcagatatatagtttatagatattttctcccattctatgggtttgtctctttactttgttgattgtttactttgttgtgcagaagcttattatgtagatgtggtcccatttgtccacttttgctttggttgcctgtgcttataaggtattattcaagaaatctttgcctagtccagtgtcctgaagagtttccccaaagttttcttttagtcatttcacagtttgaggtcttagatttaagtctttaatccatttttattttattttggtaaatgttgagagatagaagtctagtctctttggtcttttagatgagatgcaagatatgcacatttacttgggaaatttatatataaagtataacttatacatgaatgcataaaaattaatctgtagctaagactagaaggaactagaccacaataagaatagaagcttttttagtagggatatattacttgtgggaattaggatggcttaaaaaaatagcttcatcatcaggaaatgaaaaaaaaagtcccatactcaacaaacttcaaatgatgtaaatgatttataatgtaattttcctgcagagtgaaatcatatgcttttgaaagtaaagtaatggattattctgacatggacaagtaattccacttattattaccttcgcattttaaagatgacatgaaatgtaaagatcatttaaatttaacaaatgacctctgattaccaggaaaaaaaggccaccttgcagggcgtgcagaagtgaacatatgtttaagagtgctattgcatttccaacataattagtcatctaactatgtattcaaatgaagctaatggatttctaagtacaattaactatgatttatctaagaacattgcagtttgaattcttttctcccaatttgttcgtaattattcttttatataaatttgttaattatttatgggcgaatttcactttggccaaattaaaatctatttccacaatgcagcagctatcgaacagcaattaaaaggtggtgattgaagaaaatgcagctttacttattgttttccaaagggaaacattatttgagaagttaggcaaataatttctctcagttctactttaaaggaattaaagatgaatgagaactttaaaaatattttaagattaaaaaagtgaatatatactaatttattctataacagttttactttttattcatcttggtttcatttattggcatttaaagagaataaagtattgtatattcatgcattttcttttgagtttttgtagaaggatacgggaaagttaaaatatagcaaatgaatgactcattttataatttttagctaaatacagtgtgcttataaaatgtacatcaataaattcaacttggtttaaaaattagccaactatgtgtgattttaaaaattgatttggtatcagatacatgaaatactaaacaaaacttatctactgtaatattatgagataactatcttcaaattttaaaaatgcttttagaaatgctcagcagtgtggtagagatgtatgtcagtattatcaataatttaaaacttattagatgctttttcagaaaaatacagtaatgttatcttgatgagcatggatttggactcagcataatcagtaaaatgagcctcaggaaaagtattataccatttctttttgttgagtttattatttcactttggtataagaattgctcattcaaaataccttaggaaaactttaaaattgataattcagcacatggacttaattcacatcaaaactcaatttgtctttgttatggaactttgagagattcctgcttaatggtataagagaaattcttcattaaagaagcccacacagttataccccacaaaaagctaatgctattgggcactgtagaagtgcctactgtgaggtctataacttgtaagaatcaagatgggtgatgtgttatgtagtttaattcatccatatgttcaaggcagttctggtaactctcaggtaaagtgcaggctcgagactctctttacaaccatttttatagaagctcagcttttctactaggaaatcctcctaaggttttcaatccaaaggtctttcaaaaatgtgatattcaaggtttcctaggtaaagtgaaaaagccatacatacattgaacaaaagaaacgatgataacaatagtggttaacattaaaatagtatatgcagttccaatttcttattttggtgccagtggactgagggaaagggctttttgttcctttggcccttgacctctgcactttgactctaatccttgtttccagcttccagatttagcctctcatgtcatcgagtcacatggagtaattaaaccgctctcaactcctagggaatctcacatgcaatacagagaatggaaaatccatattatctatactttatgtttaaatatgagtgtttattaatgtaaatcaaatatgaatacatgactgtatgctgtatttttattagaataaaatttaaaatctacagttttagtttttccacttagacaagtattatgtaatgcagtaaacaaattagcaaatgaaagcagtggaatggaataatttgataagagttctaaaagaacagtgaaatagggcaaaatgccaccagtttatagtatttcatgaatactgaaaatcaagaatagtaactacctaaatgatggaattctgacttgagtattacactttaaagataaacttcacacagattcattgaaaaaacaaaaaattatttagcatatgtttcatatgtttttatgttcatactgttattaccagaatactagaaaattgtatacttacttctttgttattctacattaatcatagtctaataaattaaaaagcacggccccaaagaactttctttcaaccctttaaaaaaaatcttaagtatatttttgttattatacattaatcatagtctgattaaaattaagaatagaaagacctgtatgtcaaactccaaacaaaaggaaagtaaaactaaaccaaatttatgaattattcagagagtttcagaagtaaaacatttcttccctttttttgcatttacaatgaaccttgaaagactaagaacttggaacaaaagaaattgggagaagatatatatattcactggattcctatctcccacgccagcaacacacacagacctgaagtacaggtcgagtatcctttgtaagaaaagcttgagaacagaagtatttcatatgttagattgatgcagattttggaatatttgcatatacataatgagatatcttagggatgggacccaagtttaaatatgtaatttatttatgtctcatacataacttatacccataacctgaagctaattgtagacagtatttttaatatttttgtggactcatcacatgaggtcaggtgtggaatttttcacttgtggcatcatgttggtgctcaaaaagttctggattttagagcattttagagttcaggtttttggattggggatgttcaacctggatttcagtttacagttctagtcaaacacttatgaagtaaagaaaaactatgcttagaagctgcaggctggttgatgttataacctataaggtgacagagagaacatgtaacactgaacacttgaggacaaatgcaaggccaacatgcagattatacattgcatcccagctacatgacatcataaagcatcgtgtggaagagattaatcccttggtcaagcttccggaagagtctctgtgtctccaggaccaacctgtagcggtcaccagacttcttaagtcttagtgggtttcattgttgttgttgttttgtcatctttaagatggaataatactgagttattgagggaaaactaaaatgagataagaaaggtaaaggttttagccagttcctggcacagaggaagtcctcagtaaaggttacctgttttctttattatgaaaaatattgactcttgagaatcaaatctatcattttcacttcaagattacaaacaacagcaataattaatgaattgtgattttaatagaaatatgtacatgtgccaatatgccacatattaatatccatctcactgacccaagtacgtagctgttctttttcaggtcctaccagaaaaaaaataaacagcagctgttctttagtggtaggcaggattcaaaaatcactttctgccactctacttttgagtaccaaagtgccagaagcctgaatcacaaatttagcagtgcattacaaatcagttaactgacttgttcccttggtgaaatgaaatgaacaatctggtctaggtctactcaggacatctgtgtagatttctagcttgtgggggagacttgacctatttcctccatgtcatctacacctaaaatttacatgaagacatgtaaaaagtactatattagctcaacacttcaacagattaaaaaaaaaacaccgaaataattttagtgccatgcaagataggaatcaaagtgattaacgttatgtatatgaaagtcaagatttctatcataaggaatatgtatcctaaataatgatatgttctgcacgtggcacaatcaacactagacattagaaaatgtgtaattatagtcaataataaaagtcactaatccaatcttgtttttagtgtacttaatgggtgtcgatagagactgacttgtgttttcacctattttatatttaccatgaaattagcaacactttagaattgctgcaaaattgtcaaaggttgggtcagaagaaacgaaatgtacatgtacctgtatgagcttcaaatgtaatcaacttttggaaattcaagagaagtctaagcattgtaaatcatacgtttagtacaagtatctctgcgatgtggtgataaatgttttcagaacaaacaataatacctcctactctgtaatatcatgcactgaagaaaataggactaaggggaaaaataggattgggagcaacccagaaaaacggatgcaactttctagcaggaacaaatataatacaattctaataaaaataataatacagttaaaatagtaaatccctcattgagagataattaactgttactataggactttatttttaaaaacgatggtgaaagtaactggaaggaggtaggttgaaactgcaggattacagaaacgcaggaaaatgtaaatatgaaagagactgtgaactttcacctataggtacaaatgtagaaataactatgtcacattttaacaagtcctagttatcaaagaagtattgttggtgaagtcactttttaacaaaaacaaatacagaaaaagtgtggatttactcaacaacaaaaataagaaaactcaagttcttagaaggagtagaataaaaatacattaataaaggcttatcggaaatacatttcaaattttaaaaataaaagctatccttcgagaccatcatatgtgcccaactttgctctttgcactaattcacatttaatacttaaggtaaaaagctacaaggaaggtataatgattactccaaaaaaaacaaaaaaaacaaccaagtcccactctgtcgcccaagctgtagtgcagtggcgcgatctcagctcactgcaacctctgcctcccaggttcaagtgattctcctacctcagcctccctagtatctgggattataggcacacacagccacacccggctaatattttgtatttttagtggtgacggggtttcaccgtgttgcccaggctggtcttgaactcctgagctcaggcaatccacctgcctcggcctcccaaagtgctgggattacaggcatgagccaccacgcccgtcagattactcttatttttataggtaagaaaactagcacagaaagctaattcccagctactgcaattacttgccgagggacagaaagggctggattttaaactcgggagaactggcttgagatcctacttcctataaccctatgccgcactactacgcagtatctcagccagctggaactgtgattgcaataccaacataatcctctacttgtatttcatcccaaatccatatgaatgtgattatttttcattcattcctcacattctagaataatatgtaaaggaaagtgctttttctgacatgtaaaatgtcctgaaaatgcaatacaactattgctcattctaattttatagtttaaattgtacatagcattgaaagcgagttccattgtaacgaatgtctaaataacatgccttctaatgaaaaatcattccaaaatgttttcttgctaatataatcttgatgtttatggagtttttaatccaaatcagcatgtagggtacttctcggttgtggtatgaacattaacatggaaaataggttgaactgaaaacaagcaaaggaagagcgggattcaccaggaagctctggtacactgaatgacatgagccccgcgccgactccaagattagcaaataaattgaacagagagaaagtgaaaccatataaactatttcaagtttctataatttctcatgaaaatagaagtttctaactaaaggcattgcaatgttttgacattcctaatatattctgaaagaaattgcaaaatgcagcgctaatgaaatcagactgtcttttctccctaatctctcttacgaaaaaaataataccggtatgtatttgagggaaatggaagcatagcatcagaaaggatggcaaggtggaactgtaacaccacatttattctttcttcatccaggctgtttgtcaattttatataaatgttggaaaatatgaggctacatttctttcatttaaaattaccttttccttgttccagcaagggcagggcatgttattatttaggctacacagtccttgttaatgacagaaatatccattgtcgtataaatagcacgcaaaatgtctgattttatccatctggtaccacagtagtcaagagtatctccttcagggtcagggtcagaaataaaccctctaactatatcccatgatacaaagctcaaacctaagtgttaaacatatgttcatggttaaacctatctatgcttagtataaaccatattcatcaggcatagaacaaaacaaaacaatacaaaaatagccctgaaaatacttttagtaattttatctccaggtttgtgatgagtttgtttgtttttgaatccgtgaggacatttttttccttttacaaaatttaataattctctcataaatgtgacttgtctttatcaaaaattgatttactggttttatgttgtttttttgcttctgtttatttgttttagtcagaagcaatatgattttaccattgtattgcttatctgtagtatttttctgtaaagcactgactttgaggaacctccactgtgaattgttgaatataaccaagattcaacggaatggccttttgcattcctacagcaaagtagaataacacattccatgataagtaccacaacttcacattaatcctcataataaatgctcaaaaatattttgggtgtgaatttatcatgtaccaggaacaagactaatggtaaaagagtagacaagatagatgtgatccctgccctcaaggagctttcactctagtgagatctatcttgacatggtatgcatttgcccatacttggtgtctagttatggagccaaagatggagcctttgtcctcaccgatgatgaaaactcaggacctcaggaaaaagtcagaggcatttggtgttcatcatttttctaaactcatccttttagtgatttttttaaacttcagtgaatttatatataaaaacagaaggaaatattccattctgcttaaaaaaatgcattataagaaatagctggaccaatgagcttaattctgttattctgtaacaagaacataggctattataatcatagctccagtaaatgctaatatcctgagggagatgagctgtatctttttcatgtcagtatcacccacttaatttacacatgctatatgttaaatatgtattgagaaagaggtacgaactcagagcaaggaatggaagaggcctcatttttcccacccaggaagtaggctgcaatgttaccaccaggactccacattcagataggaaatgttcccttgctgatagtggatactgaacactgaaggaacttagaaacttcattagtttcacagaaggtggccactataaatagtatatgctatgaccattcataaatatagttataatatgtcagcttatctcagtattctgctcaagggaaaaggatagaaatatccagaggtgaaaaaatgaatttcccctaaagaaatacattgtatatattttatgtatgatctctaaaaattcaagatttatttgggaaaaattaaatgaataccactgaaatagataatcataaagtgtaatcagtcactatctctagaattgtgttttgtaaacaactctggtgtaagcgatatccatgtaacacaaaaacacactgattttataatgtatactatgaatagattttgatggagtaagacataggaaagatgacacatgactaatcataggtatgaaaaaacaattggttaaatgctattatgacagcccaaattctgagattcttaaaaaaactatataaatttaaaaacacttttacttctgaaactgtatatgtttttgttaaaattatgttttaaagttcatttctgagctatcagctattaaaagctaagccagaattgtaacatctgtcattgccatgtctcaaggccatcagggaaaaataaataagcataacatcactatttcagcgaaatgttcaaactcactgcatattaccagttatcaaaaaacgtgtctctttttggagggtgagtaaacttcttttgggttcttttattaaaatgcagactttgaactgccgatttgtttcaaaaagacctttctcaaatagagaaaacacagacatccaaatgctaacacatttttcttttaaaaaataaatcaccatattttaattgctttaaaaaggatacaataattgttgcacattttacactatgtaactactgactatattatcctgacattaaagtgttgatgtcggccaaaagttgattttcccagatagtgactgccacattcactgtaggtcctttcctttctgctgtataatttagattcttaacactaaggaacattgcctaaaggagcacttgctcttaagttctcgaaggatgctacagctcctgaaggatgctgtctgctgtacagttttacttgaatatacaacaggtggctctaaatcactatgcatcaaactatgttctttatctcttcccccaaacttgaagtgctttctcaagtatcagttaatgagttgacattagctaagtttacttcctttccttcagcacctccctttccgtcatccatcctccataatatctctagctttcaacaccttggactagctacataattcatgaggccagtgcaaaatgaaaatttggaactccttgttcaacactactaagaatttctagactgtgacaaagagaacattcaaccaaatgtggacccttgtgagcgtgggtctctgtgcagctgctcagactgctcatccatgaagccagcatttctgtcacctctttctctaattttctgaggactcttgtcctccactcttgaaaatcctttctctgtcatccttttctgtattctctcctcaccctcacagtctatctcttacatcagggtttttcaatctcagcactattgacatattagactagactggataatgtttttataatttcaactttcattttagattaaagtgtacatgtgcatgtttgttacatgagcacctagcatgatgctgagggttggggtacgaatgattccattccaggtactaagaatagtacccaataggtagtttttcagcccttgctcctctccttctctgccccatctagttgtcctctgtgtctgttgttcccatctttatgtccatgtgtactcaatgtttagctcccacttacacgtgagaacatgcggtatttggttttctgtttctgcattagttcactgttaatggcctccagctgcatccatgttctccaaaggagatgattttgttctttcttacatctgtgtaggattcatagtgtataggtatgacattttctttatccaatccaccactgacaggcacctaggttgattccatgtctttgctatggtgaatagtgctgtgatgaacatgtgagtgcatgttggtctggataattctttgttgtgaaggactattctgtgcatgtaaaaatgtttagcattatccttagtctctgcttactagattaccagcacccttctccttccccagttgtgagaatcaaaaacatctccaggcattcccatatgtccactgaagggcaaaattgtcccctattgaaaatcattgctcacattatcagactgctctttacaaaacatcgagatggtcatgctaccccaggctcacaggttttgaagaactctatcgaggataattataggatgaattccaactcttcatcatagtattcagggttgtcataacatggctttgtgtatctcgctagctcaaatttagcctatttattttccttaagctttatattccatccatgcaaaatggcttaatgttttatttacacactttttaatatttttgtaactctgcttgctctaatatctttgattacattatcctgccatacatctctcctctcatctcccaattcctgatttattgacccttacggttaatctagaggagcattttcttctgatgaagtgttgcctgtccttacactattccacgcagaactgactattgcttcctctctgtcctgcgttgtacctacacgtgtattgtcccggcatgctgttgctaaattgaggtaatcaagagaagatgaagttttcagttcttcaaagcatttccaaaaattgaaagactgattccatctttagtaacattacactgaggaactccaacttcccttggagcttatgtttctatatggcaagtttcaaatagaaaaactcctgttatgtctgcatgtcagtcataaattgtggttatccttggttttctacatgcctaattcagtattctagtctatatgcttaaaggctggggaatgttcattgtacttatttatatctctgacatatagcatactgcttaacacatactagttattattctttttttggggggggcagggtgggggatgaagttttgcttttgttgcccaggagtgcagtggcgcgatcttgactcactgcaacctccacatcccgggtttaagatattctcctgcctcagcctcccaaatagctgggattacaggggcctaccaccatgcctggctaatttctgtatttttagtagagacggggtttcaccatgttggcaggctggtcttgaactcctgacctcaggtgatctgcctgctttggccccccaaagtgctgggatttcaggcgtgagctaccgtgccctgccttacttattcttttttttaaaagaaagggagggaaaaagagagggagaaaaagagagaaagaggaagggagggaggcaagaaagaagacaaagaatagggaaagataagaaatttctgttttgaatcagagctctgagtttcttaatatatgggctacagatgaatatttaggcaaactgtcctggtcagcatgtacatatccagattctttatcatccttattacggtcatcatcaccatcacattaataaacacagtgataagaacatctactgggagctttctaaacaccttatgcaacaatgcttttaagcaacccacgtgctttgtgagtgcctactttggaaaatttgaataatgctgtttttattaatatatgcaccctaatattatcatttaagatgtatagtttaatgttcagatatgtgcatatttactcatgtgtactctaaacaaagcatataactatgctttgttagtccagatgaaatgtatacatcttatctcaagatgatactgggttttatcaaagtgaaacagatttgattttagcatctccacatcttattgaaaatatattttctagtttatataacaaaaatattacagaatgaattacacacttgcataactacccacataattttgatagcacaaagacatacttcatataatggtaggcaagctatgagttagggagaccaaaacaggattctgtgactagggctcgtgagatgtccttcactgatgggttgacagaagatttcaaatcactgttcctcatgattacactctgattatgaatttaaatctcttgtagtccatctgttcatcaaagagtaatttactgtcaaatccaataagtgacagggtattcctttcctttatttctgaccttgttcttggcacagaagaagtcggttcaaatatgacaaattttcccctgacagctggacgattgttcacagtggccaaatgagaaatctgttgcagggaatagacaggctggatgtaccgaatattttaccattctaaaaggttcttttgaatgcacatattagttctcaaatttttttgccttatttaataattttctacatgtatgttttgttagtcctgatgaaatgcatacatcttatctcattacttttgatatataacctatgtcagcaacttgttttattttttaaaaactaaattttcactttttttcagcttgtctctctagcttaaaacatctaattagctctaactttagcttttttaaaaaagaaaaggcattctttagaaataggcagaaaatttatttttttctgctagattgtggtttctttgaagataaagtatgtttaaaatttatctttgtatctttaccacatagcaaaataactggtagaattcacttttacaaaatatcctgtaaattatttaagtccttcaaggagaagtattgttatgtaattatttattatgactaaacaattcaagtacaaacaatcttaatctggattttcacacagtctccagctgaacatgccataaaaataaaaaaaatttacaataaaattcttacctattaattacatttatacaaaaccaattacagtgcattagatatttaaggggtacaatttgtatcgtatttttattacagtgttgttaaaaactaatatgtgttttgttaattttatgtcttttcactaaaatcaatgtattttaaaaaacaaaagagatgtggcatgtacaaggcatacatttactccccaaacagaatacatagaacttgacagtagaggactctatcagcaacttccttcctttcttactttctttttttttctttctgcaaggaaaagttatgtccaatatatgctaagcattttgccatgggtctaataaattaaaaacaattagtatattttatgattatatgtcctagtggatattgaagaaatttgagtccttatatcacattcaaggggcttatgcagtagtccttgagaccaactaaatgctcagttgtgtgactcactctacaaatatagtagttgttcccataaggaagaaaatattgaaatgtgctatcaggaaggtcaagttgaactcagtcctgaaggctggctagtgtttaaggaaatggagacaggccagaagaagacttaatgttctgaggtaagagaaatatgttaaagtatgtgtgaaagtaacataaaaagtgtgctagagctaggtatataaccctcaggaccttggatcctaggttgttctagatcctagggtgacataatgaaagttgtgtttctccagtaggaggtatgagttgtattgcaggaaaggaattagaataagagaaaatagctgggaaacaaatctgagtgaagcttgaagatgttacatggaaagaaacattgggttttaaaaatagatgagtaagacttcctctacacacatggctaagtcaacattttttttttctgaaaatccattaagagcatcaggagaataaaaaataaatcctgtaaactttctatttggtgaaactaaataagaagtattccctgtagattcaaaaatacagagaagatgcaaaaagtacaaaaaggaaaattggataatgagaggatttttgaggagcagaaaaattcattaattgattcaacgaatatgtattgagctgcttctatgggtcaggtcctgctttaggcatgagattataataaataatggaatggacagaagttcctgctctcatggagcttttgtgtagctgaggaagataaggaacacacaaaatacttaacctatgtagtgtgaggaagggtggctaagtactgagaaaaacaaatcaggaaaaagtaatacggattgtggaaaaagagacatagaaatatccatttaaactagactagtcagggaaggtggaatggattgaatgtttgtgtcctgctccgttcctcaaattcatacattgacccagattcccaatgtgatagtaactggagattatgcttttgggaggcaattaggcaataagggctgagccctcatggtgggattaatgcctttgtaagaagagacactagagagcttgcctcctttctctgctttccacttcatgagcacacaacaggatgatgccaacttacaaactaggaagaggacccttagcagacactgggtctgctgcccggttgatcttcaacttctcagcctccagaactgtgagaaataaacatttgttgtttaagccagcctgtctgtggtaatttgttacaacagcctgagctaagacagatgcacctctgaaaagtcatatttgggcaaagacctgtgtgaagtgagggagataaaggaacagcaagtggaaaagcccaaaggctcaggatagctgatgggcagctgggatgccagtgcggctgaacccgaaagaaccaggtgactatcaggaaactctaccagttagagaggtaccagtatgcttagctgtgtgtggccttgccagcgatagggaaaagtgggcatttaatcagagtgacagcggaagccactagagggttttgagcaaaaagactgatgtgatctgattgacattttcgtaggatcactttgtttggctggctcattgaaaacagactacagggttcgaggtggaagcagaggcaccaatgaggagagtttgtaacatacaaggtgagaggtggtggtgaagtcagccagggcaataccagcagaggcggtgaaaggtgattagaatccaggtctgttttgaaggtagagagtttaaggttggatgaagtgtgagatatgaaagaagcatccaggtgagtcccacgttttggcttgagtgactggaatgatggactggagatttactcagatgtggcagaagcaggggtttttcttgaagaagagcaataatttgttttgcaaatgttaaatttgaggaggttattgaaaattcacgtacagatacatagtagacaattgaatctatgagtggagcttaggtgagagttctgggctggagacacaaatccaacagttgtcccaaatttagatggtatttaaagccacaggactgggagagatctccaaacaaattttgtgttttgttcatgtctttttttttttttttcgcccggagtttttctcttgctgcccaggctggagtgcagtggcatgatctcggttcactgcaacctctgcctcccaggttcaagtgattctcctgcctcagcctcccgagtaggtgggattacaggcatgtgccaccacacttggctaattttgtatttttagtagagatggggtttctccatgttggtcaggttttgttcatttttaaatcaaggagttcaaggcatctgtcagaaagcatggcaaagacgaagcacataccctgcaagaggacatctatttttttcctatttgcagtgccagaataaggcacatccatgccagcaccagctgggacctgcttttattcagagaatagagggggcaaggatagggcttcaccagaacctcacagatgagcccgatttacatgaggaaaatatcaagattatcccaagatttggaccattgattaaagtttagcagacaaacatggtttaaacagccattggattttccagagaaggtgttacattttcttctctccactggctctgatgcagtttctgcagcacacgcgatgccaacctgctgccgagaatgctgtttacacacagcaagcagtccaactgcctgatctgtcaccgtctaactctattctggggtgaggcacttaacctttttcagtctcattttcctcacagcaaaggctagcgtttgccagatggtttctcagatctctcccatttctgaaggtctattaatcctacccctgatcactcattagcatctgctataacggcaggttgcatggaattttatttctttaggataaagctgctgtgatctttaaactatttttgcatgttaaatgatctcagtttggaggaagatttttttttaactctagaggagctcttcaattataagatactgtgtaattcttccttgtaacatagatacataaaataatatttggtaactttatttacatttttcttcacttatatttaatatctttccagataatactccacaaatagcatttttcagttgtgagacacaaagcttttttctactatgaaatgtcacatttttattccagtttccactactttaagatacagttttaagatacaattttagattattttgcaatgcaatttattggagttaagagtttctcagaaaaagagtgtcttggcacacttggtttttgtcatcttatttttattatttttgtcacatgttaaattcaggggaggtgtgagaatagctattatatgttaggtagcactaagtgctgtgtatatatcgtttcaactaacagttgcagtaagagggaagcagtggtgtcatcagtgttctgaggaggaaaatgagacttaagaaggttaaataactcaatcaaagttatacaatttatcactcagatctgactggagagaccaggacatttctattacccctcatgctttggtgcagacgacatatcttccttcaaatccagagttttatgtgttgcttaagacccactccaccatacatatgatatgaggtgaaccaattatatcaaatgataccagcttaaacatttactgagtccatcttttatgtctgccatgaacatttccatatttttacaccaaaaattatagataggttttgcagatacaattttatagagttaggaataaatttgtggataagtaaataataaactccatattttttttgtacaaatctgtcttctttggtgctatttttatcttcatccattaaccctaaagaaagagaagtttcaatgaatgcacactgactgcatttatttcccatcaatttcaccatgattaacatagtttactgatgggttcatagttaagaataccttgactcaagaatacctgcatggtataaaatttattctatttacaattatggagaaattttaaaggtacattttgcataatatattgaacatattgttattaatagaaatagaaactttcaaaaattactttaaagcatgtaattatatagcatatcatgatagaattagaatatgctcaacgtgtgtttgtttatgggctccaaatttcttgctcaacattattagaggaactttataattatttggatatatatatcaatatacaaagataaaaagatttacatatgtttatgtaaactatatatttaaacaatgtatatttaaatgttatatatctatacatattaaaactaaacataatgaaagaagaagaaaatacattaataacaatgaccagtaaagtgattgtgacagatggtacattcatctatgtttcttaaaaaccaatataaggagggaagccagaatttgcaaaattagttttctccaaaaagtagaaaaaggatcagattttcaaagggcagacacaatttactaaagtgatcaactctaaacaagcttttcatgtgattatttatttgaggcatgagaatacacattgcataaaagtgtatgttaagaaatgattacaatttttatagcatacaatttttatagcaaatatagaagcattttatgcagctatccaaaattcaagaaattctattggaatattgctttctgatgagaaaatcttagacatgaatgaactatgtacaatttagacatacagatgaagattatattctttaagatattttaacattagtttttgagctagatgtcagataatttgatggtatgctttgacttgacttacagcgtttataggctatgctacttaaggacagatgtcctatatacttaaaaaaattgggttatctattatgctatcttataggagagtcaacacttcattttgaaacttgaaaaccaaaccatgtgtatatttttttaatccgaggtggatggccacatcatttccacatggattgaatcactaagattccttcaagcaaaaccattctttgtctttttttttctgaaaaagtcattttgatttcatttcagcatttgaacaacagctgaataaaatcagagttccatactgacagcagtgcaggtttttataagaaaacattagtccaatgacgttcattaaaaagttctattgtctgaatctagatgacattatgctaagtgtaataagccagacacagaaggataaatactgcatgatctcacttatatgtggaatctaaaaagtcaaactcacagaagtagaaagcagaatggtggttaccagaggatgggggaggggtgggtgatgaaaggcgatatgattactgcgtacacacgataataatgtgttgtagatttcaaaattgctagaagaggacactttaaatgttctcaccacaaaggaatgatacaaatgtgaggtgacagatatgttaattagcctgatttaatcactccacagtgtatagaggtatcataacatcatattataccccataaatacgtattatttgttaattaaaaatataaatatagtagtaatagtagtagtatttttgtctgctagaataatttcaatggtgaatgagccttgcgtatcaggacaaactgacttagtgtttgctttagaaaatggcgattttgatggtaataaaaataagcatagaatgataacaaaattatggatcactccaggtccctcctagttaggtatataaaatcacaacctgaagtcataaagactcttgcctccctgtctgatctcagagacattttttcattcaattcatttctaaatagctttagaccattacggtgtaaggaaaatgtggttaagagactggtttacaatgtatcacttgagattttgactttttacttccaatacactgtttatggtaaaattcttatggaagcactaattcttatggaagcattaaagtgtgcattttatagaagctataataattagggcttttgaccatatttctcttctaatcaaaggtcagtgatagagtaattaaaaatttgtgaagttttatgttgcacttggtaaatcacttcatgaggtttaagcagttgttggtggtaggatggtggtacctggaaattctctggttcttgctgtgaggtatggggttaataccgtaaaaagtaaagctgacataaaaacgttgagtgaatatcaaacaatcccgatgtattcagtaaggagagtattactgcttctgaaaatgaggcagattacattttgattcagttgagacaagagggtactgaatatgaggtgctaattaaaagtctggtgttcaccatgctaaatagtcttcaaactgttcaggctgtccttcctaataaaagctggagaaacgaggcctccatttcccaaaggtaggacagcactttcagtttccatctgtcaataatgctttgtgatcggatatgtgagcaagcctttctcaaatggcttttgaagaaactcttagaagttgtttgaacatcataagactgcttagagagctaataaggacctggaaatatttcacctttttcttcggagcttttcagacagtgttggtgtcgtttgaagacgattaaagagagggaaaggataatgggcagaaattcatgtccgtcttaagaaagtaagtaagcacaggatgacttctgaataatcaaactggaaatctaaagtgcattggtatacattaatataagtttatgcttatagatgagtctggctggatgctttatttttactttcataggcttattcctaaacacaagattaaagagaaaatgatgttctaattgatgcaaatattgagcatttattatgtattagtcactgttctacacatttttgtgcattctttaattcttacagacatacacacaaagaaatatatgatgtaggtactattgttatctttatttcacaggtgaagaaactgaatcacatagaggtaaaataacttgctgaatacctaaaactagcatgtaaaagaggcaacactctgactctagagtcgtatttttaactgctgggctacactgcctctcagtattgcctagatgtaggtttagttttgagaacacaaaggagacttgtgaactttaaattccctccccgaaaaaacattatttgttcaatgaagaagatatatgcagtttaaatgtctctctaatggatgcaggagctttaaataggcttgatgtgctttggggagatgcacacacaagctagattatgagatatccagtaaaggagagttcaataaaaaagaagaaacaagttcctggaccaacgaactcagagtttattcctctattacaaattgaaattaatgtttctagattaactttcccaccttttttttctgaatattccttaatataaaatgggtctaagtgtttttgagctaacattgacagtatgaaatccaactctttataggcgaaaatagtacaaaacatgggggagaggcagctaataaattggttgattcaattatggatttaagaattcatcagacaagattccaggtgttggaaaccagataatacaaagctattgcttcccttcaagggaaacaagcatacaagcagcatattacaacttcacaagagaaacgcttaaataaagctgtgcaggaagtgaagtgggaatagagaaaaggtctgtctcactccagaagagtgttcttggttgtttggaatgcagatttagagagcctgttagtctggggagaaacagtaacttgtcttttcatttctgctcatctgtattgggtaagcaaaatgtctgatctgaaacaaatcaaatagacatgagctggggatttcccaggttctgagaaaagacaggaatataaatacattggacttgttgcacatgattatttggaaactatttgtatttacataagcaaaatattccatacttttacgagaagaatacttacttcatttttatatcacgtttttgcatacataggattaatgaaacacacacaaacacacacatacaggccatgtgtttttagatggaaactggggaaagaacacagcagaactgactgagcactttcactttttttgcacccttgcaatcatgctctagccaagaatttcccacagtcccttgcaaagcatcaagtgtcatcctgtacccattccctctccacttagaaaaaccaccttcagtctttgccttgctgttttctcagtactctgtccaggcatcactgcctccagagagcctcctcctttccctccactgtcttgtctagggatatgcccatggcgtcctattcctatcgcacaaattatcactctgtcttaaaattgtctaactgttccatgatgtcttatatttattttttgttttccagtgctggatacagggtggggtgcataggacaggtcaagatacatgtatagaataaatgagtgagcagttgttactaattttgttaaagacatttttacattatttaaaacatccaagtaggttatcttaaggtctccttcctctctaatttttttttcttttctttttgagatggaatatcgctctgtcacccaggctggagtgcagtggtgcgatctcagctcactgcaacctccacctcccaggtttaagtaattctctgcctcaacctcccaagtatctaaatttctataccatttttaatatcattattagagtgttttctaacaagatatgagaagtgaaaggaaatctatttattaactagttcaaacatttatttcaccaatgaacaaacagagcagaaaagttaaatcattaatctaaggtctatcatatggttagcattatgattaagactagaattcttatctaccaatttactttatggggctctacttgattcacattatataattgctgagttggagtatgacattttaactcattttaaagccttaaatcttgtctgtacaattgttctatttgtatagtgcagaatagacagaaagtaaaaatttgtttaattgaacttcttgtaacttctatgtttaaaacccaatttcccacgtctcttgcaaagactttcattatggtaaacagcaaaaggggaattcacataggaattaagtttataacaataaaagtaggggttcccaaatacaaattttatcactaccttgtaataatttatatcatactgagacaatgaggtacatgtgtaaactcacaactcatactaaatatgaaaattgttttttctttatcatgacaaagtgtctaaagaatatgaaaatggtattaatagttatagtctggtgaatattttataactatcagaaatgagttgaggtgttacataaaacaaaggctagtattatagaactggaacaacttttgtgctcataacaatttttaaaaggtaattttccctgaacttgaactaaatcactcagcttgttcgtgttttactcaaccttagggcatgtttaaggatcacgtttaattataggaggaaagatgaatatacacatgcacatataaatggtcccattaaaagaggtctactatataacagcgaaaatattaatatggatatttattatttgctctgcaatagtaaatcggtttgtatttcacagcagattgcaagaaattcaaacttgtattttataacataattgaacacgatattgactttctttttttaaatttttttattataccttaagttctgggatacatgtgcagaacgtgcagttttgttacataggtatatatgtgccatggtgattatattttctatgtattttctccttttatttgaacatgagtttagatagccctaaaacatccaggtctaagagaagagaaaaactcagaaaaaaacagaaaggcaaactataataagaaagcatgatatgggagcagaaggtgcctggcctcacactgtcctctctgttcagcatcttctccctcaaccactgctgagcagtagctttctcattgcaatcatttctacaccacctttaaaaaagaaataagtattttttactgtatgtctgaaaaacaatctgattatgcaattttaaccttcacaatgactcaaggacatcctattaacgtgggtgtaaatattagggctcttagatattaaaagggctttaggggactttgcttgcccctctagatgtcattgggttgacagagaacatcagttttcatcagctattatagacctgctaatcatgtgtgagaagaagcaagttgctttgatgagagattaaaatggagggagacaggtttgggaatgggaggcctctttctcgagtttgtatcagaggatgtaggagatggagactgactgtcatgtgacgggaaacacagtgagcccctctccatgcagctgggagggcagccgtgtccttatcggggctagaaaaatggacagtgccctcagccacaacatggaaggggatgtggacatgagattctgatgtaagtcctatagggagggagggtcagaaacaggtactttatacactaaactcaatgattagtttgtctgtatttctttatttttattttatagctttctatagttttaatcatgtttttaaatatatcagactccctctacttaagaggcccaggaaagccatttttgctccaatttggagatgaaatttaggtggagcatgcacctgtgagcaacagcctgcagatggatgtggccaatactttctgcacaccaggaaagaaagggaagctccaaagaaacacgctgaggtcttttggttacttatctctccctatttataggtaagccatccaggctagaaccctggagtccttttattgcatttataataaggaacgtacatctggcagagtcagagcaagaaaacttagttaattagctggcagagagttatttataaatatgcatatattatatataaatacacatatacatatatatagagagagagggagagagaatgagagtaattaggagaatttcaaggagttgcaggcgctaacgagttattttacagtgactttaagacaactttatgagtatttgattattcaaaaaatcacttttgtgaggatttgtgtgaatgtctatgtgttagatcacagtaaagaagctcaggcatttgcatgcttgattcacaatgagactcaaaatgtggagctggagggtgaaataagtgctcacctgttcccagactcgccacaataggtggttctgtttttatagaaagtgagtgatgcagaaatattttgacagcacatctatttaatcattgtgttcctttggacttagattccaggtaatttggaccctcttaactggtggctagcatggatgaagtattgttttaaaaatgcaaatgaaggtacatgtatgaatggaagcatattttgtacagaaaccatggatttgggattctgaatgatcaggaatgaaatgttaggcccataacttcctcctgtgtgaacttgggcatattactccttctgtatttattttagatttttcacccttaaaatgagtagaataataccatcttaatctttcccttcacttctatccccttctctttccaggaatatttattggaagtttaatctctttccactttgctggctgctttaagatacaatgttgagcaaaaccaatgctactcctggtctgctggagattgtagtctagtaaggttgttatgaagattaaataagataacatatataagttagctcacgtgcaatgtttcaataagtatccagaccctttcttcttatgaaaggcctatgaatctcttagggcattctattcagaagatgcaaatacctcttgccagttgcccaaatagaacagcttgttcagagcctaggagagtagggtcagtcaatgaatactttacaacacctaagtagtttaacaaatacttaattctttatctttagatgactttattttgttgctcatttgtagatgaatatccagagtgacaaaaatgtggaatgcactatctgaggtatagtaagataaatcttgtaagtttaagcattttagacatcatcgactcagtattaattttgacttgtatggaaatgttatgtctgagggttcccagatttgctaatgacacacttaattgacaatataattgtgactctgaagagtgtgaaattaaaatcttaagaagtatgtaaactaattgcatgattctttgtgtgaacaaagcagtttaattgaatagtaccttatttatgattggcttttgatacctagataattctgtttggtatctaatgaaaaaactgatctaaaacattaataaccatttgcccatttaataaaaattgtcaaaaacagatattgatcatatttctaaaaattattaaggggaatagagcagcatttcacaactagattcccaggatggtggtctgaacagcacaaaccacatattttcatccatcgtctagatctttattaggtctaatgcatttataatatttttgcaagtttatatttttatttattgctagtacctcaatgcccagtagagatgatacaactaaccaatagccaataagatacagactttgagttttgtgtttcaggagttatgggttgcaatgttttatttatactcgatcacactgtttctcttcagctccagtgtagtgattgaagtcttgtaccaggcagaggactaggtgactaagtacttatggcatgggccacagaatagacaagaattaatcctgtgctttttggactaatggtctggtgtgctgaccaaataagtatttcaaaacaaatgattctcatcaatagtattatgtgttctcttaacagattgaggattttatttttcaaataggaaatggctaatttattttaaactatgtatcatattatactttcaaatttcaaacagtatcttaaaatgatgtgaatatttaagttttataatttagcttaaaacagttatgtaaattgtatatagacactgatgggatagaaatctgcattggaacttttaattcccttacgtttttatagtgtcatcataatacaataaaattactgctctattgcattagaagtatatgctcattaaggaaatggccaggaaaaaattattcatgtactgagggaaattttaacatgagatattttgccttagtgtgtatatcacttgaacttcctttgaactctgtgcaatacttgctctttatgacaaagaaagctattgctcacaaagtattgggtttgcctttgaagcaatatcaggagatcattgacaaaaggcagagctgagattagatgttgaggtttattgccttgctaaagtcccaaagctatgtgaaatgtcagctaattgaaaaaggtaattattctaaataacagcataaactgtttctttctaggatatgtgttgctttcaaattaatagccattgatctgtttttttttttttcccacaattctcctctgtccttttgtcaaattatctagacatcggtccttgggacaaaacccattgcaccatttatattgaccatggtttaatgagtgacctggtcttcctgtttgcatagattgtaataggcccatccatctgagagtctgtcagccagactgagatgtgtaacctctatgtatatttagtttctaactgggaagactttaaaatgaaaaccaagtaattgtgttacggtggccatttgcatttatttcagatactgatcgggaggagtcctattaatcacagtagtaatagatcttcaaattatgacctactgagcaaggtcatcccatatgagatgaataatatatattcacaatgctcagcttgcttctcatgggcagtacttcataccaaatggcttttagggaaatatgtatggtataatttttcagacaaagaattaaaattcctagttgtgatggttaaaaaaaaaaaacctctccagtggaaattagaaatacatattctcaatagctataaaatgaactacaagtacactttgattctgtaaaattgagttactttgcaaaatatttcagagtaacataatcccaagtcaggattctctattggaattgtagacaacccaaagatacctgggcttgatctgttttaacaaagtgaagaagacaggaagaatatgagaaattattcaaatatattcagaaaaatatctgctgagcttagaagactaatatacggtgattacagaacagttatattctgtccttagatcaagtcttgtcacaaaatcataaaaccaattttcttctggagtttgaaggaaatgagtacaattagtgcttcctctaactttatttttaactagtaaattataaccaggaagtatactcacaaactgtggaggcaaggacacaggaacaaatttagcattgaaaataaacagttgaagtcaggtagtgtgatgcttccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaaggagattttgggctgagacaaagcacactacctgacttcaaactatactacaaggctacagtaaccaaaacagcatggtactggtaccaaaacagagatatagatcaatggaacagaacagagccctcagaaataacgctgaatatctacagctatctgatctttgacctgagaaaacctgagaaacacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaagcctagaagaaaacctaggcattaccattcaggacataggcatgggcaaggacttcatgtctaaaacaccaaaagcaatggcaacaaaagacaaaattgagaaatgggatctaattaaactaaagagcttctgcacagcaaaagaaactaccatcagagtgaacaggcaacctacagaatgggagaaaatttttgcaacctactcatctgacaaagggctaacattcagaatctacaatgaactcaaacaaatttacaagaaaaaaacaaacaaccccatcaaaaagtgggcaaaggacatgaacagacacttctcaaacaaagacatttatgcagccaaaaaacacatgaaaaaatgctcatcatcactggctatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagtgatctagaactggaaataccatttgacccagccatcccattactgggtatatacccaaaggattataaatcatgctgctataaagacacatgcacacgtatgtttactgcggcattattcacaatagcaaagacttggaaccaacccaaatgtccaacaatgatagactggattaagaaaatgtggcgcatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagaacacatggacacaggaaggggaatatcacactctggggactgttgtggggtggggggaggggggagggatagcattgggagatatacctaatgctagatgacgagatagtgggtgcagcgcaccagcatggcacgtgtatacatatgtaactaacctgcacaatgtgcacatgtaccctaaaacttaaagtataataataaaaaataaataaataaataaataaataaataaaaagaaaataaacagttgaagatagtgaatctgacacatttagtaatgagcaaatcctattgtgtgccccagtatttaggcacacctatgcaaaaaagtcatttcaggaaactatggctttatatctgagtaaacaaaagtggagggaaagggtttggcagtgaagaacaacttgttcacatcccttgttaaagtaatcccacataaccttattccatttcaagccaagactgtttagaatcttatgtcctgttgccacaagaactgagctcaatactttagagtcctcagcccagtatctgatagtgggtgtagatatttttggaagaacccaggcatgtatctgcaggaccttagtaaacttcctgtttggcataattctcttctgcctacccagtctgtctgagggctatgctttcttcttccctctcctgagtgaaggcaattgacgcttaattgttattttctttctaaaattgataacataaaaccggggcattaggtttcttccttgaaaattttgtgtttttataataaaagtagctgtagccaaaacctgccccatgtaaagaagtatgtgttaacaattacaaaaataatcatatgcatctgttttgtacactcaatgaagtcccagaaatctttttagtgctctgataccttgtaataaaggacctctagaggttactgaaatgaaagcatgcagagttactgtagcggtgtgttgttattggggaaaataaaaccagcagtcattcactgcacagcctacattgctgtaaccggtgttgtccagtaaactatctggtatgcaaaatgctaagtattcaatgtacctggcacttttgatcattgtaatagtaaactgttggcatttggtttattttccaaagccagctcatttgtacttctcttaaatattttggctttagaactttgttgttcatacagataatttatctccttattgccctgtttcccttattgctgccctgcatttagctgcaatttgctttaattgagtcatccccatgatcacggagaatttgttcagtattttgatttttagctataatctcattttgaattgtttatcttgataattaacattattgcatgaagacccaatagagaaaaaatattatgtgggaaattcattccttaatagttaatataagccttcaaatgttgaatgtcaaaacctgcaatttctcttgatccttaaaagccttgtaaataaagacagttcagttgaagaaactatactgttaaagtcaagtatttttagaaatcggctttgagtcttggggatttagaaatttacatatatgaactgaatctcagcaagctctaaataaacaataactatttgatgggataatttaaagagagcctgccatcacagcgatcattatctgcaaaagtgataattcgctaaaaatgtatgcctaacttggtaataacttaatatcgcagtggtaatttttaatcaataaactggaatataatcagattggggaatatgtaaatctatatcagttcagtgaaacctgtcaataggaagagaaaagataaaaaggtaaaaatcagattgaatttggggggaaagcttgaaagaaatgcagttacacctctgctgtgatactcagcatgggacataaagagtcccaccgcagggcttgaatttataggaatctatccagcggcactttgtccaacgttggaccttcctaacagacaaaaagaaatcttatactcttgcttcttagtatttaatatatgcattatgtgctttttaatttttttgtcctacgaaagagtagctgatggtgctggattgaaggcatatctactctgcctctgactagcaatatgaaattggttaagttattcagcctctctacatttcagtttcaggaaatgaagtggactaagaatatcgtcattaggcaatatgtacctccaatattctgtattatgtggagatgtcaagtctgtatttgattacacaaattataagtccaaaagagttcagaatgagtcatatagaattgaaagtcctatttatagagatactggttaaagcacaggaattagatgggtttaacatacttcatctgtgtatagaaaagagtataggctcaggaaagggcccagggacataccacgattgggcccaggagacagtaagagagtttcagtgactaaggagatgcaaggagagcatgggatttctgaaaccaggagaagaaagcctttatcatagaagcaagcgataaacttcactaaacacttgtaggacattttggacaagaacagaagagttacctttgattttcactgcatgtagcttaacaaaagttcatagaggcagtgaaaatgaaatctcaattagagtggtctgaggagagaattcaggtgatgaagtagaaaatgcgactatagatggctctagaagttttacttttaagagtagcagagaactggagtacagctgcagacatagttcctcctcctccctgtcctccacctccagtttcttcttctttccatgagtgtaacagaatgaaattcagggcataatcctgtagaaagtaagacattgaaagagactggataatcctccaaaataaataaatcctcagatgatgccaggcagggggctctagcacacaaagtgattgacatctgataggaattgagctgttttatccacataacaattatttttcggagaaaatctaattgtaaaaatatagctgaaaaccaaagattagccttatgtgtgtgtatgataacttgcgatgtaaaatgcgtttctcaatataggtcctggtcaaaaattttaaaagtaaaataccttgagggaactacagtcagaggacagcaggatgaaggataatcatcagaaagaatacaaagtgggccaggcatgctggttcatgactgtaatcccagtgctttaggaggtggagctgggaggatcacttgaggccaggagtttgagaccagcctgggaagcctagagccccatctctacaaaaataaaaacaaaagactacaaagtagaaaaatcagagtgaaatagaatcttcaatacaaacagtagggggattttagcaaacagtagctgactaacatcagatggtgctaagatttgtatggagttcagtgcagagaggtctttttaacaagcaatttaaatgtgaacattgccttgtttacacagctcacataaagtgcagtataatgtgcagggaaaaaaagtaaaaagcttaaataatctttattcttaggacagtgtttttcaaataaggattatggctcacttttggatcataacataaaataattttcttgtggctccaagaaaaagaaaacccaagtttaagaaggcttaacaatggaggttacctgtatcatataagaagtcctgagttatacatctactaacaatagatccatggcaagacacatgttagaatttgcactttggaatggtctttctctcacatttctagtctcatggtcgcaagatgacagattatcccaggcctcgtgtttacattcgcagactaaaaaacactgtggtagataggaaaagcccctccccagagatgactcccaagtcctcactcccagacctgtgaatttgttgccttacagtcaggcaacaaatcaatctacagatgtgattaaattaaggatctggaaatgaagggattaacctgtcttacctgggtgagttcagtgtagtcataagagttgagtgagccaggagatttggcgagggaggtgtgaccctggaagcagaatgatgtggattaagaaagactcacctagcgattgctggttttaaagatggaagggtatcatgagccaaggcacatgagtgcctcttgaagttggaaaaggcaaaggaacaggttctcccctagaacatccagacaatgtcactcagtgggttctacttcaggcttctgacctccagaactgtaagatcactaatttttatatttttttgcattttttttttttgagacagagtcttgctctgttgcccatgctggagtgcagtggtgtgatctctgcttactgcaagctctgcctcccaggttcacgccattctcctgcctcagcctcccgagtagctgggactacaggtgcccaccaccatgcccagctaatgttttgtatttttagtaggaacaggggtttcaccttgttagccaagatggtctcgatctcctgatctcgtgatccgcccaccttggcctcccaaagtgctgggattgcaggcatgacccaccgcgcctggccaatttttgtattttaagacaccaggcttgtagtaatttgttatagcagcaatgggaaactaacaaacatgtatgcgcaaaaaggggaaaagagttgggccagttgagtttgtcactttgtatccggaaagcaaaacccttcacagaaaccttactgaactttcatttgcttacatctcccgttccagaattaggctgcatgaccactgtggatcaaccacaaaccaaaagaattcaattatcatggcactgttcaattagacaatcacagttcatctcttggagctgagatgggggatcatttcctttcttttctaagatctactgaactctcattagctggaaaaaaaaatcaaattctattgggagagaagaagggggttgaagacaagtggatttttaatacctagctgatgttgggaggctaagtataaaaagacattctgtggctgggcgcagtggctgacacctgtaaacccagcactttgggacgcagaggtgggcggatcacctgaggtcaggagtttgagatcagcctggccaatatggggaaaccgcatctctactaaaaatacaaaaaaattagccgggtgtcggggtgggcacctgtaatcccaggtacttgggaggcttaggcaggagaattgcttgaaccctggaggcagaggttgcagtgagccgagatcgcaccattgcactccagcctgggcaacaagggcaaaactctgcctaaaaaaaaaaaattcctgatgttgggtgcgtagcagcttgtgcctgacacactgccccatatcctttccaccaacaagtctcattgttttctttcaaaaatacatttcaaacgtgtcttatgtccacatgtccacaaccaccattctgttttaatctaacaacatctctcttttgaattgcttaaatgaccagttaattctcctcctaaaagctgtttagcttcccactcgcccctatcttatttttttccattaggtagcctgaagaatctcctaaaaaattaacttgtccattctctgctttttatactacctaaccacttcttgttgaagttaggattaagctcaaaatccttaagtgacttacctcttttgcagcattgcttgtagagtaaaagattctttaacaccattcttctttccagctttggccagggtttttttccccccttaaatactactagttatataattaaattttagtttatgcaccaatttgaatgaatacttgataaatgtctctacttgtaatttataacttccattagagtggaagtcaggtacacttttacccacgattgtattgcacttaaactggaactgttgagtgggtgaataatcaataaaatgagcaaatagttctcatccttaagaacattctaaatcagtaggaagaaagaatgagtaactatagttatgccatgcttaatgatggggatactgtattagtctgttctcaccctgctaataaagacatacctgagactagttaatttataaaggaaagaggtttaatggactcccagttccacatggctggggagacctcacaatcatggcagaaggcaaaggagaagcaaaggcacgtcttacatggcagcaggcaggagaagcttgtgcaggggaactcccatctataaaaccatcagattgagacttattcactatcacgagaacagtatggaggaaaccgtccccatgattccattatctccacttggccttgccttgacatgtggggattattacaattcaaggtgaaatttgggtgaggacacagccaaaccatatcagatacattctgagaaatgcatgtttctgtgatttcataattgtgtgaacatcatgagcatacttacaccaacctagatgatacagcccactccccacctaaggctacatggtggagccttttgctcccaggctacaaacctgtatgacatgttactgtactgaatagtgtaggcaattgtaacacaatggtaagtatttgtgtctctaaacatagagaagatactgtaaaactacagtgtaaaagataaaaaatagtacaccttatagggaaattactatgaatggagctttcaggccacaaagttactgtgggtgagtcagtgagtggtgagtgaatgtgaaggccgagaaaattactgtaaactagtgtagagtttataaatactatacacttagaatacccaacaattattaaaaatatttctttttcttcaataataaatttaccttaacactgtaattttttactttataattttgttttttaacattttgacttttctataataaatgtagcttaaaacatactgtacagttatacctgatttttttgttatattattctaaagcttttatctagtttctttttttttttccttttttattaaaagcgaagacacaaacacacattaacctagtcttgccaggcactgtggttcatatctgtaatcccagcactctgggaggtcaaggtgggaaaaggcctcctcctcttgaggccaggaatttgagacataccaggacaacatagcaaaaccttgtctctacaaaacatttaaaataactggccaggtataatggcatgcacaggtggtcataactactcaggaggctgaggtgggaggaccgcttgagcccaagagtttacggctacagtgagccatgatcactccactgcccttcagcctgggcaacacagtgataccctgtttcagaaaacaaaaatcaaaacatctgggcctgcacaaggtcaagatcatcagtatcactgtcttccacctccacatcttgtactactggagggacttcaaggtcagtaacactcatggagctgtcatcatgtatgataacaacgactcttggaataacttctgaaggatctgtctgaagctgttttacagttaatttttgttttttaatatgcagaaggagtatactctaaaataactataaaaagtagagtaaatacctaaaccagtagcttagtcatgtattatcattaccaagtattatgtactatacataatcatgtaggctatatttggttatgcatactatatgactggcagctcagtaggtttgtctacatcagcatcaccgtaaacatgtgagtaatgcattgtgctctgacatcacaatggctatatcaccaggcaataggaatctttcacctcccttgttgactgaaatgtgcttatgcagcacatatataataaaaatgataaaaggctactctctttagaaggacagacaacatgtgagtttggaccattataggtcagatgtgccttgaatagaatttttattttatttttttattttttttttgagacagagtctccttctgtcactaaggctggagtgcagtggcacgatctcggctcactgcaacctctgcctcccaggttcaaacaattctcctgcctcagcctcccgagtagctgggactataggtgcgtgccaccatgcccggctaattttttttgtatttttagtagagatggatttcaccggttgaccaagttggtctcgaactcctgacctcaagtgatccacctgcctcggcctcccaaagtgccaggattacaggtttgagccactgcccctggccttgaatagagatttgaaggaaagatgcagccaaggggatgttggcaagtgaaacaatccatatttaaaggttagagggatgaaatggaagtgagttctggaagtttgatggaggcaagtctgtggaaagtttcaaacactaaacctgtgcaaatgaattatcttcaatttttgtaatttgtttttatgcaatatattttctgaatatatgagtgatgtaaccttgatggtattataggaagttgacatttcaggcagtcttactaattaaatgttattaattcaacatctgttaaacaaatatttttgggtgctagttgccagactccaaaataatagccagagaaaataaggtgagtgcaaactaaaggcatagcctttactctcatagaaaagtctttttctctaatttttaaatgtattttgtctttaagataacatcacaagttcatcaagagtagaaaaaaaaatcactttcttatatttcttctgtttcaatcacagtccatatggcaaaattaggcaaatagtaattgagcaataaaccccaagttgattgtttaatggaataatcaagaaatttctagatggtcattccactttggatcattacagccctaccttacagcaggtgggtaagatttgagaaaagatatttaggccaggcacgttggcacatgcctgtaatcccagcactttgggaggccaaggtgggtggatcacctgaggtcaggagcttgagaccagcctggctaacatggtgaaaccctgtatatactaaattagccagacttggtggtggacacctgtaatgccagctactctggaggctgaggcaggacaatcacttgaatctgggaggcagaggttgcagtgagctgagatggtgccattgcactccagcctgggcgacaagagcaaaactctgtctcaaagaaaagaaaagagatatttaaaaattatgtagttagattgactaatgccagcagctatggatcgttcaggctgaaaacttcccttggaggtcttaatgatccagatttccttattaatacatgcaactgtcacatgctccatcacattctgtattgtctccctaaagcttcaatgtcttttttacactggaatttatcagtgtcatcaaaacatttaatgctggttaaaatgatagcccctgacttaattatatgggctgtcaggcaaaattgacggatgtcagtgacaacaaagcttattctagcctgaccttcaccgaaaaatacactgagaaatggtatttctatcctcctatcctcagatcaagcttttatctgttggcatcattgtcattataattatatgtggtataataatagtgattctgatttaaattttgtaaaatagaaaccacatcgaacttgcttcctaaagtgtgatgtaattttttaaataaagaggaaaaaattctagacatttccaactccttaaaaaatactgtgtttgatttgttgacatagggaactggaaagtggggtaaattgaaaaatagtagagttttagtttctaacactcatatcaactttaaatttgtctttttgacaatttggaggtacttgattgtatttctatgaaaggaaatcataagaatgagaatataaagatcactgtttaattcctaatatgaatcgtgctctactgtccaaaaaaatagacacgtggctttttagatttaaagttaattaaaattaaaatgtaaaattcatttcatcagtcacatcagccacatttcatgtgattcgtggtcatgtggctagtggctactggattagataacacaggggacagggattttttttttttcagatggagtctcgctctatggcctaggctggagtgcagaggcgttatctcggctcactgtaaattctgccttctggattcaagagattctcctgtctcagcctctcaagtagctgggattatagccgcccaccatcatgcctggctaatttttgtatttttagtagagatggggtttcaccatgctggccaggctggtctcgaactcctgacctcaggtgatctgcctgcctcagcctcccaaagtgctgggattacaggggccgtgcccagccagggaatttttgttgtcttagaaagtcctatggagagtgctgctttgctgtatttgcatgtagttttatcatctccatgcagttaacagaatgttttcaggaggagaattccctaaggtgagaaactggttttctcaggagactatttggacaaatgacaaccatgttatttagtgagagtgaccaccaatggagccctatacaactgtcactggcactgcctgaagggaatttataaccaggagactattgctgttcttagttgtgtctaaaattgcattgtcatgattcaccaaaggcatgtcatgatgtaccatgtgccttttgagatgggataatacttatctataagatggtatgattatcagattgactccttctcctacaaagaagcctcaatatatttcaaagagtagaaaactttctgcatcccagagagcaatgatttttatcattgaacagtggaagtgtttatttccaaactatttaagtgctgcacgtgaccccaaagtttatcttgaaattagttactacactgagacacaattctgtgagaaatggaagtaaattttaagtgatcccatctcaggctaagtagcttgctgagagttgtgagacaaacatctctatactttgatgcttttctgtgaagaaaatcatgattataaatatggactatatataaatatagtaaaaaaaaaaaaaaaaaaaagaaagtaaaacctatgctattacaggccaggagagcagatccctttgatgagaagaggtaaggattagtgattggaaggaaatatgaagggaattgtgaggatggatgaatttctgtttcttgattagggtgtttatgtgcaatttttgaagtcatcaaactgtatacttataatatttgctcttttcttcatattctacctcaataaaaatgtgaacatatgcatgaacatacatacccagatacgtatgtgcctgagtgtgtgtgtgcgcgtgtgtgtgtgtacaggcatataagtttgtaaatttaatccagtatcaaaactcaatgaaaacccatttttttctaacgtggctgtgactaattatttaaggattgcaaacttactaaacagtccaaaatctttcaaaccaatttaaatcaaagcataatattatcgaaagatttaaatttatgcatcacttttccgtgatggaatgctaagtagatcctatccaatgcttacttcagatccacttcatttccaaaatgccactgaagcataagttaattaaattacatagattctaggcagtgatgggaaaagtaatatttgattaagtgcatatgcctgcaaaaatccctccgttgccatacgtgctgatacatcagctgcttaactgctggcatttttaatctatccaaaaggaagacatatttaagtaggttagttattccttggcttgtgaagtgctatcatttttgttgtttgctaatagtcctgtaaggcagaattcattcaaagccagacaggaaatgcaatgacataaaacctggtatttagagtgcatatgctcagaattcacagcgatactgtgtcgtaggtggtggtttcttgcaggcattgcatttctcttgattcatgataatgtttgaagctttgaaagtgaaattgactaaaattaattctacttgtgaaactgccctccggaaaactgttcatgtctatgtgtatcaatgtgctaacatagcaatagcatttaaaggcttgacaataaaggcagttactaacaaataaaacattagaaagggcttttttaacaagtaaatttcaggggaatggtttcaagtttagacagaattatatacaagttcccagatgttcatataaatattaatatatcagttattttctatttgactcaattatgcacaaatcagcacataataatttaatcaagctcttcatctctctttgacaatacattgcatcatggagtagagaaagaatgtgaaattcaaggtggctagtctactgctaaactctgatgaaatgacacagaataatgatttaaccaccaaactaagaaaaatccttcattttcatgtacattttacctatgtccattcacttatctaatgatcctatacatatttatcaagtattagtatgtgcagggctatgtcttcgttgctagagatacatcttgtgactcaccaattctctgtcctcatggagtttctattctaacggggaaacagaatactggcagaaaacaaaccagtaaatacatcatgtgtcagatattgatgagacacgtggagaagaattaggcaaggtaatttgcataaaaattgtgagatgagatggagtgctgatgttgttattttagttgagggatatggacagggttactcgaaaggtggtattggagtagataactgaaggaagtgagagatacccacgtggatacctgaggcagggctgctctcagaaactcacctagagtttgccattaagcttgccattactactttcagaagaactcagaatattaatttactttctccacattccctacagtatggatgaagaaatatcaccacgttcttttgtttgtctagacacacaaaatatctacagtagttggaggtacagacagagctgggactaaggcttgattcacctattcataagccaggaaggaactcttggttgaatgtaaaaaacaaaaaatatggtcatattgcaaacagaaaaaaaaaaagtcagcttctaaaaggataaaatatagggcaagtttcttggcaggattttaaatgattctgtggaacttcattatgacatatttgtccctaaacattatatgtaagtttttatttttaacatgtgcttcttcctcttagaatgtctgtttacatactcttcttgtgcattttaaaaaatttatctataatgtgcagttaaacttttcagcgcattgtttcccgaaaactccaagctgaattgttctcggttctttgtgaattattaggtcagtgcaaaagtaattgcgggttttgccgttgcttttaatggtaaaacccacaattatgtttgtaccagcctgatcctaagcaatctcattatcgtctagattctgccacttttcattgtattattatatctattttttcactaacagaaataatttttagtgtccctaatgtttagtgttgtgcatattttaaaatcttaatgttttccaaataaataaatgaacacgagattaacttacaggtagaaaaatgtataaaacctcatcaaaaatgatggctctctaatcagtatccttgctatacattgtaaagggacattaagtatccacccagcctttagaggtggaagactggctctaccacttaatggttgtataatagtaaacactttggtaagcctcagtatcctgagttctaaaataaacatataaatggtgtttgtcccagtggtctgtttagggtcacagtgactaacgtatataaaagatataaaagtgttttgtaaattttaaagtgtttttcacctcttcatttttatgactaattctaatattatcttatatttgaaaagcatagggacataggaaggaattaaccgtgtaacagataatgaactaaaaattttcttaaaaataattgactgaaaagatatattgggttgaacctatactagtataaatagtagttcaataaatccaagctaattattggaggcaagaaaactacagtggaaatctttgtacttatcatgaaagaagccttgtaaaatttatacaggaataactgtcaactccatcacatgcagggggtacagaatgaggtagaacaaagacagatacctatggaaactgagaaggactcagatggtctcgttactatatggaaccaagtttctgcttagtgacaaatcagaaatttattatgttttcttgtcaggagatgtgtactcaattgctgattatttcagaattaaacctatgctaatggtttactatcagatccatgttaattaaaaatttaaacttgaaaatgattctgagatgtccttgatatgtgaagtgctattttaatttgttttgaaacattctccataattacaagctatacagaaaaaaagatctgatttttttagtcttcaagtccacaaaaatagggactaataaagaaaaggaagaaccagaattactttatataattcagtcaactttttgacacacttgtaaaactattatattttagaaatgtgcaattaataggcattttcatgttttatacacatattaagatgggtagtttttgttttgatgctatagaaacatatttgatcaatattttctcatggtaaagcaaagattttctcaacacacatcggcagcacgttcttcacattcatttggtcaggagatttttgtgaataaatgggatttcacatttattcttatattcataataaaatataagaattagtgcacttggccaaccgtgtagattatccacttcagcattttgcctctgacaagcaacaagaaatatattgtcgaatgtactgtcttctacctgaatattactctaaaaattaagcagtacatgcccaaactgttgatttttttcagactactccaaattcaaactgtgtcaattctgactagaaaaccaaacctcataaaattattatactatgtcaagtaatatttctttttatttgccctcagttttcttctctgttggttcaaaggagattcttgttaactgaattcagttgaaatatatccttagccttcataattgcagaatcattctttcttcagcttcacagttttttttatcttttcagtctagagtctacatcatttaagtctgtccccaaaaggcagactctgtccctttgatgttttttgcatgctgtgatctggacctcaaaacctttcattttatcattcttgtgcaacaatacatatagaagaagcaggtatagactcagtattttgcagaagaaaagcattttgtgtgtgtatatgttttaacaaattatatacatttctaatgatgtcaatgttgtgatttttaatttaaaaaattaagaccattttgaatagagtaacacattaattttctttttttctttttttttaacaatgagaacacttggacacaggaaggggaacatcacacacagtgcctgttgtggggtgggagaggggggagggatagcaataggagatatacctaatgtaaatgaggagttaatgggtgcagcacactaacatggcacatgtatacatatgaaacaaacctgcacattgtgcacatgtaccctagaacttaaagtataataaaaatatataaaaaaagagaaaatacagaatcaagaaataaataaataaaaataaaacaaaacaaaaaaagtaacacattaattttcttaagaaagtaattccctaaaccataaaaatgtcctggtaaatatgtaatcaaagagatgatattataagcaaaaaagtaaaactagaacaatcaaataaacacaatgctagggtaatgttcttcttccttaggaaagccaggtgaataaaaatgaatattcatgaatttgttgaatcttgaaacaatttttagcatctcagaaataaatttgccttttttataaatgcaatgcctagtaatctccaactgttgtccagtcagttatttgtatccactagtgactgtctcaaaattctccttgacttcttatcaggaagatggggaataatttttttccatctgataggtgtggaacaaagcagcctcaccctgaggctgacttcagtatgtcaaacaaatggctgttctctcacaaataaatgacaataagcctgttggttgctttctgaattcacactgatagggctcccttccagggccctgagtgtgcagctgttccttcttaacacagactcaacaggttcatgacattattttttaatggagtttctatagaaattatgttttaaaaattctcatctgcatgagatatgtttgaatctcatatattgacatgtacacattaatttaaaattagaacttttcagcattaaagagggacaagcattaaatattgtacattaatttatatacattgacaggaacaatcatattcggagaaattagaagatatcacttgtatgcatatcattttaagaaataacagggagggaacacttttttaaaaactactgtgaagttgtcagtattaagaggatttaatagaatagaatttgttgcttcttatctacttcagtattgactatctgcacattcaactgctctcattgaagtagtgagaacgataatatttcatttgtggggttaactgcagtagtaggttttggttgagaggaagagcgaggggaaaaaatatatatgaatatatagaaagagggagatttaatcctcagtctcaaggtctgtcttcaagatatcttgccgtcttggttgtgttcagagttcagtaattcctaatttaactaaatctttcttatttttctttttcaatgagacaccagaggcatagaggcattgtaattgagacttcactgaagcaaagcctttggattcagaaagatccagacgtagcgctagcaattcgacaagtcacttccggtctgaaacttgataccctcacctgcaatgtaggaataataattcagactattgcttcaaagactaaataatatgactgatgaggcatcgaggacattgttatatactatgaacttaatcaatgttcatgtaaatgtatattgtttctcttgcatctttagaaaatacaaaaatataattcacaattcacatatggacatttaataatgaatatgaatttgcaggacactggacattaaaagaattactttgtgtttttttttgtttgtttgtttgtttgttttgttttgttttgttttgtttttttgagacggagtctcgctctgtcgcccaggctggagtgcagtggcgcgatctcggctcactgcaagctccgcctcctgggttcacgccattctcctgcctcagcctcccgagtagctgggactacaggcgcccgccactacgcccggctaattttttgtatctttagtagagacggggtttcaccgtgttagccaggatggtctcgatctcctgacctcgtgatccgcctgcctcagcctcccaaagttctgggattacaggcgtgagccaccgcgcctggccaagaattacttttaaatctactgaagaactttgaagttcttcaactgtatttttctcatccttgaaaggaaatcataaaacgtgctttgctattattcccaggattgtacaaattgtacttaccaacttatttgcaaatttttcttttcgtattctaagtgtttattttgaaaaacatatataaatcgtatatatgaagtaattgcagctgtatctaaaattatttttccaacaatagttctcttagcccctaaaaatatatattgcattagtttatttttaaattatttttaatattttgactttatagggaatgcctgtatgcctctgcttctcactggtaaaaaagctttggttacagtaacattactgaattgtgtgcgcatttaccaagaagtcttgaagatagaccctggtattcaggatttaatcttcctcttttcctacatgttttatgtcctttctttcttcctatcaaccaaaatctattattgtagttaaccccaccaattaaacattattattcttgtattatacagtttattttttaaaaatttttttgtgagatacttaaaatttctgccttcactattccttcttgtatctcagattttccatttgagttattttgcttaagagtccacttagttcttgtttgcaggaagtaaaatttcttggttattgtgtgaagatgtctttttctcaaacttgttctgagttcgtcagtctagaaaggtaacttcctctcagcacgctgaaaataatattacattgccaatgtcattatggacataagaaaatctgtttttaagtgatactttcttgtagatgatctgtctttcctctctggcttcttttaaatgttctcttcatctttgatattttgaagtttactgaactaaattagtttggggaggtggaggtaaatctcagctttgctttctgctggtacttttcaattacaatgatgtcttttcctcccatatttggtgactttacattgtgaattcatacctagcagcataccatatgggaatcctgaatgactttgattgactatatttttatctacagaaaatattttaattttattctgaatggtattgggatatgctgccagtctcgaaccactttaatttgattcctcagactggggagttcagatgtaggggtgatgtaaactccataacccagaaaaatgaaacaacaggcctatcattacaatctttaaggagactttttttttttttttttcccacagagataagtaacagattctaggagatgtcttcattggttccttttgtagacaggcggttttttgtttttgttgttgttgttgtttaacccctatttataccctcactgaaattataacacttaaaagtgtcttcacattattcatgaatctgcagttgaaagtctatttttcaacctgtgtaaaccccagcctctcatttctcttcaggtccattcgtctaaatattctcgatcccagttacctgcttgacatttagagttagaggaatttaaagttacgctaactccaatggtttgcttttcaacaattttttttaaagttttacctttattttaaatttctgtatctcttgaatgttcttgtattttctcttgaactctacaatgaactagcatgtattttgttatggttttcccacaatggagtgctttctgtcaatggaggacctatctgaatttgtaatcctccacattgcaggtggtagtgctgtaaattcttttaaaacttttacagctcttttataattcgaatataattattgatcatttgtgtttgaaacatgaaaatttatcagaaattatatgagtattatgtattcaaaatcaatttgtaatagcaatgaatcataggacaagttcaaacattagaaatataaaatggcaaatttttaaatggcatttagattctaaagctggaattttagaaacaatttactcgatgtttccaatttgaaaagataaaacaaattgaaaagattgacaaatacacagtatgtgtcactcgatttttctcaaaatgaaattattgcaaggtaaatcaggacctaaagaataattacctcatctgcctgccctgggtacctccatgaatatgaaaacaaataaatgcaaaatgaggagaaacttagccataaaaacaaaagggaataggtatgctttagtagcaactttgtgttactagcagccatactagtcttgggtgtggattgacgaccaaattcacagaactcagtaccgccagcacaaagcttactaagctttaagaaaagacccaggacaggaaatacacagcatgcatacagacagaggagaggtctcatgagttcccctctcagtcatttgttactcaggacatgcattctagagaagaggctgagttagcatggtcaatctgatatccctttgttactggcggcaaatccatgcaggtctcccacaacctcaattcttgcttgcctcctcagaagaaagaattcaactgaggggcatagggcagagtgacagagtgagacaagttttaagcaggagtgaaagagcattaaaaagtttaagttccctgtagattctggatattagacctttatcagatgggtagattacaaaagttttctcccattctgtaggttgcctgttcattctgatgataatttcttttgctgtgcagaagttctttagtttaattagatcccatttgtcaattttcgcttttgttgcaattgcttttggcatttttgtcatgatgtctttgccaatgcctgtgtcctgattgctattgcctgggttttcttctagggtttttatggcttggggttatacattttaagtctttaatcaatcttgagttaatttttgtatgaggtgtaaggaagaggtctagtttgttttctgcatatggttagccagttttcccagcaccacttattgaataggagatccttcccccattgcttgtttttgtcaggtttgttgaagatcagatggttttagatgtgtggtgttatttctgaggtctctgttctgttccattggtctatatgtctgttttcataccagtaccatgttgttttggttactgcagccttgtagtatagtttgaagtcaggtagcgtgatgactccatctttgttctttttgcttaggcttgtgttggctacatgggtctgctttgattccataagaaatttaaagttgttttttttctaattctgtgaagaatgtcaatggtagtttagtgggagtagcactgactctataaattactttgggcagtgtggccatattcatgatattgattcttcctatccatgaggatagaatgtttttccatttgtctgtgtcctctcttatttccttgtagttctacctaaaaaggtccttcacatcccttgttagctgtatgttaggtattttactctctttgtagtgattgtgaatgggagttcattcatgatttgtctctctgcttgtctattcttggtatataggaatgcttgtgatttttgcacattgcttttgtatcctgagactgctgaagttgcttatcagtttaaggagttttggggctgagatgatggggttttctaaatataaaatcatgtcatctgcaaacagagacaatttgacttcctctcttcctatttgaatactctttatttctttctcttacctgattgcactggccagaaattccactacttagggcaggaatgaaaggaactaaagtacacttggaagagggccaagtgggtgacctgaaagatcaagtgtttgaccttttggggttttatacagtggcatgtttctggggtcttgtgttatttctcccctgattcttttcttggggtgggctgtctgcatgcacaatgggcttttagcacttaggaggggccacatgtgccatatgtttactggatttacacgcatgctcacttgaggcatttttccctttccagtccagtgttcctagagaaagatcatataccagttaaatgctgctattttgcctcttagtggcatacatgagccccttggcccaactcctgagatcttatcaggaagctactgatcaccacttacagatgtttctgtccattgagagactgcctttccctggttctggctgggaccaattattattttagagggacagcttaaaaactgcctgaccacgacctgatggtcacctgacattcctggtttgcagggcagagggtgggagactctcctgccctgctcatatctgactagctacgtactataatgccttcaccttttacagttagacaatcggacccattatatgtgctctttcatctatatgggttactcattattccataactaatttaaaccatgaaattagggagattggcctggcatgtcatccttgggcaaattctcgttcgcatattatccggcatagataaactcctaacaattcttgaatgagtgtggcaaaggggaaataaagcaaatgacaaatcatcaggtttccccaatgctagatgttagcccttttctttcacatgaatatgaaaataaaagattacatcctagatagaatgctgaaagatactagaaacctcttccccccacttcatcctaagtagtagagtgtgatgtgtgggaccaagtgaagaaaaatagagaggatcctggaatgtccttaacatagaaaaaatagtttggatgtaagaataggactcatacaaataagaagcacaccaacagacgtcccttttataagtgaagaataacagtgttcaaaagtaatgtgaggtggctccagggttcaaacaataggaaatctgagcttatactgagaaacctaggaggaatcttcctgacatgatagaatttctcccaaatgttactggcaatgacatattttttgagcaaaacggtttgtactgatgaatgatctcagaaaagagaaacatggaaattactgtgaaaaatcaatttgctgttctttttttgcctgttcaataggaagataattttcctagggttggatagatagaatcagttgattattattgaaaatgttttcataatgtgattgacaacaccgaatatctagccaaagtagtagcatatgaagagattgagagacatgaagaaggctgtgtattttttaataaatttacctgaaaagtgcattaattaactttacaataattggagataggagtcagatcataactagctaccaaagagcataaagtgccagaatcaatattacagtaaagatttaaacttcataaaattttcatacatagtgccttgtatgtacagtaatttattagctaactcggtagggaaatattctagtttggctaagtgaatcttcttgttacatactaattcaccaacatttcaaagatcaggctaagtcttcattgaaaaatgggacctcagctttgactcaatttttacctacatgcaactatgaatcaaactttatccatctaggattttcagtttgggataaaatggaataagctataaaacctgaacagaatgcatagagcatctctttgaggactctaaaaagtaaatagtgacagatagattggaaaaaaacagaattcaaaataccactaaattggtggtgactttccttttttaaaagtttctccagcctggactcaagttagcctgaaagatggaagcaggcatcagcatggacataaggaacaccaggagaagccctgtcatctaggcttgagaactgagaaaatggtttgttggaagctgtaggggtccgtcccacagaccctgacccaacaacagatgaataacgtacagtgacacagatattatgcttgtcagtctggctgagaatccagaccacttacagactcccgggagagtgctgtgatgagttgcaactccctggccctcctggcatgtattcagcacacaataaatgacaaaagtctcaagtaaacaccattagaaggtaattactgttgccggacccccaggagtagagagcaatcatgcaccgcagatggtcaaaggttagtcttaggaccacaagagtaaacaagcgatttagatagacttctctacattcctatgttaatcacccttgttatagctcaaagaggattaggctgccttcagccataactctatcctgaggcttttgcaaaaaccttctggccttccaagatagtttattttacaatttttccccccatcctgagtgaacccctacaggtagcagtagtagcagcagcagtgaagtcttgcagctatccaaggaagaggcatcatcctccttgatttaagtagctgtggcctcaagaggatgaggcaaactcacattgtttttactttatttttgtccactcaccacctgccttagatatgggtgcagcttagagagagggcaaaagagttagataaataaatccgctgctttctggataaaagaccaaaaaagggaagaccagagaattggaaacttcaggggagattacagagagggagagctaaggaaacctagtcaaatctagtggcttgacccctacccagttgactatctataaaacaaaagtggagatatttttcataagataataacaagacccagattttcaaaacataatactcaaaatgtctaggataaaatgaaaccttacctcacatatggcttacaaggaaaataacatcccacatatgaaaatacaataaaataaatgcctctattgaagtgacacagtaatgagagtaattagacaaacagtttaacaagctataataaaatattccaacaaataaaggtaaaaatgtattgcaggaatgaaacaatagaaaatctcagcaaataggtgtaatagaagatacaaatggaaaatgtagcactgaaaaaaattactggataggcacaatcacaggatggaaatgacagaaatgtgacaatatacttgaaaacagatcaataagaattatgcaagattaacaatagaaccaaaattgaaaaacatgaacaattgttaattggcctttggaatagttcctaaggtttatgattggcactactggtgtcccagaaagagaggcaaagagcgtagaccagaaaaaaatatttaagacataaaggctgaaaatttcccatatccagtgaaacatataaacctgcagattcaaaacactcatcaaaccctaaatcaggtaaacccaaagaagtgtgggccgagacacagcataatccaagaaaacaaaaagagtaaagagtcttaagagcatccagagaaaactgtttaaatgttttcaaactatcaaagaaacatggagacgttctgttaaatgtctgtctgcagatttctcatcagaaattgtggtgatcaggaaaagaaagaaaatatgtttaaagtgctgagataactgtcctcccagaattctaaatcatgtaaaaataatgtccagaaataaacataaaataatagtgttctcaaataaaggaaaactaacagaatctgttgctgtcagaattgctctgaaagaattgccaaaggaaattcttcatagaaaaagatactagaaagaaacttgcaatatcacaaacgaaagaagagcgacaaaaatggcaactattggggtaaatagacttgttctcatgattctttaaaatgtttggtaatatatagtaatgagatttatatgctctggttaaaatgctaaaataccaattctgaatagagtgagaaaagttaagtatttggatgataatccccaaagtcactggacacacacacacatgtctgcaaattatacagtgagatacagctgaatgtgcagtaggtgtatttaaatagagtaaaaaagatgttggaataacccaaggaaaataagaaaagatgaataaagattgaaaaacagagggaataattggaaaaaaaataataaaatggtagacctaaatctaagcatatcaataaatactaaatgcaaactgactaaacacacattttaaaatacaaagattgtcagaatggattaaaaaaaacatgaaatggctatatgctgtctacaaaaaattcgcttcagatatacatagtgatgtagataagctagatataaaggattgagaaaataatatatatgcacacacgaacaaaaacaaagctggagtggctgtgttaattagatgaagtgggcttaaggaacaagaccagagacgaagagggacattatatttaaagcagaaaacaatcccaatgtgtatgaacctaacagcagaattttagaaaacataaatcaagcatggtcagaactgaaaacacaaacagacacattcccaagtagagttagagatttcaacattcttttctcagtagctgatacaatctgtagacagaaaataggtgagaatgttgacctaagctgtgacatcaatcaatcaattctaattgacattggagcactccactggacacagcagtgcatacatttttcccatatacacaaggaacattcaccaagagcgcccatattctggattctaaagcaaagttcagcaaatataaggaattaaaatcacacataatgtgttctacaataataatcaactaaataacaaagataacaggaacacctccagatatttgaaaatttaacacattttcttcttttaaaaaaatctgtataaatttaaggggtacaagtgcagaaaacaaggaacaacattacatggatatatggtatagtgatgaagtcttggcttttagtgtaactatcatccaaataatgtacattgtaccattaagtaatttctcattccttacctccctcctactgtctcacctttccaagtctaccagtctgttattccacagtagcatactttttaacaatccatcagtcaaagaaaacatcaaaaggaaaattagaatacatactgaactgaggaaaaatgaaaattcagcaaatcaaatttgtgggatgcagctaaagcagtgcttagccagaaacttgtagcagttaatgcttacacaaaaagaagaaaagcttgacatgaataagcttggattatctaagattccatctagaaaaaagagcaaagtaaactccacagcaagcagaagtaagagaataagaaagtgaaaagtagaaataccctctttaaaaaaaacccaggaaaacaacaaagaaaatatattaaaacaatagctgtaaacttctggaaagactaacaaagaattatctttatcgatacccaattatcaatataaaaattatagatagactatcactacagactccataaacattaaaacaataagtctgtatcacaaaaaatcctacacaccaaagtttgtcaaattgcatgaaatatattaattcctcaaagccagaaatcaccaaagcacaaccaagataacttagataaccatcatgttcatataactatttaatttgtagttagtctttttctgaaaataaaatcctcttggccaagattgtttctgataaattctagggaacatttaaagaagagttattttgtatctttgtttactttgttttgaagattgtttctaataaaatttagggaacttaaagaagagctattttgtttctttgtttactttgttttgttcttgttctactttaatgcatacaattggaaaggaagaaattaaactgtgtttactcacgtaagatatattctatatagaaaactgaaaggttttccaaagaacttctgtaactaataagatatcgtagcaggattataggatacaaattcaccacacaaaatgaactacatttctctatagaagcgaagaacttttgaaaaccatataatcactccaaaataaaatacctagttgtaaacctaacaagtacagaaacagaatgttgacaggtataaaacactggtgaaagaaatcaaaggaagcctaaacaaatggagagttatcacatattcatagatttgtctcaatatagtaataatgttaattcaacccaaaatgatctgtagatttaatgcaagtccaatcaaaatctcaacaagatttcttggccaatatataaaacttgattctaaaatgtatatagaaaaggacaaaagtgctaaggtgataaaataaccaaaacaattgcgaataaagacaaaatgggagactttcattttctaatttcaaaaaattgtttagtaatcaaaagaatacagtattagctaagggccggacacagagatcagtgtcacagagaagataatccagaagtagacacacaaatatggacaagttttgacaaaggtgcaaaggcaatgacaatagagaaaggatagacttttcaacaaatggctttggagtacttgggcaaccacatgcaaagaaaagagcactgaattaaacttcacaatttatctaaaaattagctctaaattgatcatagatgtacatatagaacacaaaactgtaatacatttagaaaaaacacagaagaaaaccttcattcccagggagtagagtttttacaccttacaactaaagcaagaccatgaaagtcatatctatatatatttatatatatatatgtgcatataaataggactacatcaaaatctaaaatttttgttctttgaacttactgttaagaaactttagagagtctaaaagtctcctaaagttacagttcacattaacagtaactttgagaagttaaagttactgtttactttaacagtaacttttaaagttaactttgagaagttaactttaacagtaattttaaagagcatagaaagagcaaaaatatgttcaagccacatatctgaaaagggagctgtattcagaatatataaagaaatctcaaaatgtagcagtaagaatcaaatttaaaaagggcaaaagacttgaacagatgtttcacgaaagaagacatggaagtccagtaaacatgtgaaaagatgtttaaaatcaaaatcactaggaaaaagtcaatgaaaatcatgagatatcgctacaacccattagaataactcccactaaaaaaaagtattaacaattcctggtgctggtgaggtcaaagagcaactgggattctcatacattgcattgggaaatgaaaatgatatagtcactctttaaggtggttggtagtttcatgttaaatttaacattcacttaccatatggcccagcaatcccactgcttggtgtttaccccagaaaaataacttagatttatacaaaacctacatatgaatgtttatagcagttctcttcataattgccaaaaacttgaaataacccaaatatctttcaatggttgaatggataagcaaattatgatacatcccgactatagaatactactaaacaattaaaatgtgtgcattattttggtactcacaacatcttacatcaaactcgaaggctttaatctgagtgaaagaagccagtatcaaaaagttacagcctccatgtttccatgtgtgtgttaatctctaaaaagataaaacttcagtgatggaaaacagatcagtggttgacaggatgtaggagtgagaagtagtgggactgtaaagagatggaaggagagaatgggggaatggaatataactgttcggccttcttttcggagttggtggctacatcagcatgggcacaggagagaattcatagaactgtatgccacattaaaggtcaattttattgagtattaacttaaatatgaccttaaaaataattatccactacataccaaactttgtatttaatagtagtaaaaagcttggaagatgagctgcatgaaaatgcaaaataaaggctgtctctgaggactttaagagaagtagaatcattataggaacacacactttttcaaaaacttcatatgaatgaaagagttctaaggaacaatattacactgtttatatttcagaaattaaaatttcaaaataaaagtttgattagaaataagaaaaactaaggccagtttaaaaattaaagccagtcaaaaaatagattacagaaaatattttttaaataataattgattataaaattatagctaagaaaactctaggcctctttcaagcaaagtaaattccaaataaagcatgttcctcatataacttcttgacagtgaccagaatatgatttagacacaacagttaaccaaacttataaaatgcacctcttacttcgtgattctgaggaaatttcagagagtgaaattccagcctctgtttcttttgttttgtggtctttcaaatatataacatccctgaggagaacgtaggaagctcttctactttgtgtcaaggctccgggtgattcatttggaatcttctacctttgattcacacatatacttttaggttcaagagtatgccttactttattaccatagcctgtcgcaggctcgattaaaatttctggaaacaaatgaaaaattgtgttatgaaaagaatatgattctaagaatcaggaggctcttattggaatattagaattatatacatacagatcattgcacttaagatatttccacttagtctgtgcctctgtctacaccttgatttctgctacttccttggcccccaagtatgtgattccctaaatctatgcatttccatgtcttcatgctttgcacatgcagcttcctctgcctagaatattcttgcctcattactcaccataatcatttctaccctttcttctagaggctattcaggaattacttccattggtaaatctgtcctaatcattctctactccccagatgaaagatcaactacttactcaaccatcccatccaccgtttgtcttcacagtacattgagtttgcctctaatcttacccacttacagcatcacaaggaattttttctcatctatttacatttttacttttttctcttgccagcaatagctatagaaattcaacaaacgcttgatgagtaaatgtataaatgaaacaatgaatgaatgaatttagctttctttggcttcagtcctttcattataaaacatctataaaatattctctacaaatatttttttcattctgcagtaggtgtagtatttgaaaatgtgttatttacaaaaactggcagaatagatgaaatcccttctcacataagagtgtgcaattgttttcataaccagtttagacaacactgaataaactcacacccactctacctataacatctctgctctgatgttagcagaatttctaaaagcaaagtaaagttatttacaagttataccactgagaattgaaaatgttataactggtacattattttgaaagaaaaaaatgtcaaggtgcctttatttagaattaagtggaaatagctttgctgattcataggaataaaatatatcctgcacaagtgaaaaatttcaacaatcctcatacatttaatggtttaccttatttttttttgcttgaatttgtggtgaatttgaaaaattatgaaaccattttatgtatattgaatggatctattgctgaaaagaaagtcctgcttacaaatttttatttaattaatttaattaattaatttagttttttgttgttgagctggagtctcactctgttgccaggctggagtgcagtggcacaatctcagctcattgcaatctccgcctcccaggttcaagcaattcccctgcctcagcctccccagtagctgggactacaggtgcacaccaccatgctgggctaattttttgtatcttagtagagacagtgtttcaccatgttggccaggatggtcttgatcccatgacttcgtgatcttcccgcctcggcctcccaaagtcctgggataccaggcgtgagccactgtgcatggcctacttataagagttaactcaataaattagcattcatttgtaaatcacccaaatatatatagaacatcatattagacaagtagataggaaaattttaaagtcctaatctgtgtcctcagcttgggtacaataataatgattatggacaggcatatacagaacttttaatacaagaaaaaaatgtattatgaattgtgtattgttttaagagtttcacagattttgtacaatctgatattctcagtaatggtgaagtgggtaacattctttcacatttgaggaaacacgagtatggagacattaagtaacttgcccaaggacacactgtaaatagagaagctgctattggctatatgaatctagagttcaagttcttaaaaactatgctttatagatgattaattctgtcttgaagttttataactgcagataatcagcatgttagctggaggcccactcaaaagacattctctttacaggcaataaattagtcaagtcatagaggtaaaacaatttaataaaaatattgatgtgattggaaatcatgaagaatttgactgtattttaggttgtgctaaaacaggaaaagtaattgaaatcagaagacggttttgaaagataagattttaagcactcaatttattcattcatttctgcatttctctatgaaggactgggcgcctactctgtgcaaatctctgttgcaagtactgagggtggagtagtgaacaagatagagaaaaacctgtgcttgtgaagataacatcctaaaaagaatgacagaccatacataaatatgtaatatatgccagatagtaacaagcactcgaaggaaaaagaaagtggctaagtaatagaatagtttgatgtgaagaattccatggtataggctctatcatgatttacccctgcctcaaacattacatcccagcaacatcaatccgctaatcatttccttgtatacttcctgatagttttaaccctcctctccctatcttttctgtctgctctaaggggaattcctttcttcccattgcttttaattatctctgaccctttaagcatcacataaatctttccttaggtaaaatattatattcccccaaaaggttctctctgcttaattctctctgctattgtctcattatcttaggcttagcatcacctcttgacacacctctcgccttgatagcacatctcctcttatattttcttatctttttcttattttttcattactttcttccttcagtgaccacgatagtgcctcatgcaaaggagacattctacaaatgtgttgggaatggaaagcagataaagatgtgatcgagatgaaagagaaaaatggcatttggaattctcccttcagagatcaaagttaacagtatggtgatacggcatccaaggaagacagaaataactgatttcaagacagcgaaatttctacaatttaccagttatttaaaagctagcaaacaaacaacggcatactcaccttcatctgttgggggaaaattattttttgtcattgctcacttcaacatgggcgcaatgagagataagagacactaagaaatgagtgtagaaatgaatatttttgctcattctgctagaaaatataatacttagtagaaacagattcctgaattgctacactttaaacatgcaatcacattttactattatatgctatacacatactctaaatgttgtaagcttaatatttcagattgtataagagattttgaggcatgttattgtacatacaaataacataaatagggttaccatcctaatccaagggttacttagaaaagaaaccaatactatttttgatatattattaatgacattgtcttctgacaacataatttcttatacacactgcttttactttaaaaattgtttctagataaacataatgttttttcctcttttgctgtttttttatttttggaaaaattaaaggcatctttatgtttattcttagagataactcagcttcatcttggcccactttcaagtaaaattcaaataaattaatttgagggatgtcaaaatgtctaccagcctaataacttaacaacctcttaagatgccagtgggttagaataaaagacctacatcgaagggaatgatggggaacatggcaggagggaattttgtcttaatatcctttcttagaagcatgctttctgtgctcagctgcatagaaacaactggcttcagggagctaccttttactcaatctttagaacagtattattcattcaattgcaatgttgactattgtatatacaattgacataaggcctcaggacattcagtcttctgttacggaatttatggaatctgagctctcctgctgggatcaagacaccatctgtaggaactggtattatgaacccacctctgggttactttagatggagccacgtggctctggctcctagatctcagctgtatccatggcttatgctgattttccacctataggggactatgaaaattcacttgtcttaatttcagagtgagacataagtaagggtgattagattgatagcatctccattaccaaatcaatcagtccatggcttgtcagcattctttctagggtttgcaacttgtctgaggctcagttcactcctctaggaaatggaatgaagtgagggaggataagatcaggctatgatgtgtgggcctttctcaacattaaagtagatcattcccatcatttgaattcactattatgattttaattaaaacctttgttaatatctagattggtatcttataaagacatagagaaaaggatgggttcatttcatctgaaaggttagggttttctttggtttgatatgtttagcttggcttttaaaattcttgaacagactttatttctgttcttaatgtattttttctattttaattattctggctttttctcaagtaaatctgctatttttagaatagatttctatctatcatctcccatagctgtattggctctcattttattcttggttcttcatttctgcattctgggaaagtatctcaaatttgtctttcacaacattgactggacttactgtagtttccactagcacaaatgtatattttaattatgctttctttttccatttttgtctctctccagaaatatttcctaacggtcatacttgtaattactttatgttagtttttcatctggggatctcctttgctaggatttttgcatttatttcagagaaatcagctgtcatttagcctgcaaaaaatgccagctgattaaatgatacctctgttgttcaagggcatatgatttctgtgaccatttttggatgttgtttcacttactttgtgctctcatatttttcccacaaaccccatggttctttgtaggtttttccctttaaccttaagagatgcatattctcttataaagtcattttgttgccagagctataattttctccttcttctgatacttagctctttgacattttccattgagcaagggagaaactgcaatcatcaatctgtatgactcctagacccttcctgacttcatcatctcatgcagcactttacctgtgatcattttccatctcagtaggttatgcttgttatatggtgaaagagagacgtggagtgcaggctggagaagtgggaggcaaatggtctcaaaatagaacatccctgtagtgaagttctgggtgtcccgatttctagttgctttgtaccttgggtgtctgggctagaatcagtcagtgggaaagaagcaaaatagctcctgaccttctctaagaccaagtttatcctgttttcaatagcaaagcatgcatccatgagatattgatgatttttgccagtccaacccatttatcttatattaactaaattttctccccgattctgccctggcaacacttaatgattgatcctagtaatttttttttattttgtagattgtatgtgtgtgtgtgtgtgcgcgcgcgcgcgcgtacgctgtgtgcatgcacgctcatggtaacacatattttttactatttccgagtcaccttaagtactttagtgacaagtggggagaagctacagaaggaacaattaataccactgcacttaaaatgggaatccctaaagcaacaaataataagattttaaggatagtatgtgtgaacatttcaatacataaaatatatcttacaattaagacaataaaaatattatatataagaaacagctttactctaaatgcttcatctgtaggctttttcagaaagttatcaacataatgatcatctgaattgtagtaacccagatgttgatctgttactttttcacctatttcttcattttccctatgccaatatccagttagctcttctgtattttcagtgttcatttagaagagaagggaagggttcacattattcatgctttggagattaatgatatagtcaatcatctgaaattcacatggatcattactgccttcacattaatttatgctcaattaacattcttagaatcagttttctgtggagtttagccaattggctttatagcttctggctctgcaaggttcattttgctctgatcactagtaataggagtagctacagtcctccttcctgtcattaaagtcttcagggctttggttttgctcataaattgaatggggccagcacgtgatgcgatgttgtcacagagttcctggataacagccacattgctacatcctggcaactgtcctccatgcagatgtgatgctcagccgagcagcagggtcacaggtgtacctttgtgctggtgtattggaaaggtcaccggcggaaggccatgttacactcagagggatgggaagacgtattgttcgtacttgaatactgttcttctaggagaagggcgggaatcagcaggccgccttttcctgtagtgaaaatcagcaggaacatggctttttccatattggacctagaagtaatgttttaggaatcattgacagtgtgcttaggggtctattaaacataggagaacatgcaatccttttttgtccaatgtttaggtgaaaagtgaatttataataatgaacattgaaagtattatgaattaattcacttggactgctgtcatggttgtggaactaaataaacttctgttcctgtgtatttttccacatcctagttaaaaatctaaagcttttttctgttttttttttttaattaaggcatataagacatctttctttctctctctcattctctttccctccctttctctccctttcctttcctttcctttcctttttccttttttctttcctttcctttcgacttcaggctaagagaatttcaataaatggttttacaggttgagtatctcttatttgaaatgcttgggataagaagtgtctcagacttcaggtttttggggggtttgggaatgtgtgcatatgcataaagagatatcttggggttcggatccaagtctaaacacaatatttatgttttatatacacctatacacatagcctgaaggtaattttataccatatttttagtaattttgttcacaaaacaatgttttgactgcattttgactatgactcatcacatgaagtcagtgtggaattttctacttgtggcatcatgttggcactcaaaaagtttcagattttgagcattttgaacttcagatcttcagattaaagctgctcaacttgtcttaaaagaaatggcctttgaatgtagatcaactaggaatttagtaatttactcagataaatcagtaaaaagaaagggagtaaggctaaaaaaatataaaaactaaacaagaaggggtatgatttttactgaaggttttgctagtccctgcccccccgcccccgccccacacacacacccaggtcatattgatttgtcacctgtcagtgtctgctccaatgtaaaacacacactattttaatatattttctctcaaatttagtgttactgttttcatgtcagggataacattctaagctggaagactaagaattaagacatatactatggtgatcccaatagcaaaattacttggtgtgctgttctagagaacgctgaatatttatcagaaagagcccagggaaatttagaagtccttgtttcaggctctgtgttcagcccagaaaatttggtacaaggaaaaccacagaaagaactactactttttccactcttactttggcccaaggcattgttgtacgtgccttttaaacatatggggtaggcactgtattatctccctttcatagatgtgtaactggaggcacataaaggcaaatacatgctccagatgacaaaggtaatagtggcaagcagagactggggcctccatttgcccaatccagagcctgcccattcgccacagtgctatatggccttcaagagaaatgagccagatgctttgtgaggggcggaatttctaaactcagttctggactactttgaataaaactaggacagaattatctagtgagtcagacaaataacccgtaagacccattcggccttctccaataaaggatccaagagttcttttgtgacaaagcatgactcttatctgtgacagcaacctgaaaaaaataggttatggcaaccacttatttcatgcaccgtcattgactgtcattattccctcactcatcgtgactggcagactccacagaaacgcagggagatgacagaacatatttgttgaaaaattagtaagcaaaaatggtgaaagttagagaaaactgaagaacctggaggataagtatgcaatataagctcaaaagagtagtcaaggtaaaaccagtaaagagaataaaaactagatgatatatttgcagaaaaatgagattttgttttaattcactaaaactcataatatatattgagtgtttccactgtgtcaggcaccactaagcttagtactaagaacaagtaaatgaacacataatccttacccccaaagaatttgtaaccaaatagttgatatacagaaacataactgactgtaccaagatgggagcagcatttttttgagaatccaagaaagggagtaaagatacctggaagactgaagatggtgtggaccttaatgtgtttctttcatctaattccagagatttttggtttttgtacagggtaaaacatgaagcttgacaccagtatggtatgaagttctcgacccagttagatgcttgggaaggtggcatttttgtttgacctatgtacatacaactgagaatacactgtagaattttactagcttgtttttcaagcagtagatacatttattttatataccctcataatatgaatataaatttctaaagcagataaaaggactaatttatttaaaatgaattgaatcaatgaacccaatcaataagacacagtgtaatactttattaaccaccaaaaatggaaatcctggtttatggatgacacaggccttaagacaattattggttttttgtgttcaatattgaggaaatcataattcacaacactaccctcaaacccagaagactaaattaagttgttctaaaacatgaaaataaagtaagaaagaaaagtttaattaaataatttaacttgaaatattaccaataactactaactgttcacatttcttttcatgaatataaaaatcagacaagaagcacttaagcgtaaaagtagcattagactttttctagtgtgatattactattaaatcatatattctgtattttcatataactattgactttgtgccatgaacttgctgctagcttatagatccctgagaccctttctcagtatttaattgcatgcatgggttactaaagttcacctaatagtaccattttgttaggtacagctaattttttttctacttttaaatatacattaattataatttttaaaattatgcactgagtactgtgggagaacatactgaggtctacacaagaaaataataataatccatatagcaatagttaacatattagtaatttggaaattaacattggcataaaatacacgagtccatattgttgttttttattaaactataaaaatatttatacctgtgaagttaaatttaaaaaatacaagtttgtagacccactaatgcacttgatatattatggggataaaacttcttcctgctagagtcaaaatggctaaaatgaattcctttatcagtaaatattattggaaggtgaagagatattctttgaaaatttgaagaaagaagtattaggacaagttattcagtgtggaaggtgttctgtaaagctggtaaagaaaatagatgtttctgagtgccctttttcagttgctgtaaagaaagagaagcctaggaacgtccttgttttaattatcatctatatattcatgattcccaaatgtgtatttccatttctgacttctgtgatcaagaacagattattgagtctgcagctcccagcatgagcgatgcaggatgggtgatttctgcatttccaactgaggtaccaggttcatctcactggggttcatcggacagtgggggcaggacagtgggtgcagcccactgagtgtgagccgaagcagggtgaggcatcacttcacctgggaagcacaaggggtcagggaattccctttcctagccaagggaaggggtgacaaactgcacctggaaaatcgggtcactcccactctaatactgctcttttccaatggtcttagcaaatggcacaccaggaggttatatcccgcgcctgtctcggagggtcccacacccacggagcctcaatcattgctagcacatcagtctgagatccaactgcaaggcggcagtgaggctgggggaggggctcccaccattcctgaggcttgtgtaggtaaataaagtggccaggaagctagaactgggcagagcccactgcagctcaaggaggcctgcctgcctctgtagactccacctctggggacagggcatagccaaacaaaaggcagcagaaatctctgaatctctgcagacttaaatgtccctgtctgacagctttgaagagagtagtgtttctcccagcatgcagcttgagatctgagaatggacagactgcctcctcaagtgggtccctgactcccaagtagcctaactgggaggcacctccaagtaggggcagactgacacctcacacggctgggtacccctgggagatgaagcttccagaggaacgatcacgcagcaacatttgctgttatattcgctgttctgcagcctctgctgctgatacccaggcaaacagggtctggagtggacctctggcaaactccagcagacctgcagctgagggtctgactgttagaaggaaaactaacaaacagaaaggacatccacaccaaaaccccatctgtacgtcaccatcatcaaagaccaaaggtagataaaaccacaaagatggggaaaaaacaaagcagaaaagctgaaaattctaaaaatcagagcacctctccccctccaaaggaatgcagctactcgccagcaatggaacaaagctggacggagaatgactttgatgagttgagagaagtcttcagacgatccaacttctccaagctaaaggaggaagttcaaacccaatgcaaagaagttaaaaaccttgaaaaaagattagatgaatggctaactagaaaaaccagtgtagagaagtccttaaatgacctgatggagctgaaaaccatggcacgagaactacgtgatgaatgcacaagcttcagtagttgatttgatcaactggaagaaaggatatcagtgaaagagtaaaaagaaacgaacaaagcctccaagaaatataggactctgtgaaaagaccaaatctacgtctgattgttgtccctgaaagtgaggggagaatggaaccaagttggaaaacactcttcaggatattacccaggagaacttccccaatctagcaaggcaggccaacattcaaattcaggagatacggaggatgccacaaagatactcctcaagaagagcaactccaagacacatcattgtcagattcaccaaagttgaaatgaaggaaaaaatgttaaaggcagccagagagaaaggtcgggttacccacaaagggaaccccatcagactaacagcagatctctcggcagaaactctacaagccagaagagagtgggggccaatattcaacattcttaaagaaaagaattttcaacccagaatttcatatccagccaaactaagcttcataagtgaaggagaaataaaatgctttacagacaagcaaatgctgagagattttgtcaccaccaggcctgccttacaagaggctcctgaaggaaacactaaacatggaaaggaacaaccaataacagccactgcaaaaacatgacaaattgtaaagaccatcgaggctaggaagaaactgcatcaactaacgagcaaaataaccagctaacatcataatgacaggatcaaattcacacataacaatattaaccttaaatgtaaatgggctaaattctccaattaaaagacatagactggcaaattggataaagagtcaagacccttcagtgtgctgtattcaggagacccatctcacatgcagagacacacataggctcaaaataaagggctggaggaatatctaccaagcaaatggaaaacaaaaaaaggcaggggttgcaatcctagtctctgataaaacagactttaaaccaacaaagatcaaaagagataaagaaggccattacataatggtaaaggaatcaattcaacaagaagacctaactatcttaatatatatgcacccaatgcaggagcacccagattcataaagcaagttcttagagatctacaaagagacttagactcccacacaataataatgggagactttaacaccccactgtcaacattagacagatcaatgagacagaaagttaataaggatatccaggagttgaactcagctctgaaccaagcagacctaatagacatctacagaactctccaccccaaatcaacagaatatacattcttctcaacaccacatcacacctattccaaaattgaccacatagttggaagtaaaacactcctcagcaaatgtaaaagaacagaaattataacaaactgtctctcagaccacagtgcaatcaaactagaactcaggattaagaaactcactcaaaaccgctcaactacgtggaaactgaacaacctgctcttgaatgactactgggtacataatgaaatgaaggcagaaataaagatgttctttgaaaccaatgagaacaaagacacaacataccagaatctctggggcacattcaaagcagtgtgtagagggaaatttatagcactaaatgcccacaagagaaagcaggaaagatctaaaattgacaccctaacaacacaattaaaagaactagagaagcaagagcaaacacattcaaaagctagcagaaggcaagaaataactaagatcagagaagaaccgaaggagatagagacacaaaaaacccttcaaaaaatcaatgaatccaggatctgtttttttgaaaagatcaacaaaattgatagactgctagcaagactaataaaaaagaaaagagagaagaatcaaatagacgcaataaaaaatgataaaggggatatcaccaccgatcccacagaaatacaaactaccatcagagaatactataaacacctctatgtaaataaactagaaaatgtagaagaaacagataaattcctggacacatacacccttccaagactaaaccagtaagaagttgaatccctgaatagaccaataacaggctctgaaattgaggcaataattaatagcctaccaaccaaaaaaagtccagaaccagacagattcacagcagaattctaccagaggtacaaggaggagctggtaccattccttctgaaactattccaatcagtaggaaaaaagggaatcctccctaactcattttaagaggccagcatcatcctgataccaaagcctggcagagacacaacaaaaaaagagaattttagaccaatatccctgatgaacatcgatgcaaaaatcctcaataagatactggcaaactgaatccagaagcacatcaaaaaagcttatacaccatgatcaagtgcacttcatccctgggatgcaagctgcttcaacatacacaaatcaataaacataatccagcatataaacagaaccaaagattaaaaaccacatgattgtctcaatagatgcagaaaaggcctttgacaaaattcaacagcccttcatgctaaaaactctcaataaattaggtattgatgggacgtatctcaaaataatcagaggtgtttatgacaaacccacagccagtatcatactgaatgggcacaaactggaagcattcccttggaaaactggcacaagacagggatgccctctctcaccaatcctgttcaacatagtgttggaagttctggccaggccaatcaagcaggacaaagaaataaagggtattcaattaagaaaagaggaagtcaaattgtccctgtttgcagatgacatgattgtgtagttagaaatccccatcatctcaacccaaaatctccttaagccgataagcaacttagcaaaatctcaggatggaaaatcaatgtgcaaaaatcacaagcattcttatacaccaataacaaacagagagccaaatcatgagtgaactcccattcacaattgattcaaagagaataaaatacttaggaatccaacttacaagggatgtgaaggacctcttcaaggagaactacaaaccactgctcaacgaaataaaagaggatataaacaagtggaagaacattccatgctcacgggtgggaagaatcaatatcatgaaaatggccatactgcccaaggtaatttacagagtcgatgccatccccatcgagctaccaatgagtttcttcacagaattggaaaaaactactttaaagttcatatggaaacaaaaaagagcccacattgccaagacaatcctaagccaaaagaacaaagccggaggcatcatgctacctgacttcaaactacactacaaggctacagtaaccgaaacagcatggtactcgtaccaaaacagagacatagaccaatggaacagaacagaggcctcagagataataccacacatctacaaccatctgatctttgacaaacctgacaaaaacaagaaatggggaaaggattccctatttaataaatggtgctgggaaaactggctagtcatatgtagaaagctgaaactgattcccttcctcacaccttatacaaaaatcaattcaagatggattaaagacttaaatgttagacctaaaaccataaaaaccctagaagaaaacctaggcaataccattcaggacataggcatgggcaaggacttcatgtctaaaacaccaaaagcaatggcaacagaagccaaaattgagaaatgggatctaattaaactaaagagcttctgcagagcaaaagaaactaccatcagagtgaacaggcaacttacagaatgggagaaaatttttgcaatctacccacctgacaaagggctaatatccagaatctacaaagaactcaaacaaatttacaagaaaaaaacaaacaaccccatcaacaagtgggtgaaggatatgaacagacacttctcaaaagaagacatttatgtggccaacagacacatgaaaaaatgttcatcatcacagaaatgcaaatcaaaactacaatgagataccatctcacaccagttagaatggcgatcgttaaaaagtcaggaaacaacaggtgctggagaggatgtggagaaataggaacacttttatactgttggtgggactgtaaactagttcaaccattgcggaagacagtgtggcgattcctcagggatctagaactagaaataccatttgacccagccatcccattgctggatatatacccaaaggattacaaatcatgctgctataaaaacacatgcacacgtatgtttattgtggcactattcacaacagcaaagacttggaaccaatccaaatgtccatcaataatagactggattaagaaaatgtggcgcatatacaccatggaatactatgcagccataaaaaaggatgagttcatgtcctgtgtaggggcatggatgaagctggaaaccatcattctcagcaaactattgcaagaacaaaaaaacaaacactgcaggttctcactcataggtgggaattgaaccatgagaacacttggacacaggaaggggaacatcacacactggggcctgttgtggggtgggggaaggggagagggaaagcattaggagatacacctaatgtaagtgatgagttaatgggtgaagcactccaacatggcacatgtatgcatatgtaacaaacctgcacattgtgcacatgtaccctagaacttaaagaataataaaaaatagttgaaaataaaaagaaaatagatgtttctaacacatctcaacttatttgctaaattctgttttaaaatattgaaatgtaagtacagttttttttcctgagccaataaagaagcataacagagaaaatacgtttttcaaaaaataaatgtttttggtaaaaacaatgttttatggaaaacaatacaaatataatctctgctgaaaattagactgtgcaagaatgaacctcttctgttacaacattcgttggaaaatgattacgacaataatttgtggcagaaaatgcggaaaagtgatataggatgttattgatacagttaacgtaattaaaacaagacttctttgatgattgtaaaagaaatttatgaattgtttgtaataatgctcagaatttttatgaaaatctcttgtactcagatattcactattgaccttctggaactcgtgtgttgctaaactcaaagataagtaacaccttttttaaaaacaacaacaaacaagtgttccaaatttgctgacattttctgggctgacagtagtttctcagtcatatgctgtttagattaacattttagaacatagttacttaatctatccttttatagcaaaaatgttctttgatatttgacaaatacctcctttttgtatgtaacttgtacaaagtaatgataatttttaatgaatatttagaaacatttccatcaaatatttgagaatttgattttgtaaatacatacacagtttttctgatctccatctttcaaatatgtggaagcaaacttttaataattattttagaagcaaaatttctaggtcttccaaataactattttagtgaattttaaattaatctgtttaacataacaaatgtaaaacatttaaattagttaaaaagaagacatcaaagaacatggaaatcaaccaaccacatttcaacaaaaccttttgtattatagtatcaatacttactcattatagtcaacaaattaattatttcatttgaattaatattttacaaggcagctgtgtcaattacatcacacaagttgtttcccatgcatataaaagtaatgtttagattatactatagtcaattaagtgtgcgataccattttgtctaataaaatgtgtatgtatcttaattttaaaaataatttattgttaaaaattgctaacaatcatctgagccttcagcgagttgtaatctttttgatgatagagggtcttgcctcaatgttgatagctgcctactgatcagagtggtggttgatgctaattggggttgctgtaacaatttattaaaagcagacaatgataaagtttgccacatcaattgatgcttcctttcatgaaagatttctctgtagcatgcgatgatgtttgctagtatttttcccatagcagaatttgtttcaaaactttgaatcctttcaaaccacatctctcctaagtttatggaatattctaaatcatttgttgtcatttcagcaatgttcacagcctcttcaccaggaatgattttatctcaagaaaccactttctttgttcatctctagattccacataatacctaacacaacgtaaatgctatgtaaacagttgttatcctgcattgtatagggagtaatggtaaggaaaaaaagtctatctatgttcagtacagacagaatatttttccaaatattttcagtatatggttggttgaatccatggatgcttaacccatggatacaaaaggccaactgctactgatttatgcactcatatttctatgtataatcaaaagaacaggaagtttgtcacttatttttctaaagtcacattagacttctatctggtctcctagacctgtggtgaggccaactcattctaaagtcctttcattgagagcatatcagaaaagccagacagaaagttgtatattgattattgtagattatccattcacttggagctaaaagtagttattgcttatatttgttttaggctcctcagaaacagcttttaggtagacatcattaacagtcacatcatttttaaatatgaaggtttgcaagctaaatacaaggtccagaattaaatgtaggcaagaatgaattcaacacaagatatggagatgcgtagggatgaataacattgtaagccttttaaagcccttctttatttcagttaatgaccaatgcttgggtttctaagtgtattgaaaaataaagaaaggttgagtggggcttatcaactaagaaaaacaagttcatgcattgaattttgtgccatcttaaatgcaagtgattattaaagcagctatgactgaaaggccataccatcgcatggcacatgactgtgattgagtctgcacagtctctgtagccctcccattgattttcttcagtcatctcacagtggatgatttctgtttggcctactacttgctaattatttatgaatttctgctgttattgctaccatttgtttaatggaatctacacagtggagagattttgcgctgtttatcatagtactctgaattgtaaataatggattcagagaagaaaaatatcacatgttttgaagtgagcatatgaactgcctcatttgaagatacgatttaatataatgaagcaactgggagaatcaaaatgaatcagaagtagatagattcaagtgtgtgtgtgtgtgtgtgtgtgtgtgtgtgtgtgtgtgtgtgaaacaaccagaaaagcttagaagatactttgggtgacagtaataagtatatgagaagaaactgtagcataaatataatggcagaaagttaaatgtttctaatatgtctacctggttgaaatcataatagagattccacctagtatactgaattatatctctaagggactactgcaaaagataaggacagtttctgtcagagcagacagtcatttgatgcgatcttttctcttcttccaaaataactgccaaaggaaaagtgaagggagctcacttctggcactagctgatggtgatattatccatgagagctaatcctgccagaaatttgctctgatcccaatattcacagctatatactcctctgtatctaatcaaaagaatttcccttatcaactcctttcttaggcacaatgtttactgttctttccaacgttaagcattgaatgtctctttactaccttgatgctctatcagatatcattgcaatttctataatataatctccaacttctcactgttcactaccccttgattacataaacatgttcaagtatctcctgtcttaaatgttactgtagaacacagaaaaccttccttgacttcatgctccccatcatataatattcatccatttgttcttttattcaacaaactttgttttgcaaacctattgtggtccaggtattgttccacagtatggaattatagacatatagaacaataaacatgcaaatattgcaagaaagtggaaggtaattaacagcaataagaaaaatatgataaatgttgacagaaaggccaattaggtcgtcagtgaatgagaattaatgctaacaaatttgtgctttcataacctgaggtcagagtgctcctggcactcactaactccatagatagtgtcatgacccccaactccaaaaggaattttgacatatttgaaaaacagaaataagtccagtgtgggtgaaagatgtgtgtaatggggtacatgagaaaagtcagacaggagagcaggagccagatcacacaggaccttgtaaggtaggaccttaaagggtagggaatgttgcttttattttaagtaaaaatgggaagacatagaaggattttaaagaagaaatgcagatgacctaatcagaccttttagccatgacttaggatgttttagggggatggataccaaggaaagaatagaaacaggaaaaccaattagaagacttcagaggttttaggagactagagataatatttatattatttttattattaaagtaagtatagacaagtgaaagatttgaaatgtgttttaggtttaaaattatcaagatatcttgaagagcttggtattaaatataatggaaatctaggaagttaagtataaccttaaactgttagtttgagtaactgggtacatattaataactgtgcttgtgacggagatgcaaaagtacagatgaggaacaagtgtaagaaagaatcaagagatgtgttcactcatgcttgctaaatttaaggcaatataattctggaatttgagtgagtggtcagggctggacttacaaatttagagtaaatatttaaacctaaagatcccacaatatgagattctgtaggaaaagaaagaaaaaagaaagaaagaaagaaagaaagaaagaaagaaagaaagaaagaaagaaagaaagaaagaaagagaaagaaagaagaaagaaagaaagaaagaaagaaagaaagaaagaaagaaagaaagaaagaaagaaagaaagaaagagaaagaaagaaagaaagaaagaaagaaagaaaaagatcaacaggcaaagagagcccaaagtagaactctgggacctaccatatttatgcgtccaacagaggaggaaaaggcaagcagcatgaaaaaattttagaagtggtatcatagaagagcagagtatggttaatagccaaaactgtcaatcatgttggatgctgctaagaggacaagtaaaatagggggtaaggtgtggctgttgcatttggaaaaacaaaggtcaccggtgagcttgagaagagtaaaatcacggcagtaatggataggtaatgtcaggtagagtgagtacaaaaaaactgggagggaagaaggaggtggagatggttattacaactctcttattaaattttgctgtgaagaaaacagcttagtttataaagctgctatctcaatatcagtattttcaatagaacttattgcaaccacttccactaagacactttcgaacagcctttaaatgcattactttcatgagcttaaatactaaatttttcttaactttgattcattaggtttagattagtttctataacacagagaaaattactaatttcaagctacaaatagataagaaaaatactggttaaagaaaatatttaagtgtgacttagttgtgatataaaagctattttcccctgaatttaatgaaaatagttaaactatcattaggtagttacccaccactattccaatgttgattcattcaataataattttgagcataaaaattgaatttttattgtcaccgtaatgtgaaacttaggaaaaaaatgattgaaatatctgtctattccaaaaatgctaatcactagagaattgaaacctaaaatatccaataaaggcagtctctgtgctcaatagtgccaattttgagcttctgcaaaaactgtaaaatactgtacattttagtatgggaatgctgtactaaatctgctacccgttatttctatttctgattgtcttaattttccaggaattattaacatttggctgcatttttataaactttaaaaaagaggattttggccatgcaggtccttttgactaatgtaagtcatgccaatcagaataaaaattggcttagcttacagagttattttatgaaagaagccttgtagaaccctgtgataagtcaatttttatgacattccttctagaatttaactacagagtgttctttttttattatgggatacaatttatattaatgtctagtatctctgtctctaaatgataaggtatgtattggaattaagcttttcaggacctatcaaaatttaagtgatttatataaatagtatatttcttgatgaagtgatctattaaaatcttaaattaactcactgtcttcaataaatgcctaatagatgttctaaggaaaggaacttttggactgtaacatgaattttaaatttaatttaataaggtaaatgttcaagtgttaagtgttctttaagcagaagcagtttaaaaattgagttctattttagtagtgctttaaatatgtcattaaaataattctttcttaatagggtacccatattttataaaatttttataaaatagggttagactattttcttgaaataaataggcacttattaatgatcataaagcttacaacttatgtcttttgcaggataagaactgtgaaaatctaatgaagtaaattttagctaaagtaagatgtactgcattattactgcaccagtgtcaatccattttacattggaaaaaaagataattattatctgccaattatatttgcatgctctctttaaggtagaacatttaagactgaatcttgctttttagaatacttcataaaaaaacaagagttcaaaatattgtgttgttaattgaaaagatatgtaatgcagattaggatattttaacaaacagttaaaattttgccttcctgcccaatattttaaaattctcagtgcaaagggcctcaaatcaataatttgcatgaattcaatatggcaattaggatgagtcttaaagacattgaatctatgaaaataaaacagccttcaccttaagatttattgaagattttacattgtacaaagcaaacaaatgaactccaataccaagatacacaaaaagatattatggaatattatttaaggtcttataataaacatatttttacatatcaaatctccagtaattgaagaattaatgatcaaatcagcaacacacataatgacataagctacaaaaataccttaaagaatagtaactgtctttaggtggcttaatctaatatagtaatgtaaccagctggcaagtaacctgctatttagctgctctgcccactccaacctccagaattctgatcacagttctcagctggacttacatcatttaaatattcttcctaaactatataagaaaacacttttaacctagaattttacaaatacaacacaaatattaagaaaaattatgatcacaccatagaactagtcatattaagcactaaaattaacaacacgttataaatatggctgggcatgatggctctcagctgtaatcacagcagtttgggaggccgaggcgggggcatcacttgagctcatgagttcaagaccaacctgggcaacatggaagaaccccgtctctactataaatttaaaaaattagcccagcgtggtagtgcgcccctgtagtcccagctactctgggggctgaggcgggggaggatggcttgagcccaggaggtagttgcagtgagctctcatcgtgccactgcaccccagcctgggcggcagagcaaaaccctgtctcacaacaaaaaacccagaacaaaacaacaaaataataatatgcagcattgtcctaagcatcgtatcaaatttctcattactggagaatttatagaacacttacagattttagactgggatgtgagctattatataataaacacacaatgaaatcttaggagcttccatgttaaaaagtgctacttttttcatcacgcattagttcaatttagagcatatggattagggtcagggtggaggggagggctcagctctctgcatttattcaaggacacatgtagtgccactgccatccacccactaaagcctcagagttccccactgtattttgtcagtgcagccagtggaggcaagaaaaaagagaaaacatgaagaatggcattgaagtttttttgttttgtttttatttttttttccatatctgaaagtagaatacgtacttccagccaattatattggttagaactccctcctgtggcttcagacaagtacacagaagcctgggaaatgcagtctacttgtgtaccgaagaggaaaagggtttgataggcccaaggcattatctctaacattcaaggtttccaatttaagtaaaatatttgggttgagttctttatttttcctatgtcaacaccattttcacaccctcacgtgtgaataaatgccttccaccataccttcttaagaactcatacttgtgcacatttctgtatgtctctcctactgctaccttatttcaggttcttactctttctaattgagtttggtgaatcattacataaatgacgatcttcctctgaatgctttccagggatctccatatagattcccaagtgatcttttgaaaagcacacatgatcctgtcactttctgcttaaatccttcagtagttacgttcctctatagcaaaagcccgaatactgagcaggtaatataaatacctaaatccttagcacaatatgacagaaattgaagtttctaatatcaaggctttcattatgattgtagaatctttctggttgtaccacatcttagatgttgaaacttggcagatttttttctgaagccaaagcctatattctttttctactctgacagttgataagttaatgtgagccatccataatctcactgatctcaagcaatcatacccatgtaataaaatattaatattaggtaagaatattgtcacaacagagattttggctatctaaaactgaataatacatgcttgaatattgaatagatcactagttttaggatatactacttttactggattgctacaatgaatatatatatttaaaatatatagagagaaatatgaaaaaatatatttcattgtatgcaatccagtaaaactaatacactaaatatacatatttctgtatatatattcatataaagagatatatgtttatacagatatatatgtatacatatgcatctttttatatataaagatacatacagtatgtgtctgtataaacagattaaatcttatgatcaccttcatcagatcttgccagaaatgagttccccacaccacatgctctgccttgcttcagttcaaaaaccattcctcaaactcttctgctcctattccataggattccattgcctctgttgacaacgaagactgatattctatgcgtactgatctccactgtcagcgatcagggccggtgccgtctctctggtttcctgagggaaggatatactaccatttttatataatgtttttgtcatgaattatgttgtcctaagggtaggagtaatatggttatcatttcacacagtccaactgagatcagtttgacatttttcatttaaaagtaatcaaatttggacattggatagtacagtgtcattaagttacctgttaactcttgcacctccccagatgcactttagagaattttatatggttgcttctttttctcaccctgggtctacttccaattaaaggcaggtggctcatcccttatatccatatctccagcctgcaaataaaaatctatcactgacttccacagaaaagaggaagtttctattgccctgtttcttaagtccccatttaattcctcaggagtgacacaaatgacaatttcttttagggaaaaatccctatccacagggctgcagtttagctctttgacctcagtaagacaatcatacacataactcaaacattcattcattaattcaatatatatattatataccaactgtgaactagacattgatgattattaaaatcgtgaaaacaagctaatctcattgaacttactttctaggaggagtagatgatcataaataaaaatatttcatgcagtagatttcaatgaaagacaaaagatgatgtaagtggcttataatttatggaacagccaaaatagtataatatccaaatgtaggttactaaatcccaaagaaatacaaaacactgtatgtgacaccaaataggattgctgcaagctggcaccaattctttttttcacttatcagaggatcccccaaaagactgaagtctaatctctttccttttcattttataatctctaaatctggcttattcagggatttgtaaaattatggtaacatagcatgaactatatgaagacttagttattttcactggggtttcaggtccaaacctctccattgcttattcatattttcaagagtggttatttaacattcttatttcactttccttcagggcccaatacactaatttatttgtaaaaaagaacatcttttgcaaaatgaaagaacatataacaaacagagttataaacagtcaaaacaatgtgggtttaggtagatcctaagtggcagttttattaagctgacatttttttaaactgttattattaatttggcaagtactaacataatcctttctatatgacagtctcattttatgacaaattacagaataattattattgctttatggaaaaaatatattcttcagtataaatgcagttttaaaaagttggttcatttcttcttgatatttattataggaatttatttcaaattttattacagaatccaatgggaaaaacaatttaatatgcaaccatttaccttaaaagtactttttaaataaaatatgtatggtgaaaatacatgtacaaatgtaaacttaacttccacttttattttacttcactgtatgttctcatactgtaggttttgtatgttcatctgttttctttgagctagcaagcatatcttgataaattgtgaaatgccccttcaattctttacttttttcctaaatcttctaattctttcttcattaacattaccatcagaacatttctttataatgggaatattcatttacttgtgttattattgtgtctaaacattgtattgaaggaaagaagctaacatattatgctgaaacccgtataatatagctttggatattaaatataagcatgtttttttacataagagtgagttttggtacctaaaacaggtatctcctcagccccatgtcttggtttaacacatactcggcagaaactcaagccccatagcgttaaatagagggtaagtgtatgtttgaaaagatctcattggtaggttttcatcagaagaaatacattctggtatcaaagccattgctttgtgagagcaaaaggactagacagaggaaagtaagattaatgggaattcatgatggcgggctcaacttttttatttccttcctttttattataggaaccacatctttttcagggtccttggagaatatttaagattggaactgtttacattattaataaaactttcacacaagttagatttgcaattcataaacctaactaaaagtgtgaattttcttcataacaaagccttttcctccaatactacttgggcgctgatactaaatgacagaaagagacctgatgaggtggctcatgcctatcatcccagcactttgggaagcttaagtgagaagatcacttgagcccattagatcaagaccagcctgggcaatatagtgagattttatctctataaaaaagttttaaaaaaatagctgagcagagtgccactctgttgtcccagctacttgggaggttgagataggatggtcgcttgagcctgggaggaaaaggttgcagtgaacatgccactgcactccagcctgggtgacagagtgcaactctgtctccaataaatagatgacagaagtcaagttccttaaaatatagttgtgtcctatacaacttttttcctttctcaaggcctttcaccttggaagaatatacttctgcaccaagtaagaacagcgacaaaacagttgggcaaaggaggttgatggcatgtaatcatgtattttatatgtgttctgcctcataacagtaacttcctagacagcatttttcaaacataacattctacatgtatttcacagcatttaatggaaggcagaatcattaccagattttttaggtagaaaatggaatttttagtaaggtgggaaaattccctggacctttactgcaaaatattaattcaagtagcttttactgagtatttcatatatggaaaaatataagattgtgtgatattttctcttcactcaaaaagcttacaagtagtagaggaaacaaaatatgaattaagcagtaaaatgaaatggtatcaaattaaatttttaaaaggattatgtattaagatataaaacaattcacgaatggtacaagataaaaacaatatgtcaaaacatgtagtacaagaaataatagctagaggaggataggaaaggagaaacaaacacatccaaaggtttaaggaagaaagccatattagttttcagttgtacttccaacgatacctatgtaatcatttccttgatcttagactgaatctttctgtgctcgattctggcccacagagtcaaatgaggtattattagagttctagtcaaaattcattaaattgcaaagaacgggaacccatttaaattaggttagtttcagagggttactttgaataattctgggaaatgtcacagacttccatggtcaggaatgtggctgggcttcatggggtaagccatgaagacctatggtgctgtggcctctccctttgttgtttcttctctgagtccatatgtttctcatgtctgcttcattctactctttgttaattaatcattctcttcagttcatgcacacgctaccaaaacaccaagggttccgtctaggtcttcctgcttgctgcgcagaaaggcaatcactgagacagcaactattgccagggaagaggctttcatcaggcgccgcaacccaggagactggagctcagcctcaaatccatctccctgactgactaaaactagtggtttatatagagggaaagaaaacaggaactaagggggggtccagaagcaatcgtgatgaatgagggttctggcatctcattggaggcagtgatttggtgggtttctgttctttgacactttttgagaggcctcagaataagttcttgaggaaggaactcaaacaaatagaaattttaagctttaagactagaatagtccatttctatgtttattaaaaaaaaaaacaaccagtctgtgggactattgggttgctttcatatgatcctctttgccaataacttactttgcacatagcttttatttgccttagaaatttcattctaagaaacaccacattcccttgcacttgtatattagaaatggaaacaacaaggcatggatgttggaatatagcaagtttgaggacaatataaaaactcacctcaatggagtagtgtgagcattgataatcatgattatcttaatcaaaatatgtattaaattaagatgcaaacatgaaaaactgtttgcaaaaattagacaagcagcagatatatttaatagtgaattttcaggatatatttttcatgtaacattagcttaccagaaatattaatagttattatatgaaaaatggatgagtgttacaatatatttgggtgtcttttactaagtaatgttcaaggttatttaatgtgcatcgtctctaagcctttcgtacaccaatatgcggtattattcttcatggcagatagtagaatgcaacatttttaaaatcatttgactatagttcccaactatccatgtcagctacatttccgatagtattcagttaatagttttaataaatactgaatatatacacagatatgtaaatatatgagtgaaagatgtataccaataaaaagtagaagaacccaatgttaattccattactaataaaagggaaatagatttgaacaaggtgctagtttaattaaattagcatactttttgttacaaagatcagaatattcagagataggccctctcacctctcctggattggaaagcagtctggtaatttatacaggtggcgctgagaaaatgtaaaccattagattccataaccccactctaggtgtccagcctgagggaaaaacaaaatgaaaagaaagtttatgagcaaagattttcattttggtgttgtttataatgacaaaaatctgaagcaagtgttctcaggtagggaaattgttaaattatggcatatctacaaatatagccttgagtaaccatgaatatcatggtttttggagactgatgatctggacaaagtcttttggtataaatttaattcaaaaagaccataaaattgtatatgtattaatatcataattttttatacattaatgatagaaaaaagagtcaaatacaatatatcaaattttaatcttttatttttgttatgcaggcttattagtgtatatgtctgtctaattctttgtaagttttgatctcttggcatttttcaaatcttctgctttgttcatatttatcaaagaaaatatgtaatgaggtatgttgcagttgttagctctgaaaaggtttatatctccttgtttttagcttacaattaaggggtattctaagaactgttaccacatttaaaattccatatctaaagcagtatgaagaaaaggtattcatttacattatgttttagcaactcgtaaacaatcttttaaatgtaaatatctgaatgcatatttcaaagttaaaaattaaagcatttttcaagtgcagatttacaatagtgtagttggtataagcatctgtgaaagaaaatttatcatgtcagaaaataattgaaattgtgactgaaaggttcctaagaacaactttttatctgtggcttaaataaatgctttcgatttcaaaggcaactctaactgcaccatatagctcaagtgatcagtaaaagtagacaactgacttcttcaaggagttttaatttttatgtgatttgatcaactcacagactataaattccactgtcagagctaaacatatgcacaggcttatctgaattcttgtattccaggtattgagtaaaatatgttcatgtcactagcttctttcaagtagtgtttatcatcatctccctgattgcctaatataagtttacaaccagtctcctaggtgtactagtacattacagctctcccacagatatcataaacagcaacatctttggtaatgaatgtcaaaatcctgccagccttagagtatattatccatctccctgtctcattgctgacataccaagtgagaagctcattccaagctccttagtcaaacaaaccttaagatacaaagttgacgctagttgcatgaggaaggcgttttataaatccaatcaattataaagacactgaataaatctcatcttaatagcatcactgtctcagtctttttaatttttttcttaatgtgtctcctattgtggaaatttttgaaagggtgggattttaaggctagaaggaaccttaaagatgctggtctgaacatttaatttttcatgttaagaagcttaaagaagaatgaggttaatacatttctttaaaattacactggaagctggtgacctatttagaactacaactaaagtgttttgactccctgtctgatgctagtttcattagaccaggctaactcaccaaataacttgaaattttccaaactagtctgtttagagtaaccacattttgcgtatgtaaaaatggattatctattcctcgtcctccacttccgttccctctcctcttttccccacctgatcttccttctctcctccccttttcctcctttttctttcttcccttctctttccttccttttatctatccctttctacctccctccttcctgtcctactcttttctttctgtctcctttctttccctctctcttgcttcactccttcattccttcttccctacctctcttcctcctttttcccatttcttttttctttctttctttctttctttttttttttaattacactttaagttctgggatacatgtgcagaatttgcaggtttgttacataggtatacatgtgccatggtggtttgctacacccatcaacccgtcatctacattaggtatttctcctaatgctatccctccccttgcaactcaccacccagcaggccccggtgtgtgatgttcccctccctgtgcccatatgttctcattgttcaactcccacttatgagtgagaacatacagtgtttggttttctgttcctgtgttagtttgctcagaatgatggtttccagcttcatccatgtccctgcaaaggacatgaactcatatatatataccttgtatatatatatacaccatatatatataccttgtatatatatatatacaccatatatatataccttgtatatatatatacaccatatatatataccttgtatatatatatacaccatatatatataccttgtatatatatatacaccatatatatataccttgtatatatatatataccatatatatatactttatatattttatatatattattctatagtagaatgatttataatcctttgggtatatagtagaatgatttataatcctttgggtatatagtagaatgatttataatcctttgggtatatagtagaatgatttataatactttgggtatatagtagaatgatttataatcctttgggtatatactcagtaatgggatctctggtcaaatggtatatctagttctagatccttgaggaatcgccacactgtcttccacaatggttgagctaatttacactcccactaacagtgtaaaagtgttcctatttctccacatcttctccagcatctgttgtttcctgactttttaatgatcgccactctaactggttgagatgatatctgatggtggttttgattcgcatttctctgatgaccagtgatgatgagcattttttcatatgtttgttgccgcataaatgtcttcttttgaaaagtgtctgttcatatcctttgtgcactttttgatggggttgtttatttttttcttgtaaatttgtttaagttctttgtagattctggatattagccatttatcagatgggtagattgcaaaaattttctcccattctgtaggttgcctgttcactctgatgatagttttttctttctgtctctctttctttccatccttccctttccaaccttccccttcttttgcctccttatagcctcctttgccccagtatcttggtaatattggtactcacctctctatatgcacttacttcacagaacacattttgatcatgtcttctatatcattttccctggcttaaacattttgagaaggatgtacattggggctagtaattctttgccaccccccagttttcttaattcattggcttaaatccaatcaaagaaccaaaaatttagaattaattaataagtctatgtaattgatggtaagattcttttctgaattttctatattattatagaaacaaacattttctttaagaatgcacttttaaggaccttatatcactagttttagattaactgactttggttttcatattcattatgtgactgtttatagatgttggggcctttccacatttgatttgcaaaataacaatatatcgatatagattaaaataaaccaaaaaatctccagcgttgctcatatctgttcatcaatatgaaaagctctatcatgaataatgtggcaacgtatatgaagaaaacatttttagacaaagctattcagtgcttttctcttcttctttcaacacataaataaaagcaattgctatgtagcttcctagctgcatgagatgtgccttaaggtgttagatgactataaatatgaatacgataatagtggtcctatagaaaagtataatcaggagttgtgaattaaataaagaaaaaataatgtgataaaatattagcgtttggtgataggggatacaagttattttcttaccgttgatatttaataatgttatttaaaaatacatttaaagttgatctaagctatttttacaaaattggatccattcgcaaatgtctggggtaatttattaattgatttgaccagcttatttttggaatggccaaccagtggtccaattcaaaactatttcattgattaggaaaaagaggaggaaggttttgtggaagaaaacttgagtagaaaataattaatggctacatatgccctctatacaaaattataatgataaatacttctgggactagggaaaatatcatctaatgacaacatgtatattacactgtagagaacttttacttttgttgtatgaccattgtccttacaaaacctcagaatggtaatcatgttaataaaataatgagaacactaatgtccaagaagaccagcagtgttacctcattgggtgaagtatggtaggtggactagcagggaatactagctggttctaaaatgtaaatgtagagaattacataaacactcatagaactcatagattcccatattggatataacaggtgaagattcaagtaaataaggacatatacatgtggtttattataatgatgttaattttaaaataatgtttatgaaggttatggcatagtatagagaaatactgagtttacagtattaaataaatagaaaaaatgtaaaaaatcttttagtaaccacaagcgtattttaaaatgtttctgaaatgcgtgtaaggtggtacatgaaaatgtagaaattgaatcccttgggtgttactatggtgtttggcaaggtactacaagatgaatggttttgtatctatgcaatactttccagtattttaaaaatattatatgaaaatgtatttattacggggaaataagaacttaaaaacataaacttggatgaaataaaaacatataatttgagaaaaaatcaacttattgcatgaaaagttaatacattgataatttgcatgttcctttctttgtgttgtgcctgttaaattctttttactcaacttcatttgattttctattttctttcttattttagatactagttacattgttaacaccctgctctagaaatagcttttttttgctgtgttaattgtgtcttttaatgaacagaagttcttaattttaatgaaacctactttattgatgttttctgttatgaaaagtgtttttggagaatgttcatgaccatcccagcctcatgagtattttctcctacgctattttctaacttttttgtttgtttgtttttactttgcgcatgtatgtctactagtccatatggaattcatttttgtgtcatgtaaattagaaatcaagtttcattttaatttttccacagggatattcagttgctccaggaccatttaccaaagacattattttttttacttcattccagtggcatgcttatgttagattaaatgactaaatatttgtaggtctacttctgaagtcttttctcttccattgatttatttctctgttcttgcaccagaaagggtctgttttaactacttttgttttataataaatttccacttttaaaattttaattgacacataacaattgtatataatctggaataaagcataatgtatcaatagctttataccatgtgtaatgatcaaatcagggtaattagcatatccatcacctcatacatttatcatttcttagtgttgggaacatttaatatcctctctcccacctatttgaaaatatactaagttgttaaatgtagtcactctacagtgctatggaacactagactctattcctcctatctagctgtaattttatatcaattaaccaacctcaccatatttattcccctgaatccccacctatctttcccagtctctagaaactaccattccactctctgcttttatgagatcaacattttcagcttctacatatgagtgataacatgtagtatttatctttcggtgcctggctcatttcccttgacataatgtcatctcttatcgttcatctttgcaatttggtggttttcggtagttataagttttgattactttgtttttctcgtttgtgtatttgctctaccaatgagttttatatacttttgcattttttcacgatgttaattattgtcttttcccttccagatgtaagactcacttgcgcgtttcttgtacggcaaacctacttgtaattaataatcgcaatttttgcttgtctgggaaagactttgtctttcactcctgaagtgtattcccgttaggtacagtattcttgactggcagttattttttgctttcagtactttaaatatataattccatgttttcctggcatgtaagttttctgctaaggaatctgctgttagtctattaatgattcccttatatgtgacttgatgtttttctcttgctgtttttagaattctctttttgtcttggaagtttgactatattatgccccagataagacctttttggattgaatctattagcatatctttgagcttcctaaatctagatgcccatatctctcccaacatttggaaagttttcagtattaattacattaaataagtgttgcatgccttttctcacctcttcatcttctgcaactcctgtaatacaaatatttgcttgttttatgctgtctcacaactcctatagacttccttcattttttaaaaattcattttctctatttgtctgtgtcatatcaaaatacctgtcttcacattcagaaattctttattctgcttgatctagtcttttaagttctcaattgtgtgttttattttattcatgaaattcttcaactcacaatttgtttctctctcttaaatttctcattcagatcatgaattgtttatctgattttgttgaattgtctctgtattctcttgtgtctcaatgagtttccttaaaatatttattttgatgttttttttctggtgacttaagcatgtaggggaagtgtgactgctctgggtatccaaggtactagtttctcagaaagtagggtactgcttcagctcaggcgtaggggatatgactactctcagtgacaatggcaccattttcctaggatgcagggtgccacttcagtttcagcataaagtctagggtacaagatttactgggaaggatagaaggagagtctctgccaaggcactgattttacaggagagagtgcgcagctatagctgtgaatatagctatattagatgaaggtttattttctatttttttaatgcaaggaagactaaaattttttatctaaatattatcttttcaatatatttgaactctttctatatatttaaaattgacaaacgtttaagtgttattttttaactattgcagtttacactttgcaacataaaaatgcatctcatgtgtagtttaggcacaagattctccagtttcagaatacatatcaaaatacatgctaatgttatgttattgggctatattgctttgttttgcttgttgttttttttttaaatactacattgccaaacttaaatttcaaaatgccaaatagaagtacccttgatatagtgaatgtatattaagtaactgaagttccttggtcatattgactaatataaaatgttaattataccaaacctggtttgagagggaggtgtgatttgtaacctcagttttccatgatgttgggttcacttgtagacttgcttagtatttccatcaccacccatcctggttgtgataattaacagaaaacaagcatttgaaaggcactagctaaagccaggagcaaactgtttctgaagcctcatcccagacccatagagactctggaaatacattggcatttaatagaaaggtgttttcttaacatttttgtagctacaaaagcccacttggggaattgtctcataaaaatgtgacattgctcaaaggagtatttaaatatgccctcttgcgagaatagacctggaggaattttctgtgtgacaattttttaagagacattatttgggtgttattattgatggtttttatcttctgttttgattttattttttctcagctcttactgtcttataaccctagtggcttttgattgtttgtttgttttcccaacacatgtgtcaaatattccatgaagcagctggctcttccctcgttttgggcctactaatctagggccaatttttttgttgtattagtagtgaaacataatttatttttatttcttctttttttggtcattttattatttggaaagaagcctacactaaatatgtgagctgaaataacttgcttgacactgaaatttagtttccacattatttagataatttcttcatttgttttaggatcatctattccttttttatgtgaatgaagggggtaaagttaaaaaactctcattgagagttaagagattttattttattttattttttattttttttattatactttaagttttagggtacctgtgcacaacgtgcaggtttgttacatatgtatacatgtgccaggttggtgtgctgcacccattaactcgtcatttagcattaggtatatctcctaatgctatacctcccccctcaccccaccccacaacaggccccggtgtgtgatgttccccttcctgtgtccatgtgttctcattgttcaattcccacctatgagtgagaacatgtggtggttggttttttgtcctcgtgatagtttgctgagaatgatggtttccagcttcatccatgtccctacaaaggacatgaactcatcattttttattgctgcatagtattccatggtgtatatgtgccacattttcttaatccagtctatcattgttggacatctgggttggttccaattctttgctattgtgaatagtgctgcaataaacatacgtgtgcatgtgtctttatagcagcatgttttataatcctttgggtatatacccagtaatgggatggctgggtcaaatggtatttctagttctagatccctgaggaatcaccacactgacttccacaatggttgaactagtttatagtcccaccaacagtgtaaaagtgttcttatttctccacatcctctccagcacctgttgtttcctgactttttaatgatcgccattctaactggtgtgagacggtatctcattgtagttttgacttgcttttctctgatggccagtgatcatgagcattttttcatgtgtgttttggctgcataaatgtcttcttttgagaagtgtctgttcatatcctttgcccactttttgatggggttgtttgtttttttcttgtaaatttgtttgagttcattgtagattctggatattagccgtttgtcagatgagtaggttgcaaaaattttctcccattttgtaggttgcctgttcactctgatggtagtttcttttgctgtgcagaagctctttagtttaattagatcccatttgtcaattttggcttttgttgccattgctttcggtgttttagacatgaagtccttacccatgcctatatcctgaatggtgttgcctaggttttcttctagagaaacccacagccaatatcatactgaatggacacaaactggaagcattcccttggaaaactggcacaagacagggatgctctctctcaccactcctattcaacatagtgttggaagttctggccagggcaacttcaggcaggagaaggaaataaagggtattcaatttggaaaagaggaagtcaaattgtccgcatttgcagatgacatgattgtatatctagaaaaccccatcgtctcaacccaagatctcctcaagctgataggcaacttcagcaaagtctcaggataaaaaaatcaatgtgcaaaaatcacaaacattcttatacaccaataacagacacacagagagccaaatcatgagtgaactcccattcacaattgcttcaaagagaataaattacctaggaatccaacttacaagggatgggaaggacctcttcaaggagaactacagactactgctcaatgaaataaaaaaggatacaaacaaatggaagaccattccatgctcatgggtaggaagaatcaatattgtgaaaatgggcatactgtccaaggtaatttatagattcaatgccatccccatcaaattaccaatgactttcttcacagaattggaaaaaactactttaaagttcatatggaaacaaaaaagagcccacattgccaagtcaatcctaagccaaaagaacaaagctggaggcatcacgctacctgacttcaaactatgctacaaggctacagtaaccaaaacagcatggtactgctaccaaaacagagatatagaccaatggaacagaacagagccctcagaaataatgccgcatatctacaactatctgatctttcacaaacctgacaaaaacaagaaatggggaaaggattccctatttaataaatggtgctgggaaaactggctagccatatgtagaaagctgaaactggatcccttccttacaccttatacaaaaattaattctagatggattaaagacttaaattttagacctaaaaccataaaaacccaagaaattttattatttcaaaagatatctttgcattatgattctaggtgcattcacatttgggggaaaatagattggtgtcagtgtttttaaatgacaaaatgaaagaggaattagattaaaagggaaatattaatgttagtgaaaatgaattttagttctttttaaaaaagagaattgaaaaatatggcctaaaataataataaacataacattgaatcagtgaaggaatatattttttcgaagtactttagagaaaaaattaactgcaaagaaagactttatctgtgaataacatttctccaaattttctgctattcacaaagtcctaaagttgattcagatgacgtatttttacctgtttattttcagctgacttagtcactggaggcagatgtggacggaaggaagtctccttcagtgactcattggaaaagctcaaaatgagttgccaggagtaaaacagcagaattttaaaggaattatcttcttatacattgtgtacctgtcaacttcagactggatacattaattatgctccaataggatagccccagacagccaggttttcaagatctattcttctttgaaagccatatagcaatttagcatttaaacctgcctccaagcaagagggcataaaaccaactgtgaaaaatctttgtattctattcatagttccttgttggtaatgggaaattatttttagttaaaacatcaaaaattaaaaagaaaacttattatgcctattattcttttttttttttttttttttttttctttttgagacggaatctcgctgtctcccaggctggagtgcagtggcgcgatctcggctcactgcaagctccgcctcccgggttcacaccattctcctgccacagcctcccgaggagctgggactacaggtgcccgccaccacgcctggctaattttttttttttttttgtatttttagtagagacggggtttcaccgtgttagccaggatggtctcgatctcctgacctcgtgatccgcccgcctcagcctcccaaagtgctgggattacaggcgtgagccactgcgcccggccatggctattattcttttaaaattgaatacaaaagttgagatccacctgtaaacttctatgttcaggcaaaggacacaaaaactgaagataaaaagcgtggttggtttaagtgggaaaaatcatcatttttaattgaagaaaataaaatatttaaagtaaatataccaagcaagaattatagaattaatgttatcaaaatgacatgaatggtctcatatactaggcaatacctgtatattaaaaatataaattatataaatatatatgtcaaccaacaaattatgtttttaaatatataaaatatatttaagttatcctaaacaaataacaataatgtttattttaataattgatagcaataaaatatccaagcctttctttctggtgtttgtcaaatttcacacacaagagctttaaaaattaatgataattacaatatttagaaatagtatgagtaaaatgtgttgtgtactaagccaaatatatacaaatttttacgtgaaaaagtgaagacataaaaagtttaaaactatccccactttgcttatatattttcttcttcatatggtgtaatctcaataccttaacctttccattacttttcccagaactcctatttcttggttttatttcttggtctactttgttaatatcaagtctgctctacaaattggaaacccatttcccaagatgtgcatatttcacattatatgcctgtatcaaaacatctcatgtgccgcataaatacatatatctaacatgtacccacaaaattaaaaataaaaacaataaaaagactataaatactgaaggtgacaggtggtacaatatacatgaagtttagagataagcatttagaatagatgataaaatatctccaatgggcagcctttctaatacccactattttttctggctatatttaaaatatgagtgctctcatttttgaaataggtaaaaacaagatagagaatgaataaatcaatcagctaactatagggacctctttaagttgtgagctttactgaataaggtccattctgcaaagataagagtattatacttgtttctgactcaacatgtcagatcaaagaaaaaataggaaagggaaccatacctactaaactgccactaatttctgtgtggcttaattacttatttagtcatgctaacagagatagaaaaccttttttatttttctgacgctgcaggttatgaaagatctttatttcctctttttaaaaattatctttggctgaagttaataattcacattcaagcaaaacaaattggggcctacctctttgcaagctgttctctctatgggtttgaaggcagagttaacctttgttcagagacttgagccaaagccaagtcaatttaacatgtatctatatatttcactatgtctcatgccacatcctggcattgaaatgaattaatatttgtatggatggccatcatgcactggtatatataatgtttgaatgctcaacaaatgagaataatgcctccttcaagaaaaataacaacaaactagtacttattgcccatttacagcagaggagaaaattaaatctgctaaggagaaagtatccttccattttacatcctcaaacagtttgcctttttctcatttgactttctgatttcaagtaatttttataaacctctcttttaaataagagttttagacaagaaggtaggggtaaaagggggaaagtttcttttaccaaacacacacatacacacacacacacacacacacacacacacacacacaattcttttttgtatactttggaggcttgatatagctatttatctgtaacatataatattactgataactataattcaagtatactgaatgtttccccctgtttcttaagccagagatatctattcttcaaagaaataaaatagtttttattttcagggttttgattttaagtgttttaaatctataggttgtgaaatttttatttctacatgtaatttgattccatttatattacttagatgtatatttatgtattatttgattccaataatagaactattattttaaaaatgaacatataagaatcttagctaatgttttaatgcattctcagcaagaaggaagcattattatccaggtcaacaacctacattattcattaaattactccatgggattgagctctttagccccaaagaattatgttttctctattcagtatatatgtctctgataatacctttgtcattttgaagagtagttagtaatatctattaaatttatggcctgtatgaagtgagggtgagactataaattaattttatcaaattacagaaataactgggtatcaaaatggatctcttttgtcttgattttcaatcaggatccagaggccaaaagtaaagaaatatgtgtcaagtaacatattccaacggcaggtattatctatataagacctgaaaaaggggtattaaaaaacttgtttggaatctatattttgactcatgtttaggtatacatgtttgtcaaaactcagtaaaggtacactgaagatttatgcaattcttttttatgtaaaaactacttgattgatggcgcttggaaagatatatcagtatgtgtatacatcattatcagcagcaacaacagcagcatatacaacataattattatcctgataatatttggatcagtgaggcagaaaacaaacatatgcccatctgtttttattgtttttatcttgccttggtttgtttgtttatttttaagctcatcttttagaaaaagccaaaggattaatatccctaccgatgtttgagttggacttccattacatctactcttggaacataatcaaatagagctttaactagcatgttgagcacagaagatgcagaaaacaatgctgacaatgctgttgatattttgtgataattgtgagtattagttatattcatagttatgttccaaggaccagaattatttgtattctgaaacagagataatttctttacattatgaaaccaaaagattgcagaattgaagcacacagtgcaggccaatgtgtgatagtttaagatttttttgtgtccctccctcacctaaactatgacaattgccatagacactggtaatctaaaaccaggcagccaaaaagaaaaaaaaaaagagagcgaaaataattaaataaaaattgagatatcaaaagtctccttaaatttgtaaaagtcagaattggtcagattaaccagatattttcaaaggaaaaaaaaaatcttgaataacagtgaagtttgagatggttagcaactaagaaatttctccaaagtcatttactttgcaaaaacagagaattcccataatttacttgcacataggaatataatttcatctgaaggagctattaagagtcagataaatgcttagtgtaaagacaagaagaaagcaacctgtttttattttgatttagatttggtgtggcagagcatgaaaattgcttcactggggtgaaacataagggatcttgagatgaagtctagatgttaagctcatttggtattgagaaacagtaggaggtaggaggtgtaagaagaaatactgcctgtgcaagaataatgtgagaagaacaaacaaacagaaaaaggaattatgaaactctccatggaaatagaaaactaatcaaaatttagaccagttggtgagagagagaaaagaagtcaagcaagtctcttgagactttccctgaagggcaaactggaaataacttttagctgtttaaagagtttataattttccagttagtactacaagatactaatatgcattaatttaacatactaaaatagtcagcacttctctgagatgttactgtgctaataatgtaaaatgagaaatctccaaaaagcaaaatactgtaaattgtttcccaaacttgtttaatgaaaatccatttttaactttgagaatttggtgtaatatttcacaaaaccatcgtggaaatactaatttaaagtaagtgtgaagagtgaagggagagaataatgactatcaaaaatttccatttcaacaaagccatattgaaatgggggcagcttttccagtgctgtaaatactgagagaagttaagttacagtcctcgcccttaagagcacatatgtggtctcagagagaggtcacaaaataaggattaacagaaaaaagaaaaagaagaacaacagataagatatttgtggtatctgcaggaatcatattttctcacttagtaaaatttaagaagagtcaattttatatttgaagagcaagaaaattaaaataaaactaagttactttgtaaggggaagataaatggaaaaaaatagcttaaagactaaaccagtgctaaggctcaaatttgccagtgacatcaaaatgttaattatttcagaagaagtcatgaatattaaaagaattttgggttagttcaacactttgaattaattttctttcatttccatgctctgcattgatttctccactcagtgatctctccatcctggactcacgtactcagtagatttcttggctctttcactgtgtctacttggagtctaagtccaagaaatgcttttctactttttaaataatttaacctgtttgaagtattaaacattgttgattactcccttcattgatatgtccttagtttccaagattatccttctgttcttgctaatttgaaacttctatgtcttcttcaaagggttctctcttacttctaaagattctcacttgtactttcttttcttctcactttattcactctccatggctgaactaattatattctgaaggctttatttatgactgttttgattagaccaaatagatacttccagtctattttattcttctgatttctagaataggtatctacatacctcctaatcatttccacccatgagcaacataaggccaaaatttgcataattgatgttaccatttttatttctgctatttgtttctgcatttcttgttcaatatcaataaatacaaccttcagaaaacttttcttccaacacagaaacctgttagataatactgacttcaacctctagcccatcatatccaatatgatctctagcccattatcaaacctgctagttttaacttgttcccaaaactaatttctgttccattgcctatgccattattgtattactttagtcctcataatttctcacctagatgattgtaccaaccaactaaactcttattttggtattgctattgtaatgtcagaaactttagaatttgagttggatacctggaagtagcccttttgacatgtagacattatgatacaaatctatacaaaatgtaagctttcaataaatttatatggtaatgtccccagttttatcctcaagccatactcaacccctgagtgtgggaccatatagggccgtagaaggtggatatgcagaatatatcgaagccgagggaacagagaggaactgtctgacagctaaatcacatgatcaaaccagatgactcaatctttctgagcaaaagtgctctttatcagttgacaactttgtagagccttgaatggtttgtctttcaaaatctctagtttcttcaactttatacaaacatggaaaaatttatgtgggtcacagcctaagtcctgcttttctctccagaatccacaggaattcctcagttaactttttaacagtttgcccaatgtatctcataatctacatacttcatatttaatgacatcacacatttatgatggtgtcatttgacaacatgactgattccttctcagaggcaaatatggtcctaaccaaaatagtaaaaatatttttgtagctcttattctgattacaaaagatgtataattcatatacttatgcatacatattcaaacaatatacaagagaaggcaaaataaaatttgcccacaatcatggttcaataaggggcagagtaagaggaagagttaagacacagtatgctcacatttgataacaaaggtggaagttgtacatttcaaatagtttacagattcatcaaaatagccatatcaccaatggcctggaaagttacatttgaatcaaagtatcctgctgtgtactcttctatctataaaccaccctctgtcttttcattcagtgaaatttttaaaaataatggttcttttcagtataacagtgaagcatactgattctcaataacatcaaaaatgtagaaaacctaatggtgaaaattaaaagcaacaataagccaaccacatcatacttttaattttgatttatgtatttctattgtattttcctacctgtatagatttaacccaacaagctagagattaaaaaaaacataataatccaatataattaaatgttcaggaattattttaaaaacttaatgaaacaaaaattcatccccaaaactatttacttgaaaaaaactaacaaataaacaataaattatttttcaaatataaacaagacagaaataaaggagatgctattactatgaggaaagagaaaaactatacaactaaagataaacaaaatatatgaaacattatataaaatattaaaattttattaatatgtatttgaaaatttgatagaaaatattatatagaaagatatatttgataacattctataaaattaatgcatatgtgtatagaacttacaaggcaaagaaatttgtatgtatgagatctgttaaatctacaattaatggataattttgggtattttttttaccacttcataacctcatgtaagttttgagtttgttttttttttatttttctctatgttctggcactgtttaaaatccagaagtgggaaatagggagttactgctaactggtaaaaggtttctttttcaagattataaaaatcttataaaattagattatggtggtatttgcacaactgtattaatatattaaaaatcatgaaattgtgcactaaacatgtgaaaatcatggaatgtaaattgtatcccagtaaaactgtaagaagatacatacacattatctgtttctaccaaattctcactatgaacatatgtgtaaatactagataatactaccaaatcaacagcagcaatttattgatagaataagacatcctgattaaatagggtttatctcaggaaagcaagcaatgatggactttagaaatcctcgttgaaatatacttaaaataatatttaaatgttagtctgaaagatacctaaaattacttagcaaaagtcaaatgtccattcattatttggtaaggaaacatttagctcaatttagaataaaaggaaatgacttaatcttataaacatatgcaacaaaaacctacttaattaaaaacagaacaaattttaataaagtcagaaatgaagaaatgatttaccttacaattgaaaatgtcctctgtttatacaaatacaattatataaatatataatataagataaagtaaatgcatgtaatttattttcaattttaatttaaaattagacatataagaatatgggcttttaggatgaaaacacatattgaataaaacataaacaatatatgaatatataaatttatacattaatacagtagatatatttaataaatatgtttaaaatatatattacatatatattccctaactagcaaaatacatctgctacaggggttgcattcttgatttagtgaaatctattagagtaatatattagagtgcagccaagaagaaggagagtattaactctgtaacattataagtaggaaatgtatttcatatacaagtgtatactataggggagaacatgaagaataatataagtaatcttcctgggctgtggctgaatcactttcagtaactttatttgattttattcatgagtagatatttttatactcccctttatttcctgtaaattgagtatttggaatttatgtggggcaataaataatatgattgggtttctgttttgtttttgttttgtaatggtggtaaaatatctcctgcttttgctttttacaagtattccaggaagattgtaatgaatctacattcatgccatcaccctgtaaaacaatgtatacatctgccaacttatttaacaaaatttgtgtgatctagttttaactttattttaattgcaggagactaaacatttagaaatagtttattaatagttcaggtatctgaatagtctggactttcaaaaacatttttctactagagtactagtcttttctatatatattatttttatgtttgttgacattttctcttttttaaagtgttattttggaaaaagtcttcgatgagatatttattaatatccatgatgtgacaggctgtatgtagagacccaaggtacgcagttgcaatcttcagtgaacttacagaatgtcagttaatgcagacatgaaaacacccagtctcaatataaatgtgataggtgctctttcttaacaagcaaaagatgccagagagcaaagacaagtgttcaacccctttttttaatgtagtaattttttcctttttttctaaaattacctttttagaaagccattgcccatccagagagcaattaaatttgtactaaccttttgttgtagatcatcatatgttcttaaaacggtgttaatcatctttcattgtatttcactgtggtctgaaatgtcacctgtacaatttctgctcttttgaatgtgctgagatagtctatgtattatagtctggtatgtaagtgttctttaaaaagtattcccctataaacaggagaggaaaagagtttctcattgccagctctaaaacaagagagaaggaaaggagagacacagggaatgttttaatctttgcaatagtcatcagagatcagataacaggattgactatgcttgatattcattttttttggtcttagcacgattttaggatctctgagagaaaaaaaaaagggacgggggagatcttgtggagggatatagcgctattctagccccttttgatggaccgagtctgtcttttttgtcatgtaagtctaaatagatgaccaattgtttctctcaatccagcttgatcagtgatagcatcaacatttttgcacatttttaaaaatttgtgtttctgtcttaccatgttgatgtggttaaagttggattttttaaaaagctacgtagattctttagtaggagtttgggaggagcactggtaagcctttttataagatcaaactttgtataacaagcccaaaagcacattataaaaagtaaattagataatactttacccctaattggaatctcattgtcttaaaataaaacataaacaccttgtgtagcatagaaattcattttaaagcccctggcatattttcaaacacattttaaaactttttcatgaattgcagtctatcctcaaacccagataattattttaagttgctaaaaactctatgttttcctcatccttcagtcaaatttaacatttattgaacatctactctgtatcagagacaagtaccatataaggggctagtcatatacaggtggataagtcagagttctgaatgcctacttccactaatgattgtaaattggctcaggaatcaactcccctggcaagcctgcacagagtcaccctcaatcagcacttaggcttacctggattatggcagtcatcacatgatactgcaactgcttgtttgctctcagagagctgggactctgcatctccagagtctggaacagtacctggaatatcagaaaatgttccttgacatttaatcaagactgtatttgagaaattaaattacattctatatccagataaaaaggaaatgataaatataaagactttggagttcatgagagcaacaagatgggatccgaggtactaaaagaagatttatttacatcatcaataaaacaggtaactggaaaatcaaaagaagattaacactggcaatggaaatattagataaaagataactgctatttagacatctgtggcataattgatagtaaatcaagcatacaggacttcaggaaagctgataaggataattctttcaattaaaggaagctatacttccatatagacttggactataaatgcaatacataaattgcaatgattatctcaatgttcttcattctttaaagttaatttatgcattttctaataaaagaaactaacatatgcaagtgacatatctcagagatagttattttgtaatttttttgcaaaaagttacacaaaagtgcacataattgcataaaatattaaccaatgccatccaagtattatatgcatttgtgcagttattatagtcaaaatgatataagggtttatgtatgaattcagtaaggtagttttctcagttagggttatgtttgtcatatttgcacctttttaaaaacatggtttcttgaaaatctccaatgtctctgaaatcagaatatcgctggggtaagcagggaaggtatatataatttttagtgttacaggtgattcttctgtacacttcctaagatcatagatttaagacttaggaaacaaagcaaactgttgctaactcttggaacatagcctagaacaacattactatttagcacatatagtaatagaaaaaaagataaaacaaatacctgaataaatattgatatcttctcaccacatgcaggcaatgacatactaaaccccccgaagtgtcttagagctccttgtgatcctggtgctgtgaagtcagcatggcggagttgccttctgacacatcagatttctagaaagtgtttttcaggcatgagcaacagggagcaagcatcaaaaaacactcttgtagtaacagtattccggtccattggagattctgtctaaaagactaggacctcctctttcaaatcctgctcagccagcaagagaccaatgcccacccttggtgcttggcttatttcccctctgaactacaggagcatacatcacccagcaacggacgaaaatgaaagggacaacttcaacatgatgtctttaaggaggtggagattccttagattgaatggaaaagcataaaatgcaatgacgaaagagatgagctaaaaatacatgtataagcaatgatatgtcagcatctggacagctaccctgacttccttcagatgctctttgtagtgtgtatatgtgtgtgtgtgtgtgtgtgtgtgtgtgtgtgtgtgtgttggggtgtgggggcgcgggtgtactattttctgcatactatgatgttttcacgtcttaaaaatcctttctaaggagagactgcccctcctgccgctactcaattcttagaggtagaagagcctagccaggagcacacctttcatttgcaaatgaaccaatctagagccagccctcccctatctggctcttacactccaacaggcaatattcttttgcttgaatcatcccagggccagataccaggtgactaaggaccaccttgttgcttagagcctactaacattattcaaactagctagtccgaaactggccaccctgacttaccttgccaggggaaactcaaataaaggcttggcctaaactttccccttgcttttctgtcttctgatgaccgtggtgttttttccacatggtcccatttggtatctcatgtctgctgcctacagggcctgtgagcacaataacgtttgtttctggagcctctccaccgcctcctcatatgaccacagctgaccatcacacaaaggaacatgaaaaactccctgtcccctctcttcaggcacccaagagttcagcattaatttcaaaaatgcaagcagaagaggctctggattcatttgtttttctactccctttttccacagggtatcgctttttagcagggattcctggcctttttgtttgttatccagaatatgactttattggcatgaatgaaagacaattattaagtaaagcaattatcttaaatattattagcaaaatataaacaaattgtgatagaacctatatttattttttcaacatatgaaacaataaaatctattagtaaatgtaaggactactttgattacaaaatagtgatttgtgatatattgtgaaaaatgcaaataactgtgatatgagaatattggatttctactggtgacaacgtcacagaacctcatacagcaattgtgggttttagcctacaaggtctgcgacatgatttctgccaacaccagtactggaactcaatatggcctctacctcacatatatttctaggtccctttctgctttttaacaagcagataaaccagaaagtctctgaatgggctgcagcagaaacagttaaggtttgtgattggctgtcacattaatgtttgcagtggaagtagtgagagaaggagatgggtaaatggaacaagtctagaacataatggttctccatatccccggcatatacattggcaacatcactcatagatgagactccataccaggcaaaaggtggaaaggtcccagtttagaaacagtctcaccttattttacacatgaaatctaatttctgcctcagatacagagaattaaaatgatttccctggctgctgggatatgccattcttaaggcaaaggaaagatgtgtccgttttatagtgaacctttagacaggaaaaggccagttctcctcaacgaatataaatgttagagaaatagaaaattatatgtgtgtgtgtgtgtgtgtgtgtgtgtgtgtgtgtgtgtgtatacatatatctccatcccatcctaacagccaagtcattaaggatacaggagtaggcaatgtctgcagtaccaaagtacaattccaaatttctgaagtacattgaaaataaaacacaatatgatttatgcagttaaatctttgtaatttggaccacatttgtggaatgagcattgccttcgagacgtgaccttggctagttatgcatgggagtagccatagtaaaatccttcttcggtgaagtaatagtgtaacataatatgcacagtctactgtatttttcaacctacccaaagcaattttctcttttcagtaagttatgctgcgcttatttacatacgatcattatattccttgccaagataatgtaaatatgaagaataactaacaggcattttaattaaaggttttgtaattttaagtcaatacaggcagtataggtagtggttgagcgcgtggtctctggctcattatctcatctctgccatttgccaaagatgtgaacttgaacaagtcacttaaatgctcaatgccttagtttcttctatttaaaataagaatgatcccaatagaacctttctcctgaacatgttgtaaatattgaatggttaactgtatgatgtagttaaaataatgcctggcatgtagtaagcactatacaaatgtcatttattcatttccacacaggttacatggtcataaatagagaaatttctagatttctttaaaatgtgtaactgtgcagtgttatcattagtaccaaccaagcttttcttctctctctacaactgatttagtaaagttgtcttcatattagaaaggttgccttacattattttattaagaaagaaagtttagaagaaaagagaaggtttggagtttctatggcaggagggcagctacttttatatagttcagtaaatcaatctctgctgctgagcgtgagcctcagaggagataaagttgtggatatttagaaaggaacgaagaatgcaccggtgaataacactatccaaattgactgttgtgaccgaagagatcaactcattagataaatatcttctctttcctgatatctgtttctttatatgactataaactatcaattttagagatccacttgatacagtagctgatgtgttgcacagtttaagaaggcagttttagcctccaataggaattcagaaataactgtaattccccatggtgccttcaaagaacattcaaaataaggtccaaacatgtaacacagcaatagttatcaagattgcttcttacctcctcaccagcttgccagctctcagcaattccataagcctcagaaaatctcttatgaatttcacccttacgctgtgcatttttcgcccaggcacaccaccacttccttcttgtggcattctctcaatacgtcggctcttgccaagaagtctgtgttctccttccaccatattctctccactctcagtccttctggtgcctattcacctcacataggccctcccgctctaccacctacaaggctgaatgttgaagtggaagccattagagggcactgagataacaaagaattatcttttgtattatttcctgtaaaagggaggatgtagattcctggtttcttaatatctcttcaaactctgaaatactctgtctgttaataaccagagaattttgacctcctaaaacacagtgaagatgaccctatgtgggcttctcttccttttgcttcattatttcttcaatatgctgcgaaatcatctttgcttcatcataggtctgggggctagattccagtccaagagagttacatattttcaaataactattctgaggttttataaaagtgaataaagttatcaagaacagtaacacaccttgtttgacttcgtcttttatgcctacaaaatggcaccatacattaaaaccatggcattcatactatgagtttaaaaatatctggtgattgctttttttgtgtgaaaacaaaagattttgccgaatggtaaaccatcacattatgtaccctagcagggtagcataataaaagggaagctccaaagcacaagacagttcactgatgaccaactcaatagtactgtgtaacagcaagaagaagataaaagatctctaaataccaaattcccccactccagtttggtgacgggcaggtaccaatcaatatcatttttctatagcagtcttaaattcctaaagacccagcatatagccagtaatagtagtgcaattatttctttctgtttcttgctgtatttcatctgtaaagtctataagatcacttagctttttagaattaatatgtccatgcaaatgtctcacgtaaaataaaataggatatcgtgatactgaacagtgtttaaaaaagagcccctctccccaaaaagctatttttgtgttaattgttctatctaagctttttatctaatagtttttaaaagaaacataacagatgactaaacataaaaagagatccaaaggccattttctatttcaatttttcacattttttaatgcagttttctcttaaattttaacttgcatgaaatataatttttgttgaaaaggactcaattaatgcattctttctttgcttatacaaagaaatcatgaatatatgctagactaactacactgtttaaatccagtgctcaataacatatattagtctgtgctaacaaatatagaaaaaactaacattttatcaaaagacaaagtaagatagaagatgtattctggattccattttagtgagtgaaaaacttactattcaatctgaagtggtaaataggattaagttcttttattatgataatgttatatttatcactgtgtttaattgattctggtgatatgggatagataagtttttctctgacatcaccatttcatttcagagttaattaatctggtgttattacagtcttgctacatcctaaacactttcattcatttatgcaacatatcacttgtggatctagaaatttacctccaaagagaacagtttggggtgatcttcatcatcatccattaattactcatcaacgtttcattatttccaactactatgcacttaatttttttttagaaaaagaggaattatgatacatcccagttaaagagaaaagtctcagatttttactgtgctattgccaagtatatagagagaaataattcaagaataaaacattattttttattttaaaaataaaagtggttgtcagataaaatatgctttaaacctatgagtagacacatgccttccagtgctagttgttcaaattgtcacttagtaagtaataatttccatttctgcaggtaaatgggacccaaagcaccctattcttccctgtgtcaataggttttgcatggatccatctgtgaaacaagagattctaagtaatcagtgtcctagataatgaaattatacaattggagtttttctattgctttattcactaacctaatgaagattgaggtattaaagagagttgtccatgtgttttgtgttgatgttttaatgcaatatagctagccccattgttattatttttgtgtctatttttcctgcttcattttattttttggtgtttaattaattattttataatttcattttttattttaaattcaggggatacatatacaggttttttacgtgggtatattgtaggacattgaagtttgggatacaaatgttaccgtcacccaggtagtgagcagagtacccaatgggtagtttttcagtcctttttccccttcttctctcctccctctagcagaccccactgtctattgttcccatctttatggtcatgtgtacttaaggcttagctcacatcggcaggtaagaacatgtggaatttgtttttctgttcctgcattaatttgcttaggataatggcctccagctaacaccattattttgaggctaatttacttcagatcgagttggtttaaatccaaataaaagatgttattctttctttatcctaatcagaaaattttaggaaataatcagataaactttacaattggcaaatcaaaggcagaactgcattaaacacccagatgtaaaaggtgtgacacctcttctactcttcttgtattcacttttaggcaagaaaacaggactcttctggaaggtaaaaatgcactcatttcccttttaagactcataagccattctggagtccactaatacctaaagtatttgtcaattaagcataattttgtctgaaatagcaagctttaaagaatacgtaaatattttaaaggaaaatagattttgaagaaatcaacacatttttacataagttttccaaaatgggttatatattattccactgaaggaaaaagaaacgaacatttattgagtgattatactgctccaggcactttcaccttggtttttttatttcttttcttaaagattagttttataagttctatctttttaaataaaggaactgaatctaagtgattaagatctccgtccagagtcatgcaaataaaaacctgccaacctcacttcaaggccatagttcctccccttggatgacgttgtctcacatatagctttttttcactgctacaaagtgttgtgagcaagggttcttagtgctttgcagttacaattaaaattaaaataaagagttaataactttcagtaaagttgccctatctctcaaactaagaccacaagttttttccactaaggaagaaacttggttagagcacagagttgtaaaataatcataaaaatatgtatctacattttatttcaattaaatatgtagaaatttacattcatttgccacacttacaactaaagcaagtgactttttgttttttagaaggggcctattgattgaagtttcaccttattttttgttttatataaagatgatacatttttctttcaagtttttttaaaaagattttttaaagcaaaatgagtccacatttttacccttctatttagaatgtgtctctccttcctaatttgacgtgaactttttagtgatcaacctttagtagatattacaatgtattcagtattgtttatgaagtcaaatttatttttgtcaacagtcattttaataattatataattacagtataaaatacaaactggtgaggaaataactataactcaactaatgggatcagaggtcttcttgactttagaacatattatcatttaatcttgataatctgttagaggccatggaaaggtgcatgtctcagacccctaaaggtcctatacactattgaaatactgattttccaggtagaatttaataacagttcagcaggaagatgatcctatgctcagaaattgttgaatagctatcaatttagaaatcagcacctgtcatcttctcatgagtaaaaatcaaaatgtttggagatatacagaacttgatttaagagaatattgtttccaatatttcaaattacattttaatatctttaaagctaaatgaatcacatgaagacaaggagattgaatagaagaatatggaaaataagctgatgcagtcaattcattacatcacagcccacaggctttcagggccccaagggagttgaaagtttcaaaagtattgatcgtggcccttgaagaggctaatggattttaagtcagtccagccattagcaaataaatgcagttgtcctcaaacacattttagctttttcttgattttcatgataatctggctctagtgttatggtttggtcttctgcagtaacagggtaaataacaaatccatcaatgctccagtgtgttctatgtcctcacccagaatgtaagaatttattcttcagttgtattgatgcattttgatcccaccttccaattcccaatcagagaggccaaactacaagagctaaatagcataatgccaaaaaatgtaaataataatattaaagagattaccaaatttgtcaaacttattctatttaattctgaatttaggttttttgcttttttgctattattgacctagaggatgattataataaatatttgatgacacattgaaattcttcatgattgacctttaaggtctggtatattagcaaaactttcagggagtctttgatgccatctacaaagacagctggcatagaagttgataaagacttgatacttggctgcttcttgtttgaaaggatgaggaagtctttacccacatcaggtattcacacaaaatggacagttatttccttaaaggccatgttcccagtgctaaaaatttcccgaggccaaaatttcccaaagatttgatgatacataaaatacttttggcattgtctgcttcaacttgtgcacagaaaacccatcatctttaccctgttcttcagcatttgtaggcaaaggggaatttatcacttttatcacataattgatactgtaatgacccagttcgacacaaaatttcacaggctgataatatgattgctggctgtggtgaacagaataatgcctcctccccaaagatgtccatattctaatccaagaaaccatgaatgtgttcagttacatgatcaagtggaattaaggttaaaaatggcatgaatgctgtgaatcaactgatgttagaatgggagattatcctggattaatcgaatgggcttaatgtaaccaaaaggggcattaaaagtcaaagagtaaaaagtcagtatcatactgatgagatgtgtgaaatacaggactctcagatactagaggaaggggcccagcagccaaggaatgggggcagcctctagaagctaaaaagacaagaacatggggaattttcctttggcgcttccaggggaaacacagcactgttggtgttttgattttagtccagtgagacttgtgttggcctcgtgacctacagagctgtaagatcttacatttgttattgttttaagccactaagtttgtggcgatgtggtatggcagcactataaaactaatacattggtttcttggcatttcttaattcagcccaactgatttaaacgaatgataatgaaagaaagaaaaagtgtagaaattgaaaaagaaatattcaggttattggctgagcaatagagactaacagaatatttagtttagtttgttataatattggctgagcacagtggctcacgctgatatcccagcactctggcaggctgaggcaggagaatcacttgaggccagaagttcgagaccagcctgagcaatatagtgagactccatctctaaaaaaaagaagaaataaatgttcaacttactactattatttattaccaatgcaaataatattttgcctattaaaattgaaattgggaaaaacagtgtgttaaccaatctgttcaaagtaatttcaaaataccatgagaaaattctaagtatgcctgctagacagttcaccatacttagctgagaatggaatattatttgcataaaactaaaagaaaaatttaactataagtaaaaaagacaattagatttagtattgctcagcacgggagaatactttttatttatccactgtcagtatatgacaaagacatttccagcttggttagtttaaaatatatttgtgccaacagactatttagtttgttataacattctcatttaggtttctaagtttcacaatgtcttaacgcaacaatttttattttactgacaacactccatttgttttgaataaatatatgatgatactaatgataacatgcatttgtgttcttatgactgtgtgcttatgatcataccactaagggctggccctgtactaagtgcttcatacacattagttcgtttagtcctcataagaaatcagtgaacacaatgttattattaatcccaccttagaactgggaaaatcagtgcacagagaggttaagttacttgcccaacatccagcagcaagcaagtggtggagccaggaaggtatgtactgtctctgctctccctctaggtcaggcatattctatacttttcataggcattgtttcttttttttagttttattattattatactttaacttttagggtacatgtgcacaatttgcaggttagttacatatgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggttttttgtccttgtaatagtttactgagaatgatgatttccaatttcatccatgtccctacaaagcagttcatatgcattgtttcaatgaatgctcacactgtcctcctgtaggtactattgttaactcctttgcaaaggaggaaatttaggcttaaagaggctaagtgacttgctctaatcactctgttccacaatattttattccatcaaataagcccttgtgttgtatgttacattattttgatggcgtgccgggatctaattgtactagttacatagctggaacataaaatggttcttgaaataggagctcatagcaacccaatctttgcctcatcttagaatgtcttgtctgtgctaaataaaattgccagccactaaatatgggtcttgggaatagcaaaggatgtcatcaaaaacacccgaacacctggctagaatgaaaagggaacaggacagagacattaccttctcccctaacaaagcaaaagtaaattctgttttgcaagtctagtgcaccaggattataaatgtcaggaaatagaatttcaatgccactgtacatctgctagaaattggccttttccttaaaaaaattctaagacacattagtgttttaaaaattgatttatattgcttactttgattatgaactgatacagcacggaactatcaggagcctggctccttttaaaatataaacagttacactgtgttctttctttcctataatctctttatggtcaaatgcagaatatttcagtctgcaatttcccatttaattcttgtcctcgtttgagctattaaattggactccatttcagcagcaactgagctgacactcgatcctctattaccaatgactgtgtagaaccatctgcttgaatgattttcaccatatgtgttttaaaaaagacaatgttttatacatgcttgctgtaggtaatatttgacaatcataaaagaagagcaaaatcagagtcagctgtaaaattgaaaggaaaaattaaaatcctatacatatatttgaaatcccaagagttaatatcggtgtattttctataatttctaagtcaattcaagtacaatttgaagatattagtttccaaactgaaaagaaaaaattcatcacagatcatgatctgtggttaacattttaaataatttagattaacattttaaaaattgatcaagtcaattatgatttgagataattttttattttcagtttactgagaggattgttaaataatttccttggccatacagaatttagtttggcttcctccaaaatattttagtaacataaaaataaaggttatttaatttaaatcttttagcagatattgttctgtaactcaaatacaaataaattttctgatttctggttaaagatttattttacttagttgatataattaaccttcaattaattaatgttattaatattgtgatatgtttatatgtaaaaaatggtgagatcaagtccaaaaaagtggatatggaggaaaatccatatacaaccaacacagcagaacctaccaaatattcaaaagaaagggtgtctgaattgaaatttaactacaattatacctattagtattatttttataatttacatctatttttatggcacctttacattgctagagttgatcctcacaacagccacataaaatgctgagttcaaatatcatcttaattttaccaatatggaagctgaagctctgtgcaataaacaaattgccaaaagccacatagctggcgagtgactgctcaatgtttttctcctccttcttttgattccaagttccagacccttctcaccaagacttaccaccatctcttttgactcttatgtctaacatagttggggagacatccttagcattaaatattctcttggggaaatatacaatcagttgttgcatacataatttgagagggggctagttttgtccatttctgaaaatttgggaggagcatacaaacagctgaggcaaggattctgagaataattagactcatatctcacatgtcataaattgttgccacatatatggttccagttctattctcaccataatcctgaagtatagagagacagcaactctgtgcatttcataacagagcaagttgaggcttacgacttggggttaaatgacttgaacaggatgacacaagcagtaagtgaaagaaggagccaggccatgcgccatggtgtatattaaaatgtctttctggtatcagtgtgcttcatgatcctttcaattgtatatatttcccaataacctgattaattatatatatttcccaataaccagatttcatataaatatgaaactgcattccaaatccaaatatggcagattcatttggaatatccattatttcaaggattacttttaatattacaaaagtgcctttccggtatcagtgtgcttcatgatccttttaattatatatatttcccaataactagattaatccaataaaatataaatatgaaactgcattccaaatccaaatatggcaaactcatttggaatatccattatttcaaggattacttttaatattacaaaaatgtgagcttgtaatcccagcactttgggaggcgaaggtgagtggattgcttgagaccaggagttcaagactagcctgggcaacatggcgaggtcccatatctacaaaaactagaaaaattaaatgagtttggtggtgcctgtggtcccagctactcaggaggctgaggtggaaggatcacctgtgcccaggaggtcaaggctgcagtgagaaatgatcgcaacactgcacgccggcctggacaacagaatgagcccctgtctggaaaaaagaaaaaaaagtaagctgttagccatgtgaaatcttaggctataaatctacttcatctagattaaataagattattgataaacttttatttttctgattgagatatttgaaaataagcatgttcatatttgaaaatacatttgtttttgtataatattgattttccttcagaattaaatatctggtccgagttgactaaataatagaactatcatctcttcattttcatagtaaaaatactatgctaaaaagagacaattttcccaaatgaccttctttgtcaggaagctttctgagtgtccaaccattgttgtccattttttaacggtatcaccttttgttgggacattttggcctttcgccaaaagctgaataccatcattctttgttgtgttctttgttctgttttcagcagggaagatggataccgctgtggtgaccctggcctcttgataaggaaggcacactgatgtcacagaagcatttctgttagatatggttgggttcattaggcaaaaaagggggtttcttttttaaaataaaatgacattagggtttctttataccctgatcaatgctaagaatgaagctctaataatcctttaagaataaaagacaatgaaaaagaattcttttttacattaaccttttttcccaagttgttcttcctcaatatattatctcaccatatgacacaaaatgtctagcttcatgatttattattctgtatataactgaaagcaagagatatctgttagcaaaataacaggaaaaactcaaccattttactagggggattgcagttctctattcctgtagctcttcccaaaacaaaaaacaaaatggtaattgcctattataactattagagaaagattagatatgtagatattgacttctttgagatggtaaagcacaaatctctcaagttacttttcatttttcaaaataaaaaataataaattggctttgatgcgatcaatttaactttaccaataattgttctctggaccaatgcttaagttttatgagatttttttgtaagtgtacagaggttgaattttatcaaaactatcatgacattaatccaggtagaccactatctctccctcaaactttcactagcaagtggttttaaagatcgtggctactggtctgatgggaatttatggtaaataaaatgtatgtgtcagtttcctcaggtgtgcctaataaaggtatttaactcaaaagcatatagtgagcatttaataggttcatgaatctaaaccatttttaagggtaactggcactaagctgttagctattatgttagtagtccagttatgagagaattaaatttaaaaagtagtgctgaacatttattgcctcattgtactactccagagacaagaagcagatgattttcaattatacaatgtttttccaatatgatttcttagattctgttatagttttcaatttcttgcctctcagcttttaattcattcttcaatatttactctgtgctaatgaatgggatggattcctttctcccgaacagtgagtacattgttaaaatttctcggtagagggcgatatagtgacattacaagaggaagagggcttccgctggttcaggcggttgcacccttggtcaacagagcatgtgtgaagacaactgatcatagctcctaccatgtggctaaaatgcgtgctcccttggcaaccttgcaatcccaggctagcctagtaactccttcctacagccctcccaatgtggacactgcatattccagttgtcatcagcagcataccaatgtcttcatacctgcccagttgcagtccacctgcaccctgaagagggacttcttctttgcttgtctagtgaatgtgcatcagatctggtctgggcaaaccgacgaagttctccgtcatccagtgaacagcaatcgcaccttctccaacctccaacaaggcctgaacctgagccctggggaggtattcttccaagtttgtctttcctaaattactctccctcaggcctaaggtatcttttagtttccactgcaccttgtagttatgttactctcattgcttaataattctttataataaaacttctcttgtttaaaatactacaagtctgtctacggattcaactcagagtgatacagataaagtagaaatcatttttgccaaggaaatgacttttatctaaatcctgaaagagagctgctcttttgaaacaactctgctagcaccttttcagagtgcatccatctagaaactcatttaatcctctaacaaccctatttcttggacagggaaaattgaggcaataccttcttcaaatcattctgaagctaataaattaattttttttcaaagtttgttgtattttcacctgaagagtttcattcagtgtctggaaaatagtaatctctttataagtattacagattgtcataattgatatgaactatcagaaaaatattcatcattctctctcatagtattgggttttctgcatgttcctgatgatctttgattctctatttatattcatgtgaaagaactggattactgacacacataacttctgtaagattttgtttctgttgtgaatgatttcatcatcagcaggtctttcttctgagtgggcagtctggctctgaactctatgtgcagacagacaagtcaagacaactttgaggtgagcaggagagcagctgagattgccctaaaatgccagagaatcataataaatcaaaggactatccctactcggaagaatgtttattacttgagagtgttatttgctggtcttatctagcaagaaggtcaggagtaaagacacttctgccagcttttatctcagaatggaccaaaaggaaggaagagaaagggacgctggaaagagatagaactattcatccacaaaacctcaatgatttccctgatttctgttccattacagctttgctatactcaattgctcacatgaagcttaaaacctcctgaggcgctacccttggcaatagtttccatcttctctactccttctgctcccttctgggcaaattttggacaactagcagctctgttctcttttattcttataatagtgaagctgattgaatagtggccaccaaaaagatatgttcaagtcttgacttctggtaactgaaaatttgatcttacttggaaatagggtctttgcagatgtaattaagttaataagctcaaaaggagaccatcctggacttagggtcctaattccagtgactgttatttttataattaaaagaaaaggtaatttgaaacacagacacattggggaaaaggccattcatgcagtgagaatggacataaaaattggagttatgcagccacaagcgagagaacattttcagacactagaaactggaagaggctgggactctcccagagcctgcagagggaacctggccctgccaacaccttgattttggacatctggcctccagaactgcgcgagaatgcatttcagttgttttaagtcaccaagtgtgcagtaatttgttatggcagccctaggaaactcatataaatagaatcccattaacttcctgtctttcagaagtcctccaaaaatctctgagctgctcatgtaaaccctgggcccatattcctctcagcactgctgtgtctttatctcattttgtttctcttgactaggacagaagtgaaccggtttcagtctgcaatgaaatttttaaaataatatttaatatttaactccagtgtatcttcagtcttgccctagaagccagattcagattcaggctagattgaagagaaagcattcaactacaagaaaagagatttaatttttggttccctggcacatagagtatgcattccgcagatgcaatggcatcagaccaagtgcattcaagataaaagccaatcaagactgacaggtttgacaacttcttactcagcttcaatggcccccatgccatctcagtcataaaggtgtgtatgtgtatgtatatattcagtttctaattcttccactggcattgtttcacaaaatccctccagatataacgaatactaattttaatttcagtcagaataagtataaaatctgttctcttcataacattagtttttgacttcaaaccttcagagacataaatgtgttttatgaaaagctcctactatttctttcctccagcaaaaatcatgcagtgatctgttactgccagtgaggaattagatatgtaaatgggaagagggcatttgaaggcagacggtacctaggaatggatgggcggtcgcttgggtttttcttcattaagacattttaaagtttagttctcagtgtgaagataatttaaattgaaagaatttttgtaccttgacactgcaataagttccctgtacatgcatcaagttttacaaatgagaagctgtgtggcacttctgctagagcaaggtgttcatcactaaagcaacagaatattgcttaaatatcctcctttgatgtcagagcctgaaaattagacattaaaaatgaataaccctgtaactctaagaaaaattagagcaagtaaaatataatttaatgaatccctatgtgataggaaaccatagttcaaatcatttgatatcagaaaataccatccatcccttaacctcaaaatatgttaaagccagctgaaatcacatgacttttagtaaaacttctcagacagttccagcccacattgatctctttctccaaagactttatctgtacttatctatgtcaatcataaacttgaaatcatgtaccatcttgaagcactatccagactacttcacctgtatatagcttgttttcctattgcaattacaaattcaatggagtaaacaactgtatcttaatcttcttttgtatcctgcaatgagtacttttttaaaaaattgaagtgatgtaatcttcaagataaaatggatcattcagacatattaccattttagctagcaaatttccaagatagtaagctgtgtaattttatctgcaatattaaaagctataaaagttcacctacctttagtcataagtcattgggaaagtcatgtgggtatattatattcaaatccacatcctatctgccatgcttctctgttgaattctcctcctggagactttggttccctttacttagaataattgtgaaggtatgtttaaaagataattgacaagacctgcatttcaccaacccattaccccagtcgtcaatctcgctttagtccagagttggcaagctattaatagctaccattttggagcaataatatgttccaaatactatatagctagatagataaacatcgacatgaatgaatgtaagtatgtatgtatatgtgtgtgtgtgtgtgtgtgtgtgtgtgtgtgtcaatgaccttgaaagtctggtattattagccttgttttgcagatacataaatacctttctcaaggtcatagactaactaaaccaagattcaaacctcaatttccaaaatccatgtggtttacattaagtcacctcccttgctagtaaagcttcatatttcagatcctacaaagataaattaaaactggaatggactaaaagctctttgatttcctgagtttataagttttgctttcatttatttaattaatatcctgcaagtcacaaagtacaaaatctcatcatgaaaagcagtgagtaaaagtcatgtgagagcaagtttacagaagaaaaagtaaatagcataagaaacagagactatgcaagagattggtctggttacaagaaaaataaaacaaggagcagaaaaaaattttaaaaaataggcaataaagaaggggctttattatgtcatttctgagtcaaaatgatattggcacatggattattttaggctttttaaaaagattttgcacatatgtgcagttgggagtcaataaggaaagacgatgcaatgaaggtttatttgtgaaaatagttgtggttgcaaatgctgtagaacttgcaaaatcctgaatgtacttaccataaggttggccattggctcccaatttcaccctagctccttttgcagtagaggtggacaagcattcttattttctgttgtgaatggtgcagttgggcttatggaagtcaaggtaagaggaacagggacatggctcaatcgaaacccttttatgtgtgttagccccagatagcactaaaagtatgcaactcagtttccataactcctggggtaattccaatgagcaacgaagtttgagcattactactttaattgaataggatggtgtattaatcaggcttctccagagaaacagaacaaatgtgatacagatagattagataaattggtataaagaagggaaagagagagaaatacatggggagataccttatggaaattggctcacctaattatggagactgagaagtcgtgtgatacaccatctgcaggcaggagaaccagggaagtctgtagcgtaatgcggtctgagtccaaaggcctgagaacctggagctctgttgtccgagggctggagaagctcccaactccagaagagagagcaaactcacctttcctctgttgttttgttctatctagttcctacatggattggtaagggcagatcatcttcactgaatctactgatttaaacgctaatcccttccggaaacatcctcacagacatacccaggaataatgttttgccagctatctgtgtattcctgaacccagtcaagttgacgactaaaattaaccatcacagatggcgtcagcatagtgacttggcctagaagataacacggattcaagtaataggcttgataaccaaatggacgaatgatattatccagtcatcttaaaaatacatcacatgatcccaataagtgataaccccagagaattcaaatggaagactaggattttgggtcaacagtcatgtaggaaaattaactgcaatagtagcttcacaggatgcttactaggaaagttattcagaggtcatggaaaagaaaagttcactgtcaaaattaatattcttcaatcacccacttatcaaatctattttaaatacatagcaagaaacaaaaagaaagaaatagggtaaggtcggattcaagcaggtagaagggccgtcctccctgaattatagattttagattaacacattaacacatttatgctctctccctccctccctccctccctccctccctccctctctctctctctctctctctctctccctccctccctccctccctccctctctctctctctctctgcttcattacccttcccaactgatgtagtagtagtcttgatgaatagagttggtgttttaataaagggggcaaatacatgctgcttggggcaacaggatacacttgctctatttgagataatcaggcaagtattcctgattacagatgacatcaccagttagcttgctgaacaggtgtgggttttatctgtatttattggatatggcgtatgtggggccataaggggactattgtgtgtgctaccagtgggaagttaatttataaataactgaactgagagaatcttatctaatggctcagcctttccatattgtcttttacagaagaaattcttgtctttgttataacatgtaacccttttattatttctgtctttaacatgtcttagagattaccatcgtacatcatctagctaatatctcttttgaattctgcctacatagcaaaagctacttgcttattcatacctagacctaacacatcctataaggtttctctctctctctctctttctttatcataagctagctttttcactatgtatgcttaacattcttagcagttgtatcactcctgtttattttctttttgtaaaagcattgaatattctcaaatgagaaagcaagcatatattctaaaaactttctccgtgtttgaatgacatgactttattatagaggtgaaagagacctctgtcgctttcattactcacttaggataactttgtacattttaaagtagaaatgtaactgctgtgtgcaacctttgttaaggacagcatgttcaaggggaaaatgctgagggcaaatcaaagaaattcaaattgaagaaaggtgacaactaaacattaaagcataaagatatctcaagaatcgaatgacccatgttgagcaaaatttcaggctaagcacaaatccaaaagagtgacattttgcaaagactggcaaatgtaaataaaagaataattattcattgtaggaactatggtttctagtcttccaaattagtccaatgagttgcacactgaagtagcatttgtgtcatcagaaaaagtactttatattttaataattatgtatagtatacatataaacacaattgaacatgaaaaacatataaatatatgtgtttatatgtatattaagcctttcttgcactgctataaagaaacacctgaggctgagtaatttacatgtaaaataagttgaaatagctcagattctgcaggctgtacaggaggaatggcaccagcatctacttggcttttcgagaggcctcagggagctttttctaatggtggaaggcaaagtgggagaagacacatcacatggtgaaagcaggagcaagagagtggcagaggtgacactcacacttttaaatgaccagattttgcgagaattcacttattatcacgaggacagcaccaagaggatggtgctaaactgttcatgagaaattcacctccatgatccagtcacctcctaccaggccccacctgcaacattgggggttatatttcaacatgtgatatgagtgaggacaaatatccaaactatacaaatatgcatatacgtatctacagaaacaaccaaagttaccttttttaattgacaagtaaaattatgtatatttatattgtacaatatgtttttgatatatgaatacattatagaatgattaaatcaaaccatataacatatatcttacctcatattcttatctgtttgttgtggggacaattcttagaatctactctcttagcaattttgaaatatacaatatatttgcattaattgttgttaacatggcatataacagagctcttgaacttacttcccctgtctaactgaaattttctgtcttttcacccttatctcctcagtccctctactccctagcctctggtaaccaccattttatttcctatttctatgagttggactcttttatactctgcatgtaagcaagatcatgtggtatttgtctttctgtgcctagtttattttacgtaatgccatatcctccatatttattcatttcattgcaaatgacaagatttccttcatttttaaagctggaaggtattccattatgtatatataccacattttctttatccattcatccattgatgaacacatagggtgattccatattttagctcttgtgatagtgctgcaatgaacaggacagtgcagatatctctttgacataccaatttcatatcctttagaaatatatccaagtggtggaattactggatcgtatgttctatttttaatttttgagtgagctccatactgttttccataatgattgtaccactctacattccaacaaacagttaaaaagtttcccctttcttcacatcctcaccaatacttgttgtcattcaattttttgataatagccattctagcagatgtgagatgataccttagtatggttgtaatttgcatttccctgatgataggtgatgctgagaatttttatacctgttggctatttttatgacttcttttgagaaacgtctattcatatcttttgcctaatttttatcagattttctgttttcttagttttgagttccttatatattttggatatcaacgcattaccagatgcatggtttccaaatattgtctcatattctgtaggttgtctcttcactctgttgactgtttcctcggctatgcagaagctttttagtttgatgcaatcctctttgtctatttttgctttgtacttttgaggccaaatctaaaaaaattattgcctacatcaatgtcatatagttttgcccctatactttcttctagtagttttatagtttttggtattagggttaagtctttaatccatttcgagttgacttttgtatttggtgtaatacaaaagttgaatttcatttttctgtatgtggttatccagttttcccatcatctcttattgaagagactgttcattccccattgtgtgtttttggtacctttattgaaaatcaattgaccaaaaatgagtagatgtttttatttgtttatgcctgtaccatactattttgattcctatagctttagagtagattttgaaattgggttatgtgattctctcagctttgttcattttgatcaagttacttaggctatttgagattccatataaattttaggatttatttttctatttctataaaaaatatcattggaactttgatagggattacacagaatctgtagattgttttgggtggcataagcttttaacagtattaagtcttctagtacatgagcatgagatatcttttcatttattaatatcttctacaacttctttcatcaatgttttgtacttttcagtgtgcggatctttcatatccctggttaaatttattcttatgtaattttttgtaactgttgtaagtggggttgtggtcttacttttttttcagatagttcattgttactgtagaaacatccttatttttgtatgttgatttttttatcctgcaactttactgtattctttattatttctaatagtttctttgtggaggctttatgattttctgtatataagatcatatcatctgcaagcaatgatgatttaactattttccttcctatttggacaccttttatttctttctcttacctaactgctctggctaggactttcagttccatgttgaatgaaagtggtaagagtggacatccttgtcttgttcctgatcacagaggaaaagctttcaacttttcactgttaagtatgttaactatgggcttgtcatatatgacctttattgtgttaaggtacattcatcctgttcctagtttattgagagcatctatcatgaatggatgttaaattttgtcaaacacattttctgcatctatggaaatgatcatattatttttgtccttcattctgttaatgtaataaataagatatattgatgtgtgtatgctgaaccataactgcatcccagggataaatcccacttaattatgaaaattatcttgctatttaaactggtagcttcataattcctactctgtcagtcagtttaccatcagaaagcagctatcacaaacaaataaatgtaattggagaagattgaatatagagcctattttaaaagtgaagaacagcatataggaaaagaacagaagttagtgaagtgccctgttctagtgacagtggagtcattactgtctctaggctggaataggctagaagaggagtttctggaacccagcatgagacagttgtaaggaaagggccatcttgagaggagcttgtgcctgtgaagcacacatgcagtctgaggtcaccaggcaagaagctatccagaagaataagttctggaatagtttcctcttatcttctcaaacccagtgatatggtttggctgtgtcccctttcaaatctcatcttgaattcccaagtgttgtgggagggacctcgtggcaggtaattgaatcatgagggcaggtctttcctgtgttgttctcatgatagtaagtctcacaggatctgatggtcattataagggggagtttccctgcacaagctctctctctgcctgctgccatccacgtaagatgtgacttgctcctccttgccttccaccatgattgtgaggcttccccagccacacggaactgtaagtccaatgaaacctctttcttttgtgaattgcccaattttagatatgtctttatcagcagcgtgaaaagggactaatacagtacattggtaccagtagagtggggcattactgaaaaaaatactccaaaatatggaagcaactttggaactggataacaggcaggggttggaacagtttggagagctcagaagaagacaggaaaatgtgggaaagtttggaacctcctagagacttgctgaatggctttaaccaaaagcctgatagtgatatggacaataaggtccgggctgatgtggtctcagatggagatgaggaacttcttggaaaatggagcaaaggtgactcttgctatgttttagcaaaaagacttgcaggattttgcccctgccctagagatctgtggagctttgaacttgagacagatgatttagggtatctggcaaaagacatttataagcagcaaagcattcaagaggtgacttgggtgctgttaaaggcactcagttttataagggaagcagaacataaaaggtcagaaaatttgcagcctgacaatatgatagaaaagaaaatccattttctgaagagaaattgaagctagctgcagaaatttgcataagtaactaggaggcgaatgttaatccccaagacaatggggacaatgtctccaggggatgtcagaggtcttcatggcagccctttcatcacaggcccagaggcataggagaaaatggtttcctgggccaggcctagggtccctgtgtggcatgcagtctaggaacttggtaccctgaatcccagtcactccagccatgactaaaaggggccaacgtacagcttgggctgttgcttcagaaggtggaagcccgaagccttggcagcttccacatggtgtcgagcctgcaggtgcacagaagtcaagaattgaggtttgggaacctccacctagatttcagaagatgtataaaaacgcctggatgcctaggcaaaagtttgctggtggagggggtaagggggggctcatggagaacttccgctagagcagtgtgaaagggaaatgtggggtcagagaccccacacagagtccctcctggggcaccatctagtggtgctatgagaagagggccactatccttcagaccccagaatggtagatccactgtcagcttgtaccatgcgcctggaaaagccacagacactcaacactagcccatggaaacacccaagatggaggctatacccagcaaagccacaggggtggaggtgcccaagaccatgggaacccacatcttgcatcagcatgacctggatgtgagacatggagtcaaaggagatcatttcagagcttgaagatttgactgctttgctggaatttggacttgcgtggggcctgtagcccctttgtttcagccaatgcctcccatttggaatggcggtatttatccagtgcttgtacccacgttgtatctagaaggtagctaacttgcttttgattttacaggctcatgggaggaagggaattgccttgtctcagatgagactttggactataggcttttgagtaatgctgcaatgagataagactttctgggaccgttgggaaggcatgattgactttgaaatgtgaggacatgagatttgggaggggccaggacagaataatatggtttggctgtgtccccatccaaatttcatcttgaattcccacgtgttgtgagagggatgtggtggcaggtaattgaatcatggggtcaggtctttcctgtgctgttctcatgatagtgagtaagtctcacaagatctgatggtaagggggagttgtcctgcacaagctctctctttgcctgctgccattcacataagacatgacttgttcatccttgccatctgccatgattgtgagacttccccagccaagtgcaactgtaagtccagttaaacctctttcttttgtaaattgcccaggcttgggtatgtcttcatgagcagcatgaaaactgactaatacgcctggctaggtttacagagcttagtttatatgctgatgctaatatttggtaatgggtgcttaaatgtattgtgaacatgcaactcgtgaagactgtagtgacggattagtcgtgtctgctttcaatatgagaagacagaatggtgtcaagcttgccaaatattttccagtgtgttccctgaaaacattatggttagagaaactgcaaggaaatttctgaagaaattctgaagtgaagagtgaattctcataggtgaggctgaaagatattcatgcataaggcatagcatgtgcagatatccagagaaataaaagaccatgcactattcttagaattgcaagtacccacaatatgaacagaaagcatagcatgtgagaacaagaatgtgataaataggtccagtaaagcaggctgcatttaggtaatgaaaagcctggaagcctagcatgtgaagttgggtttttagccatgggttgtcctgatgaaattttgcatttaagcagccactttggcgtcagtgtgcagaatgaactggagcaatgaacagagtaagtggaatcaacaaagacgactgaagaaaaacacccagtgagctcagctttacttagttaagcttcacatttatgggtggccaatctgtactgatgccagggtaggtgccaaatagatggttgtgaatatgacacagtcctgccctgcccctaaagatcttacaggagagaaacgcaatttctccaagtgccctgggagcagagggctaggagagaaacggaaatgaaggtgaaagaggtcaagcatgaccattctctatcagcaaggccagtaccaactcctggggcttacagagttccctagagctttcagcatttctaaaccagttcttgaagacatcacagtacacttgtatatatgtctttctctcttgcatacacacacacacacacgcgcacacacacacacgcacacacactacatacacaggaacacagttttacttaatgagctattttcttcttgaaccatcgatcaaaaacatctccatcagcatctcctaactagttgagagttagtaaatacatatggtttgagaagataactgttattgtactcctaagtaaaatgttgaccatcatatcttgtattaaaaaaatggaagaaaaattctattttccctgttttccttcagtagtatgaattggcattctatataaagaactaaaatataaagaaagttaataactacttacatttgtaaatctacaaaattataaatgataacacatattatgttttaatttatccttacaaagctctggaggtacatgggaattagtattctttcattttaatatgcaatgaaaattcatggaattatgtgactctctcaaggtttacaagtaaatgtcatagccaggacttgaaccttaatcgtctgtctccaaagtgaggatggtttttattataccaccccattgtctaacaggcaatattttgttaaaacagaattaaaaagaaaaagggaaaaatcttattgtacattatttatggtactcctgcagaagaatatttgagagaatggctatgtaaggaaaagagcatatcgtctagtctcaataaaaatttaatgtttaaaattattgagcctatgatttgctaacaaaagaaaaataaaaatatagatacagcctttccatcaccattccagccagtaattctgatccctgtaaatgctcagcttcctgggcattcactcctggaggcagccatgctctcaaaccccgtctccaccctccagagtggtgttacatattctctgtggttaggtgtaatatgctggttggaattactgggtatagatcaggttttttggggttttttttttgaaaggcctattcttttttttgttactttaagttctgggatacatgtgctgaacatgcaggttttttacataggtatacatgtgccatggtggtttgctgcacctatcaacccatcatctgggttttaagccccacatgcattaggtatttgtcctaatgctctccctcccctttccctccagcccccaacaggccctggtgtgtgatgttcccctccctgtgtgcatgtgttctcattgttcaactcccacttatgaatgagaacatgcggtgtttggttttttgttcctgtgttagtttactaaggatgatggtttccagcttcatccatgtctctgcaaaggacatgaactcattcttttttatggctgcatagtattccatggtgtaaatgtaccacatttcctttatccagtctatcattgatgggatacccaaaggattctaaatcattctactataaagaaaatgcacatgtttattgcagccttaacactgcgtgtgttgctctctgaaacagacacttgagtcatctacactgctacccactgttttgtttccttgttgagtttatttattgagcactttccatttgtgaagatctgctttagataagcccttttgaatagctctccctatccagatagctatgagcttgttgttcagcaggttttctcatcatataataacactgttagtctctttctaggcatgtgccctggccctgtcctttctatgtgtctgttctaattcagcagtacaagtcatatgaaatatagaactatgtagtaggactccataagacaacttagagagtatgtttattgcaccactatctacaatagcatgttttttataattatctgaaaattgtcccggtccctgatagaggaggtattagttccatacagttggcatcctgggtcatacagcaaataaaaatactgctttgatctgtaaagcaatttttgcttggatttctaattttatgtagaagtcattttatgtagaagtctcatcctaaccaaggtgtatagaaatctctcactaacattgggagaaaatgtgcaagtaatgagaggcttcaggtaaagttgaggggggtgctttccagagttatgtctcaagggaagaaaaacatgtggcagtttctttgtatctgtactagaggaaccattcttcaactcagtgaagtaaatgtttcttgactttggttaccaaatgcgttcatggtaggtcctagtaaattagcactaacgatgttctgttcccatgaagctgtttgcagccttgagtaacactagaaagatttccatctaccggctgtaccaaaacttggaggaggactagagaatattccttttctcctgttctttcaaatgagaagattgagttgaaaccttgagagtcatgagttcagtgcagcaaggaagcatcatgcatttactcatagtgctgcgattttctactgttgtttttcatccctgaggctagagacaatattctctaattcacaaaggtccattttattccccagctttattccccaaaattggatcctgccccattatgcccaacatttctgatcaaatcatgatttcttttattttaaaatcataaaaaatgttttattcttcctaaacatcataaaattgttagtgagcagaagaataattcatgagattttatgatcatggcattgtgttattctccaacccaaatagttacttttctaaatattgctttgccaaattccataaacagtttcattgtcacaacaaataaggtaatcaggtctgtggtgacccaatcaagttattttacttgtataaaattagttaaactagagagaagtccacataggattcagagttagtattttgtatgctagagaaatatgacattcatcattgtttcacatgtgtaaagtataatcctacttacttaagtcaatcgaaatgataatcactggtattacaaaatatacatgtactaagaaccaaattaactagttcactgcttgttgttcgggctgtgtggccaaggttaaaaggttgatgagtgccacccagggaagagatgagtgcataattagaggttgttgggaacagacaacgtgcacactaggcagtagtgatgcagtgtttatagcaagaagagagagagaatgcacaagatccagctccttgcaatacttcaggcccccatggccagggatctattccccagccaacatgaggggatgtcttaactgcacatagcccacttcctgctgtagtgaaagtacctcaacgcctttccctgcggggaatctgaaatacagaaagctaggggcatgcatgagggccatggaagcatgcacttaagaacaaaggaggacacaccgagaatgaaacatggaaagctgttcctacacaaggcaacaagcccagaacaggctgtgtgaggacagtttatctattgaaaagggagtgttccacgcccaaaacccgttcctatgcagctaagctagaattgacagactgcgcacaggagacctttcccaacattaacttttctgaacaaaaccttcaaggggatgtcattactctcttcctttgtttcttcccactgcttttctcatggtggtttaatctgctatcagagctgagtcatgacagttgacacttcactcaaacattccttctgaattcactttctattttcttttggattacaaaatatctggaaccgaggactcctccgtcaattcaagttttatgataaagatctcagcccacgttgttattgcaggttcaacattgtgtgtgttgctctccgaaacagacacttgagtcgtctacactgctactcattgttttgtttccttgttgagtttatttattgagcactttccatttgtcaagatctgctttagataagcccttttgaatagttctccctatccagatagctatgagcttatggttcagtaggttttctcattgtatgataacactgttagtctctttctaggcatgtgccctggccctgtcctttctgtgtgtctgttctgattcagcagtacaagtcatatgaaatatagaactatgtagcaggaccccataagacaactaatgctaaaatttaaaatttaaaaggattaaattttaatgctaaaacaatgtaagattattaaaataacttttcatgtccccttcatcaacctttatatgctgattgggaaaaaaataatgtttaaatcagttcatctcagttcaatcagatacttaaaaccatgcttttaggaagcttcagtctctgatttggaaaaatgtctcatctcaaagattcgtttcccctccagaagcttttctccgtaagatgactgggtacattgactggggagcctgatgtgtgtcgctattagggaacgtggaccttgggcttctgttgcctccagcgtgagttatggctgtatctcatcaactctaggggaatgcccttttctaccctgggtgctttgtcacttctggtttgtgtttacagtctctgcctggtgaagttttacttttaatgtatttttaattaacatataaaattatatgtatttatcatgtacaacataatatttgaagtgtatgctcattgtgaaatggtaaaatctagctagttaatacattgattaccacacatagttgtcatttttgtgatgagaacatttaacatccactctcttagcatttttcaagaattctatatatcatcattagttatagtcaccatggtgtacaagagcccttgaattcatttctcctatctaactataattatatatccttcgaccaacctttcctcaactcccccaccccccaaccaccctagccattggtaaccgccattctactctctacttctatgagatcaactttttcagattctatatgagtgagatctttgtcttaggcagtgatagtgcagcgaactggctcaaactccaagaagctctcttcgttaataaatgtgagcacctgctaagcccttcacccaagccattgacctgagagtccacccttaactccagctgagggtcacttttccctgaagtggctggcagtatgctaggcctgctgatatatctatgtcaagcaaggactgaagacaggctttgaaagccacacatcagtggagttctcttctatatcgatttatgaaagaatacaccaagtgtgtaaagaccatattccaccattgctcctgtcaacccatgtaaccttcgcttatatttcagtcatccacatcccctcctagctgaagtttggagagagtggattggagaatgggaagagaagatgttctagaatagagcccataagtaccctgactttcttgagaagaaggacatggtgaaggagaccaagaagatgcaactgatcagatgaacacctgtatagtgtatgtgtctaagaagtcaaagaaagaaagtgtttcaagaaggagacaagcaggtcttcctcctgctttcctctcttccatttttttcttctctcacccttcttatattcaagaaatgtctagtccctgccaggcaaatgttctaagtacaggggatggagtggtaaggaccacagaaaaattcttaaccctttgtggagcttacattcaagaaagagaaatagaaatagaaaataaacaaatctgttgattatctggagatgataagtggcatgaagaaaaatgaagggactgaaaacaaggtagatttgctgataggaaagtaaagtaccagttgagagataatacctacatgttatgagggagtgagtggttcataagcagcaaagagtgccttctggtcagagataaatagtaattacaaaaagtccgaagattggaacaagtatggctcaatggagggagagcgagatggcctgtgtgacagctccttgcaatactagagttgagtgagtgaggttgagggatgggcgatgtgcatgcttcggtggccctcatgcgtgcccctagctttctgtatttcagacttcccccaaggaaaggcgttgagatactttcactacagcaggaagtgggcgatgtgcagttaagacatcccctcatgttggctggggaatagatccctggccatggtggcctgaagtgactagagtggagtgaatgaggttgagggatggggatgaactgagtagccaagacacagcagatcagagagattcagcactttggggtgatttaagcatgggtggataaagtgactaatttaagtttttgaaccatctctgtctgttgaaaactgactgtagagaaaaaaagggagacataaggagaaaagatgacaatatttgcaggagtgcatgacagtggctggttccatggtggaaacgtgattgcaatgtgggttacacattttgaaggcagggagtaaggagactgctgatgagatgcgtatgtaaattttgagtgagtgtcaatgctatgtactgagataaggaagattggaggttgaagtgtggggtatcaagagttctttttctggaaacataaaatgttaatgtttatgagacatccagagaatcatgttaagtaggcagttagacaaaacaatcaagagctcaggatagatgtcagagctagaaggataaatacgggaatcatcagcagagatagcattcagcattagaggactgaattttatcaacagaaagtacgtttagaatgggaagagaagatgttctagaatagagcccataagtaccctgactttcttgagaagaaggacatggtgaaggagaccaagaagatgcaactgatcagatgaacacctgtatagtgtatgtgtctaagaagtcaaagaaagaaagtgtttcaagaaggagacaatcaacagcatcaaatgctctgaaatggcaagtaagacgtaaccttgacaaaggtatttcagtggatttgtagggatgaaagtctgattggagaggattaaagagagaatgggaagaactaccatttaaatacatttatttccccatcctctcaaagcaccacaaaatgtatgtaatggaatttttttaaaggcataaactgcaagaacaaatagtgtagacaaggaaacaacaggcggaaaacccacattaacaaaattttacaatctggcaacaaatggagtggtagtaactgattcagtaggccagagaaggtaaaatgtaaccctatatccagattgccagaaagatataattctatttactgctaaaccccaagaaggctcagaaagtggagaatcagcttctttagatgccaggagtgtgaaatggaactaaaaacagggttgattgaaggtattttaagtagctaccagataccacactttacttctcagctcattgaaggcaggcacgggactgtcactctctggaaaggtttgataaggggttaaaaggctctgaacatggggatggcagacacaggtgagagcaaatgtgcagtgccttactgacatggagagattttaagtaaaattctttaatgaatggtaagacagtccttaccctacttccttgtctatttctcagctttacctacataaagatggctaccaggcctacaccagtgccctcccactgtaaaacattctaaaaagttcaccttcagttttgagggttgtgatcctatagcaataacccatttcctcttctacatctttgctaaccctctcgtcgttgacaccatccaattttttctgcaaccaatggtgaaacatgtctcaggctgcttcctgtatttggaaaagccctccttgaaatttagctaaagaactctgtcatgtttacaaaaaaaggagaaaaaatatcacttgaaatgaaacgtccccattcctatctacttccaacctgaaattgaatattatgtcaaacacaagaggcccttaacatgcaaacactcataatcatcgctgctttacttcacccagtacatcttattatttgtgtttttatgtaatttggatgtgattaaaatgtgtacaaatattattgtaatgtagctaagtaggtgtttatgtgaaaacatatggtccagtgtggtgagtataagacctggttcaacaacacatgcttctaggtgtttaatgatatttgatggcatatacatttttttaaatctcagttttccaaatcattacctagattcaagaaggcagagatccagatgctttaccatattttctgcacctcattattaagttcacgtcttaactgttctttgtaagtaaactgtcatagaagaccttcagaattaaccagagaaagctttatgcccccctttttcaaagtttaaatagggatctaaaatcaaagcataccaaatacctattctctccaggccaatgcagagatcaataaaatcagccagtattctgtcaatgatcatctacatcattctctcatgaacttatgcacaactatatgagcttattattgatgtcttatattgtcataaacaatgtttgcagtaagagtcgcctaccatatgtaaacctacaattatgagttgtgcgtagaccttctctggaagtcaaaagatagtatttacggccgggcgcggtggctcacgcctgtaatcccagcactttgggaggccgaggcaggcggatcacgaggtcaggagatcgagaccatcctggctaacacggtgaaaccccgtctctactgaaaatacaaaaaattagccgggcgtggtggcgggcacctgtaatcccagctacttgggaggctgaggcaggagaatggcgtgaacccgggaggcggagcttgcagtgagcagagatcgcgccactgcactccagcctgggcgaaagagcgagactctgtctcaaaaaaaaaaaaaaaaaaaagatagtatttactttgttttatggagtaatcttttcggtaatttcgagaaagttatatatttttagtgaacctcattcttgcttactgtaaaatagaatcctgcccctgagctctatcaaaatcatcataaaatcaaagttgacaatgtgaaaatatattgttacttttgtcagtttatttcatctagttcacttgtttgtcactgctcttatttgctattcttgcacaaaaatttcatacttgtttctaagtgtatacatgcattctcattcagatagagatgtttgagtaccgtgaatcacataatttaaccctcttaatttttcagatgaagaaatgttgttcactgagaaaatttaagtggcaaacaaggctgcacatttaactagtggcagtccccaaactaaaactccaggcctctattcttttcactgacatccatgttcatttctcagaaaatatcacttactttgggaagcaatgaaagaaacgttgctaagatgtaaacacaaaataaagtgagaaataaacaaaaaataaaacaccgtgtttaaatattcagatggcatataatatgccccaactaagatattagaaaaatctaaaatgaagatcttctcctaaatatacatttatacaaggtttatatatatacatatatgtgtatatatattcagtataataataatcattattattattttgagacagagtctcactctgtcgccaggctggagtgcagtggcacaatgttggctcactgcaacctctggcttctgggttcaagcgattcttatgcctcagcctcccaagtagctgggacaacatgcgcacgccaccacccccagctgatttttgtattgttagtggagatggggtttcaacatgttggccaggatggtctcaatctcttgaccttgtgatccacctgccttggcttcccaaagtgttgggattacaggcatcagccaccgcgccaggttgtattcagtataattctaaagtcataatattgataaaataatttaattctaaaacaggctccttatgaattctttgtatacatgtttagtgacgacattaaaagaaaattgaataacttaaagagtcctcagaaagcacacagattttctaccttatttggcaagatccacagccctgaaggtgaccagcagctctgcagctatgatacggagagacaagttcttccgttgtttgttattaatttccccctcttcacagtgatgtaaaatatccaggcaactcagaacactatttattttttaatttttattttacgaatcacaaacactctgttaggatcctgcttacaatgatttaacatgcattgtcaggtctcactcttttaatgctttcaggaatttggcatctgcctttattaattccaagttgcaaaagcatatctcaaccatccacatcctcatcttctggagttcagtacataatgccaggatttttttttttttttaaaaaggatgtagagaaaaggaaacattcctaatgctcatttggagaaacatgtaaccagggcacacacttccatgttctgaagacattcaggagccagacggatactttagctacatgatgtttgaccaactgcatccttcgaagagactgtaaaattgcatttaagtctgacatcctcccagctaaagtgttgagtttatcaagtaaacaaaaataaatcaattacatttctacaaaattactgagtgcttctgggtggtgcgtggaggaatcagaatcaggctctcccccttttcacagaaaatctaagataatgtcaaagaaaaactaaggactgcaatttttccaaataatgccaaggaaacaaactagatagcatttttagtgtaggcatccattttattcattgacatttttgcatgcaagcttactttggggtcaaaagaagacagagaaaagataggaaccaaaacttaataggataaatgaatctgtctttatgttagcccttctctatgcctaaaatactttttactgtggcatctggcatgcttgcatgcattcattcgttcattcattctgttgctgttcatccacttattttcttgcagaattaacacttcagtagtgctgaatatagctctattgctgtgttcccttgagagcttccatctgaaatgaatgaatatcaaggccaaatttggaactacagggacagttttcagttattcactttatatattgactgaaccctgagtcaaggttcctaggtcattccatctaaatttagcttacttggatgtatttgaactggatgagttgtcatttcttctgaagacaaattctgacaagaccattagtgatgcatgatattttatgaaaataaaatgtttcaaaagtaaagattcaaactgtgaaatcctcagtagcctcaaggagctgtatttataattattttaattaaatttcacagtcaaggtatggaatataaaatgcatatgaatgcaaattgttgctagggaggttggactgtagcagaatatgttttgttgctttaatttttaattttctctcactaatttttcatgtgtttggaatgtcagatcaaatttttttttttacgttgtatctgactctgatatccttatgtgttgcttttctctccttaaaagcttttcaacttgtttttcatgggaactttatcttctagattatgaagatttttgttgctctgatcctctcttatttaaccctttttattctatgttagataactatgaaatagtaaaaaataaaggcaagtttaacatgaatttactgtttgtttttaatgtctcatgtggaacgagtttaaagaaaaatttcagtagcatttcaaaataaatttacaccgaacaaattgtcatgttaaggggaaacaatttagaatttatcctctttctacctaatgattaataccaggaaagactttaaacgcctgtaatctcagcactttgggaggctgaggctggtggatcccctgaggtcaggagttcgagaccaacctgaccaacatggcgaaaactcgtctctactaagaatacaaaaattagctgggtgtggtggtgggcacctgtaatcccagctactttgtgtgagactgtctgaaacaaacaaacaaacaacaacaaaataaaccctttaacctcaaatgcagagtattccaaagttgtgacactgtatctatttagtactgtctaataatagacacaattattatcatcatccaagagattttcttgtattggtttttacaaaacaataaataacacaaattttcattgtgagttgttgacaattatttagtgtagttgtagacccagatgttaaatgtttgatacaacagacatacttcttgaccttattgcttataatataatgagatatacagacttataggcagatgattataatactgtgcagtgagtgcaattattaggtaaatatgcacctgaactatatttagggaaccaggaaaggcttttgcaggaagggatgcctatgctaaaatttggaaacttggcagggattcgctagagtaatgagaaaagtcggcttgaagatggaagagcggggagggaaatggtgttctaaatagaaggaagagcctgacaaagtcctggattttaaagaaagcatgtgtttgaggagctgaacacagttcaaggcaagatgtcaagcaggacatactagaagttgattctgcagagatctgcagtgtgtggaaaatgaaggggctgataatgaagccatattaatgagtttggaatttaacctgctgacagagcagaactattgatggtggtcggttggccttgctaaacaggataatggcatgaggatgactctggcttccttgctgataagcggttgaaggacaaaacagggaaaacaagaaaaccagttaggaagtaataagttatccaaggaaggagccttcactaatggataattttcctggattaagagagagggttaaattaagactttttttttgtaaaaaaaaattattctggtaaaatatatacaacacaaaatttgcccttttagccttatttaagcatacaattcagtggcattgattacatttatgatgttgtacaatcatcgccactatttccaaaaggttttaatcaccccaaacaagaaatatttaaaagacatttaacataggacttggtgacttacgggatatagtgtggcagaagcagtaaaaaatgatgtcaaaggccacttgttattactctagctatcatggctttcaatttttttatttaatattttcttgaactttctgtgctgtcactgtcaacatttcaaatccatgtgtttttcaagtgtctttgtaaatctcctgtaggtggatttgctttttttctccaacagtacaaccgtagcatgtagtccatttatatttagtgaagtatggatatatttgaatatatttcatcatcttgtatgtgctttgatcttatttttgacttctagatattttgtagggtttgttttttgactttcttaagggcacagcaatttattggaacttatttctcacattttaccttatttgtggagtcttttaaagagaatattacttagcatatagctagcaagattctgccagttaagaaagtattcccatgtgtttttttttcttttcaattcattcattcattcattcattcatttattctttaagacggaatttcgctcttgtcacccaggctagagtgcaatggcatgatctcagctcactgcaaccaccgtctcccaggttcaagtgaatctcctgcctcagcctcctgagtagctgggattacaggaccccatcaccacacccagctatttttttttttttttgcatttttactagagatggggtttcaccctgttagccaggcgagtctcaaactcctgacctcaggtgatgcacacacctcggcctcccaaagtgctgggattacaggtgtgagccaccacgcccagccttttttcagtttatttttaatcttttgctgttcattggctcattctgtgtataagcatgttaaatttacccaaatatgaaaatagcctccccttggccctgaactcctctacaagcaactacctcatgattttatctctttatcctcaaattctttggaatataatttatacttgtttcatccttaccaccctttcaccataatctcttgcaggatgatttctatcccaaccacttaaatgaaatacctggctgagaaatcagtaatttagttataaggtagagactcaatgacattttttaacttctggtttttaattttaacctgtagcattttgaaaaatttccaacatgtcttgaatttaattattctcttcactttatttccaatactaagcttattttattgtaatacagttatttgtaccaccttagagcaatcttttgaagaacaagaaacacatattgggccaggagtggtggctcccacctgtaatcctagcactttgggaggcggaggcaggcggatcacctgaggtcaggagtttaagaccagcctggccaacatggtgaaaccccatctctactaaaaatacaaaatcagccgggcatggtggtaggtgcctgtagtcccagctactcgggaggctgaggaaggagaattgtttgaacccaggaagcggaggttgcagggagccaatatcacaccactgcactccagcctgggcaacagagcaagactccatctcaaaaaaaaaaaaaaaaaaaaaaagaagaaacacatattgctcattttttatgtcttccataggcattacattgttcttaaaacataagatttcagtgtgtgtgtgtttaataaataatcatctgaaaaagaaaatataataaaatgctttatatgaatgtattaatatgatatagcctagtattattagattttattaaaatgcagacaaaataggaatttagctaaattttagaggctaaatttgtggaagagaaatacagaaatctgtagatccaagtgaacacgtggacttactgaaaatttcttctatgacatttttcataacttaagcttgattaggaaacatttttaataccttgagttatttctattatttattactactattgtactgaagcctatgtcatagatcatttccatacatatctcacttttatggcggcagaaattttagcatttatgtatatacccctagagcacaatgccttgaaaataattgttggcttgcatttatattactttatttattacaattacttaaattattaattaatgaaagtattatatacatataatacatatgtgtgtatatatatacacactatatacaaatacacactatatatattacatatatataaatatatatattacatatatataaatatatatataacatatatatatatatatatatatatatatatgcacacacacacatgtatttatgagtactctgtaaagaataattcctggtccctctgtggcatttaaaagtataattcatcaactaaataattagttgccttaatatgagtttattccaactagctgtctaatttgttgaactgtgccgacttagagctctgttgattggagttacagggtagttgtgaacataaacttgccatttggattgtttactctactaactgctccaaatctgcatgatcactaaagggctactaaggcagttttttatttagcagcttatttcttttacaccagtgtaacctcttgcttttgaagactgcaaagccctaggttcttgcagactctttctgagaacagtataggccaaaaatgaaagacggtgtgggattcttgaaggcagactatccttttgaaactgagacttctaacaaccaattccaagagggaaattaggtcagtaacctaattatctatgacaaaacaagttcaaaagaattgctgtgttggaccatactcagacttgatgactcactaaaaagacacacaagactcagaagtccttatagtcatagttttgatttttttttcaacaagaagatacaaagcagtaacagtaaaggggaaagccacatgaggtgtagtctgaaggacataggtgcaagtatccaagtcctctctcagcagtctcacaggacaaaattgattcctccggtaagttgggatagcatgtgcaaagtgttgcctgcctaggaagcccatctgagcctatgtacatagtgtctacataactgatttcagtcactgaagctatagacttccagaagaaaagcaattgttgaccataaatcccactgtttgtttaaactatcttgacataatggtatagtatggataaaggtctcaattccaataactcagtttccaagaactggccaaagaccagtcatgaaattaggtccttgggaatgtgcaggatttgaggacatcaagtctgctcagctaactcattcctgaacaacagcattttttttttccatattctaaagcctaagaaaatctctgtcttcccaggagcaacctagtcttctcaaatcccagaaccactccccttacatgaagccttctaaagaggttctgagcattttgttttgttttggtttgctttcacaaaaatttactaaacctagattgtatgatttagtaattaaaaattctgataagaacatttggattatcttatagctgaggtttcaatgatagaaatgttttaagagattgcacctacgaggcacaacacaacttgcctaagagagctccaggaatattatgggctggatagatctctttcatggttgtattacctagggtaaaactagactactttaacaaggagacccaacaacaatggacttggaaaagaagagtatatgtctctcttgtgttacatttgaagtgagtggttaggtctgtgggtgaatttgccttacgaagtcattccagaatgaagtttccttcctttgttttgtgccatcattcaataaattgccatcttctccatagccaaaactacatcatcatgagttctggatggcaggaaggggagagagtacaggaggtatatcactgtcttggggaccaggtctggaagttgtaagcatcactttcaactccctccactgaggaaacataatcgcatgaatatacttaacattaatagaggacagaatatgtagcttacctacgtgctcaaaaagaagagaagaatgtatcatgagtcaaccttcagtctctacctcatgtaagatacatattatttgaccacaaattaataaattgcatgttaactaaaagatcataaagcggtattaacccattagttttcaatgtaaatcagtaacaaaacaggaattactttacaggaattcacttcaaggtaaactttttgagaacatttcttttggataaaaaataaaaggatctctacatttctttgaaatgtatttagggatttacatgtgagaagtatttattcagaaatcagtatctatctaaatgtagaagtggtttaacataatatttgtaaatactcaataaatgttaaaaatataaggctacacaaataaaataaaagacatagataataagcagtctttgtgaattaacaaaccaaatggcttttaaaaacagaactctcacaccttgccctgtctgggcacctagaactttctaaattttattttttcaagttaaccctcttaaaagtggcagattaaacaaagcacactgaaactatgcaattgcgtagattaatttcagacccagttttaacttcttgtactattgtttctcaaactgagtgaaaaattgcctgaaaatgacgtttgatttttgtcaggaaaatcactttttaatgagcatttatatagtgtattaaaagtccaacacttcaaaggaattttatttcagtattgttgtttatgaggtgcttacaacatagatgatgtccattactaagtgcttttattttatacatatttttcaacatttcacatatagatttttccggacaatacaaatggctgtgttttctcattaatatacaagcttttcttttgatcttgaaagtatagcaaggagtgcattttgtggaatcttgctgactcttcattaaggaatttgagggcaatttaggcataaagtattctggagctttcagcagtcactgaatgtcaaccagatcccagggtcccattacatctcccagacgaattgctgaattattgaacacacgtgaacactatgcaatcttgattagagaattgttaatcaacccatcatgatatataagtcaaaaaccaattagaaatctgtgattggaatgtatgatgaagaaacaattaattgcctagtttaagaaaaaagggaaaggcaatcatagtgaattatttgctctttcctgtactccacaaattcttgtaatcattaattctccaatattactagatttataaatttttaaaaatggtttgtgataaaaagtatattcatctccaagcaaatactttacttgtcactacagcttatttaaaataccattgttccagccctcatcctggattttattgttttcttcccctaaaataaattatgtatgatgttttaggaaggctttgaagttcaatcatttttggcaaaagagtagtactttgcaaatagttaaattagaattctgtctgtagtttatccctttgaaacatttctgcatcagagagatctgaaaaataaatgagcagccgtattcactagttttttttttttttttatttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaacgtattcactagttttacaaaaatacacggttaggacaccaagggaaaaaaaaagtttgcctggatttttttttaaggattaagataggactggaaaaaaaagaaaatataatattaggttattaatcagtaatataaaagagctagaaactcaagtaaatgctatctgatgtgaaaacaaaaaggaggaaactgcaacttttaattcaagaaggaagaagttttaaaaataaaaattttcaaagctattttaagaaggtattaaaccttttagttacttggtctgggaccctaacttggaccaaccattactcttttcttttatctttcttttttttattattattatgctttaagttctagggtacatgtacacaacgtgcaggtttgttacatatgtatacatgtgccatgttggtgtgctgcacccattaactcgtcatttacattaggtatttctcctaatgctacccctttcccttcccccaactccacgacaggccccggtgtgtgatgttccccaccctttgtccaagtgttctcattgttcaattcccacctatgagtgagaccatgtggtgtttggttttctgtctttgcaatagtttgcccagaatgatggttcccagcttcatccatgtccctacaaaggacatgaactcatccttttttatggctgcatagtgttccatggtgtatatgtgccacattttcttaatccagtctatcatttgtggacatttgggttggttccaaatctttgctattgtgaatagtgctgcaataaacatactcttttcttatatttttataaacttgtagaatgaggatgaggttttctgctgcaaagtgctcaggtctacaatgtcctttccatattttttagagtatgacagttcttattaactattaggatctggtgtccacatcctacatatttaatactgcctctgtttgtttatttgaagggtgatattacaaggggattatcttactttgcttttcttccctttgttttattttgggggagttttttttcactttcctcaagaatggtatgactgccgtcttgaccatgaagaaatcctaagtctggtagtacggtacaatgtaaatatcacttgcaaatactttataagcaattactccacatgcgctttgccccattcaaagttttgactttgggaggttgtttaaattttcattttttaaatattgctgttatatttttagaatttctgtcaaatcttaagggaaaatatattttgaataattataatcattaacaaatatttttgactttgtatgtagatttgatgttctgaaacttccaaagttttaatggccatatccagctatgtggaaaatgtatctggataataatagtttgagcaagaccacaaatctaataagatttggtaaaaagagaaattgggcaacttttttgtcctttgaaaataaagtaatatgagaaaaaatgtaaagctctctttcctgttttaccctactcttccccaagaccagctcaattacttttaatgattgtgctctggagaagagcaacatattcaggctcattatctactagtggcaacttcaattctgcttacgatggctggcattagagaaataataatttctatttaggaagaagacttttgtttaacatattgcctatattctagtctccctaagagaatggaaaacgacagaaaaaaaaaatttcaatctcagacataaaaataagaacagactttttttccttctccctctaatggaagagactgataataaggcagaaaattttctatttcagtccaacacagtagagcctcaaattgtctatgaaattgtgtgtagttatttaaattcattaaagtttttatccattttaattgataaataaaattatatatattttgtacattatgttttcaaatatgtaaacattgtggaatggctaaattgagctgatttaatgtatgcatttcatcacatacttactattttttgtggtgacaacacttaaaatgcacccttttaccaattatcaagacttcagttgacccttgaacaacatgggtttgaattctgcaggcgctttacacgcagattctcttccacctctgcctgccctgagacatcaagaccaacacctcctctttctcttcagcctaatcaacaagaagataatgaggatgaagacctttataactatctacttccacttaatgaatagtaaatatatttccttatgattttcttaataacattttcttttctctagcttactttattgtaagaacactgtagatactgtatataatacatataacatacaaaatatgtgttcatcgaccatttatgttattggtaaggcttcttgtcaacagtaggctattagtaaggctattagttaagtttggagagagtcaaaaattatatttggattttcagctgcatggatggctagcacctccaactcttacattcttcgagggtcaactgtacgttgttattaactgttaattgtgcacagtcctttccaagagctgtgaagctttacttatctaaaagcacttagccatgtatttgaccaactgagcttggaatatgctacttcttcctccacccattgctcttgtctaggagtactttattgtctataaaacagtatcctataatggtaggcaatcctaagacacagttctagccttattagtttaaaatctgaaattgtccccctttgtatacagaggatttttaaacttaaatgcatgtaaggggaaaatttgtaatataaatgcattattttggcccagatataatagggagtggaagaagtatccaatataaagaaagaatgctccaattaatattcaaattcatcttaaagtagaaaagcattcacctatccctgtgtgtatacatgtttgcatgtgcggaatctgagctgtgttcctgcccgtgactccacctttgaagatgttgtatagagttatccaatcactcatttgtttgttatacacaattgtcatgatcttcatatcttagctctgtgcacactgcctagactattttttccattcttttctgtgctccaaccatagtgtatagggggcaactgtgctattctaaatatataacctaacttatgcctctgtgaatttgcttctgaattctctttgtcatgaatatcctttcttaccttgtctgtttttcctgtcttgaaaaactgttattgttttatttaattggcaaaatctcctatatgcagttttccccaattcttcccccaaccctcaaaatgttagctatttactcctctttgcaggtgattctgtgcataaatctgtgttgtcatactacattctagcttatcgtttgtatttgaatattggtatcttccagcaacttgggtacgaaggaatgtgccaaatctttgaaaccctaggaacaataaaaatgcttagcatatagtaggtatttaataagtgtatcaggatgagggaataaaggaaaaaagaagagagggtgaatgagagggggttggttggggaatacataggtgatgacacttattaccttagataagttactacctcctttcttttcagttttttgaaggaaaaataatacctgtctagcaggtttgttctaagattctaaagaaaagtaaaaggaaaacactggaaatggccagatagtttacttcactagataaaactttatctaaccttcatttactattcaatgtgtaagcaaaaaatagagtgctttgtgatgaggccagttaacgtaatggacctgaaccagtgccaataatgagttttatgctcctgctgtgttgaccagctttcatgcatgaaaaccttatgaggcacaagcagctaatcttaaaatgcattttgttgatgcttttaagtaagaaaaacataagaatcacaccagttaatatatatcaagacccaagttgtattaaaattgaagttcaggccggcatgttggctcacacctgtaatcccagcacttttgggaggcccaggtgggtggatcacaaggtcaggagttcgagatcagtctggccaatatggtgaaatcccgtctctactaaaaatacaaaaattagccaggcatggtggcatgtgcctgtaatcccagctcctctggaggctgaggcaggagaatagcttgaacttgtgaggtggacattgtggtgagcctagatcatgccactgcactccagtctgagcaacagagcgagactccatctcaaaaaaaaaaaaaaaaaaaaaaaaatgaagttcaatgtacacagccttaacatttccttaaagttgaactttgtgttcaaagattttttaaaaagagagatttctattgaactttgaactgactataataaataccaggtaaaataaacactttctgggttcatcattattatggatatttgattatctagagaacaactattttgtgaatggaaataaataggaatattttattttatcctagtagagttaatctagagagttcattcattgcttcagaacaatttcacaaacttaatgtatcatagatctcaaaattttcctaatgacatattgataatagtttataaatgttctaatttcagctaggaggagtatcaaagaaatgcgctccagtcagcttttaaaatatcttgatgacacttccaaggtaccatatagtacctcaatttctttagtctcacaaaaggaaagtgtcgcactgaggcagcttatgcacacttcactttcacaaatctaggaacagcattcagcatttctgaaaggaaaaattaagattaatctctttattagtctgttttcatactgctataaagaactgccggagactaggtaatttataaagaaagagatttaattgactcatagttcagcatggctggggaagcctcaagaaatttaacaatcttggtggaaggtgaaggggaagcaggcactttcctcacagggtggcaggaaggagaattgccaagtgaaggaggaagagccccttagaaaaccatccgatttcatgggaactcactcactatcacccccatgattcaattacctccacctggtctctcccattgacacatgggggaaaatatggggatttacaattcgagatgatatctgagtggggacaaaaaggctaaccatatcaatctcaatacatattttttttttttttttgcttaatctaggtagatttctctgcttagtgatcaactacaatatgtcctatgtggtacattataatcatgaaagttcctgggcagttcagatatataagagatatgaggatatctaaaataattttatgaccataataaaatcacatttggcttctgaagcaataactgtggtatggcaaataggtttaattcttataaaccaggtatatttaaaatatagttataaccaatgaatagaatgtaactaatataattaattgcatcagacttatctcagtaagaggtacaaagaaaaagaggactttcacttccatggacttaggctgtaatcccaggaccggatgactctttgagaatcaggcatcttccatactttttctttccctttgtctgaaaatgactgctgagattccacttgacaaccaatatctttactatcaccatgtcagaaaatggatccttaaggctaaaagataagccatatttaaattccagtaacataatgtattcaaagtattttctctgatgaaaattcaccttcaaaaatctatagttttgttgtcaaatgtctataaaatggaatctgttagtagtcctcaagagttttttcatatttatcagcgcacttgcctttccctttgcaaatgactgtttaatgctcaggactatgtcctagttacaggatttattccaaacacttatttaatgaattttgaagtgaacattttaattgttattaaaatactaaaaatattctctcttttcttttaaaaagatttctctttcaggcaattgaactaagaaagtatttctagtacagaaagacatggttttggtgaatattttatagcagtgtataaaacaggatgttcctactatttttactgccatacgattccaaatgttttagagcttaagttttacaaaagtttcaaagaatcaaccatgaaaattgcatggtaggcttatttgcattgcgtaccagggagaatatttttagctcagagctattttagacatgacttggtaaaaatgaactctcttactactccaagagtatgcatacatttctacaataaataatgaaggatgaaaaggtatgaaaaatattactgcagttggaattaggtcttttctccaagttctttgaagggaggttaatgtgcaaaagggcatccctattcatggcaatctgaatgctgataaataatacataatgctagcgattattacctaatttcaatatttattgaaaactgtcatttcagagcaatcaaagcacatcacgaattgtgctgctatctacatttgtgtaaatgttccataaatattgagtttcagtcattatcattagtataatttattattaacttcttggagacttgaatccacatggaaaatgattcaaatcttaacattatcttcttctgtatctattatattctttatacatatgatataaataaaggaataagttattcagtgaggccagtaaagcatattttatggagagggctatttctgagaaaaactataacatcacaaaacttgtttttgataccatcacatttccacagttagtgttatttcttggcaacttttgcatcaaagacaaacatacacaacttcctttggaatttcaggactcttatgttgttctcatagtgctcacattgcactatagagatgctggtagtcaaaatgtgcattcattctcccaacagaattcacctttctaataagtgaaaaaacaatattgcctgttctgtgccagacattatgacaggaacagggttatattacaaaaatgatactcaaataagatatttgtaaagttctttgtcctataatatttcatagtctagtgcaaaagatggatatgtaattaatgcacactataataaaaataacataacaaatgacatttatttttcaggaacccttttaaacaccttacatgtattaatccttataacactcctagtaggcactgtcaatatgcccattttataaatgaagaaactacagtgcaaagcaattaagtgcaaatgggttattgccaaggaagaggacatctaactttacctaaatgatcgagactttgattaaggaaggctttatagaagcaatacgcctgaattaaacttccaaaatgattaggtttgcaatgataaggaaaaaaataatcaaacagggactgtgttcgcaatatatgaagtatagaaaaaatagcaagatatcatctctacattatatatataatttatatataatatatatataaattatataatatatattttatatataaaaatatataatgtatataataaatatttatataatataatatatttatatataaatatataatatatttatatataaatatattatattatatataaatatatattatattatatataaatatgatatatatttatatataaatatatatatttatatataaatatgtattatataatttatatataaatatgtaatatataatttatatataaaatataatatataatttatatataaaatataatatataatttatatacaataatatatataatatataatattttatatatcattttattatatttattttattattttatttattatattttataaatattaaatatataatatttatatattttattatatatattttatataatatatatattatatatatataaaatcagggcatggtggtacatgcgtatagaaccaggtactcagaaggctgaggcaggaggctcacttgagcacggaggtcaaggctgcagtgagataggatggtgccactgcactcccacctgggtaaaagagtgaaatcctgtctctaaaaaaattcttttaaaataaaaatgaaaacaaaacaaaaaaccaaaaagtgaaaaagtcacacagatgtgagaatatatgtcagatttggaaagtaccaagtcagtattcagtatgcctagaatttaagactgaatgggaaaagaaggaatgaagccagaaaattatcagcttatgaagggttctgcatgcctttctaagaagaatgattttatgcaagaatttttaagatatttagcaaaagaatgaatctccaccctatcaactctcactcaccaaatataatttatttttgtccctttttttgctatggctctccttgtctaataccattaaaaataattgaatgtaaatgaccatatcttaatgaagtttaaatatctttgaaaaataatactttggtatatttgaagatcacaaagcctttaagtttctaacacagatgtttctagatttataatgtggttacttcccaacaaatctgttgtaaaacaaaaatatcctaagttgaaaatgcatttaataccccgaaaaagccattgtaaaaatgaaatgtggtaagttgaaccattttaagtccagatgctcctccactgaggatggaattatgtcctgataaatctatcataaaagtcaaaaaatcctaattcaaaccagagtaagttggagatcatctgtattgacatttcaggtcacttggcagagttgtgagctgcttttgggcagagaaaaccatccgcttactacagtgaataattcaaatggttggttacaagaaagttaggagagtagcaaattaggggcctctggattcaatgtctatgtctgtcactcacttgttgcaagtaatttagcttctcttagctcctctagtcaaccattttctcaacaatgtaatgggtaggaggagagacactgagaatcaaggttatttcaaattctttttcaaattcttacttcttcattctatgatactaatcttgacctattcaaaaagcaagttcgaattgcagatctagatttctctagaaacatcttttacaaaatagtgttaactctccagaagggaaacatattgatgtaagcagctgaaacttttgtataagttccaaacatttaacaggagatattttgttaaatatagaaagcaaaatgacaaaacagtaatgcttttctccttaaaagggtcgtataattaaatctgtaagaatagtcttatgcatatgattacctccatttcacgtttaaggaagcagagtcacataattgaaatgacttttcaaacatcacatatttcagcagtggtggagccagacgctaagcctctgttttctcattcaaagtccactgcttcctttaccatagcagttgttcttatgttgacaattaaggcttagcattatagacaatttcacaagcaataggaatattttatttcaaatagtgctagaaagataatagacataaaatcaaatgtgttaatcacttaaaccacaaaaagagaagcttgcgtttccagaagtatggaaaatgcaaacctgtcaatgtgcccccatttctatagaacatgtggtttagcaggattactgggagggaacatacacagtgacgacaaaaggagcttgcccttggaattttcctgtttatttgaatttacaacaaaagttgatctttcattggcattaagaagttatatagccttcctgaaccggcttttaaaataaacatctagagtaaaattaccaaattgtgttctttagatgttaaaaaatacagcaaatccagtaaaatagacttcttatggtcttaaatatgccaattaatatttcagtttaagtctccaagaaggggtataaaggctatgagcaatgcaacatttcccaaacttttttgaccaataaaacttcccctaccaggctgggcgcggtggctcaagtctgtaatcccagcactttgggaggccgaggcgggtggatcacgaggtcaggagatcgagaccatcctggctaacaggtgaaaccccgtctctactaaaagtacaaaaaaattagccgggcatagtggcaggtgcctgtagtcccagctacttgggaggctgaggcaggagaatggcgtgaacccgggaggcagagctggcagtgagccgagatcgcgccactgcactccagcctgggtgacagagcgagactccgtctcaaaaaatcaaacaaacaaacaaacaaaaaacttcccctaccaacaacacctacatccaaaaagcatgtaaagcaaatgaaaaggctgataaaaataaggatttatatttttccccagtaaaatagaataatctagagggatagtgagataaaatttaagttttctcaagaagacttaatatgttgataccaccagggcattttaatataaaaatttatgtttgtgcttccactatagaaacacaaagagagttttcaatattttagtcttttgccaatgtatagtaatctgaagtggcatcttgaaatcaaatatgcttatttaataagactatagcataccttggaggtatgtaataaagtgtggaaaagtctggatgtgtagagaagttatggaggacataactggtaaatgtgaaacagattgtacagcgatttatgaatactacaaaatacttctggtatccaaatactgaataaaattagcaaggaagtattatgtaacattgttcttcctattttactataatatattttaggaaccgtgttgttacactaccacaatctggatacatccaattgctgataatattggacatatttatacaaaggattacaatattttattgctcaaatgtccaactttaaagatgggcattttatgagaaacatgatgtaaaaggaaaatgctgtaacataggattatctcttgtgaaacttcatgtatgaaataatagagcttcaaaatgcgtaaagcaagaactgcattaactgtagaaacaacaaatgggcaaagatagacccaaatgatgctaaagattttcttaaaccctctctaaggccgtgaaagataaaatacacaaaatattcataaaaataaggaaaaaataaaaaatattgaatataatacatacatataaacatatacactgatgtttcattatattaaaaagcgaccattacttcaaatgttgtgggatatttaaataaatcagacaataaatttgaaaatagaaaaagaacacatgtaatgctgttgcgcttagaaaatgatacccaatgcatggtcatttggcttgctgagtactttgccctgaaggactttggaacatctctgaagcagccttagaaccaagttactccttcctcaaagattctatcagaggttgtccgctgtaacgtcttctacctgatcccctcacaacaagtattgccacctagaaatcatgctctgtgtagaagctagtggtatcataataaacagcaatcaacaatccagcattcagttcctttagctcttctttccattctgaatctccttttattcatcaaaacacccacattttactatagatttctgctctactagctatcaatcagtttaatctttctcccttctgctattttccagggttttaattccttacatttgcttacttcttttttcaccaggaagctcctagttccatctgtaactaaatttcttacctgagtctcttaactgccactctattccctaccttgtgtaattctcacaaaagattcatttcacttgatatgtatttatgatttttttctctttgtaggtgtcagacatatgttattcactattgcattaatattaatgataatgcaaaaattttactgttatttcagggaaattttataaattgcaatgactggtagtaacataacaatgaatataattactacacttttcaagagtttacaaaatttatactcatactataggtgttacatacttacaggattttattcttttttcttctttttttattatactttaagtttcaaggtacatgtgcacaacgtgcaggtttgttacatatgtatacatgtgccatgttggtgtgctgcacccgttaagacaccaccctcatttttggcaatagctaaaagatagctaaaaggaagtaacacctaatgcttcagttatgtgcagctcttaagtactctttctatggtaattgccatatgaaattaataaaaacttgtcatgcaaatggtgcaccagtgaaactaagaacagtagctagactttgcatccttttcttccccagttgatttttactaagtaacctataaaaaataagggaaattttcttggatatcttaagtacatagttatttgcacagatgactctgtaagattttattgacatatgtctttcaggccaaactaacgtagtattattttcctacaattggttgtcataaataatctgatcactgacaatatgacatattattacaaggaaaactagaaaaaagtagtatttaggttaatttgacttctgctccccaaatgcttaacttcagtcactctttatgatctgagatactacagaagattacaaagtatatagttaactcctcctaatactaatgatgggcaaaaggtaagtagatacacctgtgattaaaaacacagtaagatacaccatgggtaaggagatataccagtgattaaaggacattttaattctttcttcacttttattctaaagattttcataagaaatgtttgctgatttcaactcacatattaatagacatgttgctgacaagttgaataacttcaaattaggttgtaagaaaatgtttaaaaaatgttaaaaaaaaaaaaaaaaagcactgtgactaaatgaagtttaatattcatgccctaatgattagattgaccactaacatgacatagacatagagtgtcatgtgaaataaagatggatcatattaggcaatgtgtatgtccctataaagtattaatctcttatcacattaataagagtctcactatctattatggtattaagacattgaagtaaaacaattgaagaatttattaagttaactttctatattgactcacatgttcagtaaccaaaaataaatttagtcacatctatattaaaaagtagtttgctaaatcacaactgtcactttataatagcaaatgcaaaagtaattgcagaataatgagcgttaattttctcaaagctaaattactcactttgtgtttaaaataataaagaaaatacttaaggggcttcttttcaaacaattgtgttttaccatatcaataaacacattatcatttatgcatggagataattttctgagaaataagagtcaagattagttctaacaaattaataatcactaatgtgtttatttttaaaatggcatatttaatttttatgtcacattgcatttcttcatagccttgataacttcatttttattatgaaaggcttcatattgcatgcactgaaatgcatttattatttaaaatagaagagcaaattttaaagtaacatttgttgtataagcaattttatgaagtaactcgccaattattcttaggttaacacactctttgcaaagatcgcatatacgtctttaaaatcaactaatttaatcaaatccatttaaattcaagtaacatgcattttctaaacactgaagagtacaaagatgataagatttttctcttaaataatttcagtttgatagtacagattaaccatatttataaaattctaaaatgaaagataaaataattgctattaatgataaaaaatgattgtgaaacatccagatgagatgtaggagagattctagacaaatagctgattgatctttcatttgaagtatgaccagggttggttggtagtcaggaaagtatatttaaaacaaagaaaaacaacaagaattttttttatttctaggaaaagcaaaagttataccaaagtgaaaaggaaataatatactaactgaaacaaacaatatttgctagttaagattatgctaaaactgatttattgaatcacttgaatactgtttaaccatatcactaatctacaatcagaggacagtatataatgctaaaataaataagtcaagatgtcacaacaatcacttttctttagaaagacggttataaagatcagaaaaatagctatcagagttagtattattatcctcgggagcataatggtttagaggatgaacaatgatcactttttattattaatcttccataccacttaatctttttaattttttaaatgcatgtatacttttattaaaattttacataacagagaataattgaagaaataagtggcggaaagaaaaagattacacaactagaaactcaagaaaaaactttcagaaaaatatctaatacaaagaaaagaataaagaaaattaaagaggcaaaaaacaaaatatttagaggatcaatccaggttgttcatcatttgataaggggagttccacaattatcaaataagtaatgcagctggcctaaaaagaagcatcttaggtaacacacatcagagttctccaggaaggagaccttcagaaattccaccaggttttttgtttctcgttttacattttgtaatataaagtcactgatgatgctcatatagaagtaattcctaaagtgacttaaagattaaaatattaaaacaattaaaataatttcataagataaaactagaaatactaccaaaagctactatttcaagtatttgacaaagcaaagcagctgaaactgatggctaaatgaattaccagtgtcagtagttgggaagatttttagagtgtgggaaacttaaccgtgagtgtaggcagagtgtgggaagtcagggaagggagaatacaaatttacaatatattagtgtaaatgttacactttattgaaggaatgggactcattatagaggaaattacaagaaggctttctcttcccatatcactatctttaaacaggtctgtggacttactttatcccaattcaagaagaaatctcaggtaaatagtatagctgtctttgttgtgctcaggcatgaatttatagtgttattttgaaagactaaatattccaatccagtcttgtaaatcaaaacacagtcaatgtaaaattctcatttcaccattttgtctttattgagtctgggaaacctacagtgggaagctggggtgaggtcaacatctctttctcttgcctcttcttaagtcacactcactggctactgcttgggcccagggagtgaagttgtaagaatgagaaaagataacgttttatgtaagcagagttgtcatcagacaatgttatcctctggctgaggcaactgtccaaaaccaactctgccattggccatgtgaggtcctgggaaacccacccctgatggtacccaccacagcctccactcccatcctcagcccccatatctggcaagatgcttatgaattggcctcaagccttagctgccagaggtcgtgcctctgttacagttatctccagtcatctccttgggtaaaattccttttagtaaagataaattcaaccatattttttctgcgaggccaacatctagcccacagaaaacgtgactgaacttttgcccagacttctggagatactgaagcatttcactcctaaggaaatatttcttggccaagcacagtagctcacacctgtaatcccagcactttgggaggacaaagtgggggatcacctgtggtcaagagctcaagaccagcctggccaacatggtggaacccctgtctctactaaaattcccaaattagttgggtgtggtggcgggcgcttgtaatcccagctacatgggggctgaggcatgggaattgcttgaacccaggatgccgaggttgcagtgaactgagatcgcaccattacactccggcctgggcaacagagaaagaccctgtcactaaataaataaataaatatttctgcactctccagctcaagccagtctctggcctttaagctttgaaagcatgaatcaggtccaagtccctacatattactcaactacaacaacaaaaacaacaataataataataataatagaacatacaccaagctctctgtgtatcttcctgaaagctcccctcgactaatgctttcagtaccttctcattccccctccatgtccattctctatctggttccaacccttcctgtttgcccgtgggatggtttgccacagcttccagccctctggctctggttctgtctagcaccatcagcagaagaaagtatggaggaaatagtagctgaggcattggttattctgaccctgtccctgccaggctctgggttagcagtggcgctgttcctgtcctgaagacccagctcctcctggaggtctgtcctcagctacatcgccacaggtctgggttctgaaacctccatttctgtttccctctttaggttcagggatggttatagttgctctgttgctcacaccagatgctgcacgctccatttttgttttccctcaacctttctacaactttataaatagttcccctattaaaatgttgttattaaaactctgagtgtgttatctgttccctactaggacctcgaatgttgtgcctggattaacacgagatgaggcaccctactctcctatgctactctctaacattttgtactattccattgattgattttttttttttctttgagacaggttctcactctgtcactcaggctggagtgctgtggtgcagtctcagctccactgtagtcttgaactcttgggctcaggcagtcctccttccttagtcttctgagtagctgggattactggcatgagccaccatgcctggcccttactaatccacgataatatgccaactactctttttaaaaaatcatcatcagtgtcttatcaaatttaatgagaaattatactcttatctaacctgaaagtagacgatgggccaatgctggaagagccagttttataactctaaaaacacttggcagaagtgagttagcacctcagcgagaatgtggcaaaaaagagaaaataatgaggtctgagggaagaagaaaggaatgaaatgttcaggcaggaaaatgaggagaaatattttttcctctgagataacagaaaagtaaaaagttatattttttttactttggtcccagctactagggaggctgtggtgggaggatggcttgagcctgggaggcgggggttgcagtgagctgagattgcaccaatgcactccagcctgggtgacagagtgagattctatctcaaaaaaaaaaaagaaaagtgaaaagttatatgaacagggacagaaaaaatgtttaggtaaagagcaagactgcagaaagactcaatgttgtcagtaaaagagtgaagtggttgcacggctcatctgctccatgtgagaagggattgcaatgaagacttgggagagttaaatatttttggaacataggctgctatagtcaactagaggtgaaggaagaaattgctgaacagctgtgagggctgtagaagtctctcgccctacagtatcaccacttccaaacacctgcacatgcttcacagccttctctcatacactgcattttaaaatcaaaagtgatttttagataacaagtaattcttacattattaaaatgagagaaaaaagctagtttattattaacaattcttgaatcaaagtttcctttgtctgcaagttacgttagtggattgttacggcaaatcttgaagttgtttttctttagtaaggatcaagctatattttcagatgtgagataaaactgttgctgaaatgaacattataagaaatgttgcataactaaacatctaaaaatagttttcaaattaaaaaaaaaaccagtgaaatagttgcttctgagcatagtaaatttttcaggaatgcaattattcttagtcatttcccttagaaagtctactgatagtgtctatttatttatttatttatttattttgagacagagttttgctcttgcccaggccggagtgcagtggcgcgatctcgactcactgcaacctctgcctcccgggttcaagcgattctcctgtcttagcctcccaagtagctggcattacaggtgcctaccaccatgctcggctaattttttttttttctatttttagtagagacggcgtttccccacgttggccaggctggtaatttttttttttttagatgaagtcttgctctgttgcccagggtggagtgcagtggctcaatcttggctcactgcaacctccgcatgttcaagcgatcctcctgccttggcccccctagtagctgagataacaggcacgtgccaccatgccctgctaatttttgtatttttattagagacggggttttgccctgttggccaggctggtctcaaactcctgatctcagatgatccagctgcctcggcctcccaaaatgctggtattacaggcatgagccactgcgcccagcctgttcaaatttaaatctagtgaaaaatgtccttgaatctaggcaaaccctttaatggaaacttttccaaacgtttacttctgccatgtccattcacacatttttcagtatgatgcatatataaaactgtgaatattctgagattttacccttcttgcaagttatccaaccacagatttatgaatgatggcagaagatgagacagttctctcacaacaataacaggagacagaataccagcatgttttgcattggttctctaagccccactttacccaattcagtatgaagatggtcagatggcacatgctgacacaatgagtttgattacaggaaagaaactctaagcttagggaacccacagcttttataacaggaggtacacctgcttcttctctgcggggagacataacacaatctctaaggctctaagccaacttggtctttgttctggagaaatacacttggctttccagggcttactatgcaaatatccttcacgaggtagtctaaagggcagtcagtgtccctacttgtaagatgtgcagaattgcaaggaacacatgaatacaatagcatgtacttatatttaacataaatttagattcacaatccccaggatttaaatccctgaatttctatctaatccagagcttgctttttattattgctgtattatatccagaaaaaattaaccttctgataggaagcttctatttctgagattctgtgtcagtgtgattttgacaatataatgttgtccactgcgaatttacattaatttgggtatataatctgtggtattattttgaatacaagtttactaatacaaggtatttaaaatgttcattgataggaattcacatattaaattagtttctttgattttcataactcagattctatagttatatgtccagaaaaagtatgcataatactgtaaaatttacatcaattgggatatatgactattttggtcatttaaaaaatgttgcagaggaccaccaggaaattgttactgactatataacatctgagttgaaaactgattaatgatgaaatacttttaggaaatagctatattaataagttgcacattttaatgtatagcgtgaactcaagaaagatgatacaggtcaaagatagaaactttgggctatcaatgtggagttcagtggaaaagaacaagtaaatttgtcctggtgcaatttgctgctgagccttctgccagcttccccctactcaactaacgaagaccttttaggacttgggaggatattcttagtgaacataattcagctgctcccagctttaagaagaaaaactctacttccttcagcagtctgttccttgaagtaattgctacttgccttttttcatcctaggagtggttaaaacccaaaagtcaaaattaagtgtaggcataggacacattatctaagcttttggtccaagggacagaggcatccttgagactcaaaggtgatgtcaccaagtatgccagagtgaggtggtcacatgggtcaaagccttaattaaaactgtctccttgttcattgtgtcctcactatgtaactttttcaggagcctgtgacagccataggaaccagatcaaagattcccaagacctgctaatacttttccatctcattgcaatgaaaatgtctcctgctttaatcataaccataccagttcaatcaattgaagtaaatcatttattttgaattgtattttacaattatataataactttttctatacttacaatactcagattatatagtaatacttctgatgaagctaaaaataatttaaagagaacaaatgcagaactataatctcctgggaggaaaatattattaatttcattgaaaatattaggtttgaagggggattctcattcctcaggaacccaaacagagcagtcaaggaaggatatggatctcatgttccaagagactcatgcggtggggaggctcttgacttggcagcatggaattttaaggggatagagacgaacacagtctagaggtgagagggcaagagggcactcatgtgctatgagggagttttaaatgtggagggaatatgagcattggcatgtgtggtgaacgttggggatagaaagagatgtctaaagaggattgtaagcaggtgcactgggtgctgtcttatggaggcctcattgctgctttctcaagagatctttcgtaaagaactgtctacattttgagtctctttttagagcctcatgtacttttgcaagggatgctaatttaatgctgggttggattaaaggtggcccagcttagacaagaacttagaagttctgtcatgtaattatactaatatacatgtgtaattataataatcaggtatggaaagaagataggagtaaaactctcctataatatttgacaattatttcaacaaatataatgctaatgggtggttgaaagcttagacttactggtagctttatagaattttcagtatataatgaaatacacatacataaatggtttgtacatttttgcttttcattatttcatattttgccttctataacatcaaataataacatattatgttttcctcttacagaagtaaaaaattattgtcattgattgaatgaagctaagaatcccaatcataataaatattatttaaaaattctaacttcttaaaacatcttcctctcaatctcagttgggccttagttttccttcttactaagtcacaaggaatgtgggtaaaatttagaaactaaatattttcatgccatagagccaaacctgtagtccttttagaagaattatcttgtcagactattttccttctaacagattggttccagaaagcaggtttcacctttagcaatttgaggggcaagaaatacttcattttcccaatgaagagagcatggcattatttatcatttctgcaatggcataattactcagcgtggcagctatagtttatagaaccatactacagcttggatttgtttattggttgcactttacacagcttttcatcatcaagtttcatcccttagccaccgtgcttttggggtaatcagtggtcaggtaaaatcacatacatgcagagttgctttattataatgtattaaaggacttctgaacttctaaaatatgcactaatatctactgttgctgtactacaacatatttactgtaattcataaaatgaaatatggcatttctacaggcattagcaataaaacctccatgagcagtccatgatgagacatatttattgatttggaattatacgaaaggtttcttttttgtttacagcctcaacaaattatactaaatccaaggagcagttgctaagtaataattaggagtgatgtaccacaatttggctttattatacatgctattctgaaatgaacatacaaatatatgttctcctatctttctatcttaatcagtatatatttcccctcctacagcctgtccaaagtgtctaggtttcctgaaacagacaccaacgaatgaattgtagccaatggcatatattttcttcctggacagtatatttttctttttactgctctctaatatgacattggtgtggtagactgaaatacctagactgaaggtgttgaatacttttctcatttgagtgtattttaaaccataagcagtatcttcctggcgtcagcctaaaattcattccacacacccaacactaaaagtaagtgctaagtaaaggagatccagccacaggaattagaaaagagagggacagaggctgcagccaaacttccttcaccacctaatagtcaaaaagaaactatatatcaggtctttttaaatctattcttgagaatcaatcctattttcttttctttttctttttctttctttttttttttttttttttttttttttttgagatgtagtctcgctctgtcacccaggctggagtgcagtggggcagtcttggctcactgcaacctccgcctcccgggctcatgccactctcctgcctcagcctgaattaatcctatttcaaatttcatactttcttttccccaggctagagccattagctgggctgctttgggggtcagcagtgttgaggattctgactctgagacattcccgtgtccatgctcagccctagctctcaggtatccaaaacagggagaagggacaaaggagaaagcaaaatcttcatgtgctcctttggtggcaacgtgtccccagcatcactgtgactaaactggtacgatttaaaatggtgggcatggatttcatcccccttcatctctgaagacactttagatgggaagctgaaacacccatctgccttctccaagtgttcaaacccctgactccttctccgagttgagactctcattggcctggctgacattggactatacccatagatttgtcatttttctaattttcctgctcctctcatggaactagaagaagttctgaggatgtctctatatcaccagagggcttcaaagaaataagaagtggtgggaagcatttcccatcttcttttcagtcacgttacaccaattttctttctagctctcttgttgtgcactgttctcctgatcttcctcccattataaaccaaaggtaggatgtctccttggtcacacatacacctacgcctatcttgtaactttggagaatggcttttgcttccacagtggccctagaataagtctattggaacaacgagaaagatccaaggaatgagatgccaggagtttcttctgaaagtaccctgaatttctaccaggattcttttggagcttacctcacttagttttagaaatggtaactcaaatcctttccagttaaacaaaggcaacctatagtagcaatagatgtgtcattcccataacagcctagtcctattattaacttgactggaggaagacaagggtgttgaagatattaaggcagtttgcctcctctttgtgacacatagatgaaggtatcaggtcttaactgctggtgactacttgtcatctctgtctgtattgtggggggattatttcatttgttcctagctgttgccgcggttccttatttgtgtatctagcatttacctgtacattataagaaatggtgatttaacttgtactgtcataaataagcccaggaaagcaaaaaagtaagatagtagataaacaatgcatagaaacattttcgaatatataatcatgagtttcacaaagataatgcaaataataaatattaaagtacagagtatcttaagtcataaagtgtgagcacctgaagaagagtcagcaatgattccgttcttctttcccaacttaagctgtttctgagccattagataaatgactcctgtgacagatgtttggggaaacaaatgtagaactagaaaatacacaagtcatgagtacaaaaaaaaatcaataggacttcattcttgacaaatattgacaatataatgcagaggttagcgatttttctgtaattctgttgattctgattatcttcaaatacttgatgacaggtcctaaaggaagccttgaggaaaaacaacgataaaagagtgcatttgatagcaacaggagcaggagatgttgactattctagtggagaaccttcaggagatattccatttttatttgatatttgaagaaaggaagaccaaaagggcaggaatttatacacttaaagtagaaaacagaatgtatttgactcctatagaatgagaaagattgatttgataaaatatgacagtcagtactactatcacacccaacatttaatgagcaattattataggcaatggactgttctacgtaatcgtgaatgtatgaatgtatttaacctgaaagcacagggaagtaacagatgtggtaataataccaaggcagaaaatggaacagaaagaattggcaatataataaaatattaaaataatatataattgcaagtttgtttcctatctttaaaagataatgtacacctacatgagaaaagcaaaatgcaaactattcttattagcacattattattttttactcatttacttttcagctgaattgaaatggattgttgggcaaaacctttttaatagtaactatttgaaaattaagaaaatactttctgacataataaatgaaaactctataaaagataatcaaatgtcttgtaatcaaagcagagacattagaacatttaatgtagatgacgggttgatgggtgcagcaaaccaccatggcacgtgtatacctatgtaacaaacctgcatgttctgcacatgtatcctagaactgaaagtataataaaaaatttttttaaacctgattccattattaggaataatttgaatagttcagtcacaatccatatgctggcctctggtgtctcaacttgtcctagcaaaactgttgttaatgcagtattatgtcagtccttatatacttatccatctccaatctggaaagacaatgcttatatgtttcctttttagtcccctaatttctctttatgacacaaatctagttggcaatattaaagatgaggctgattctcctttacttatctggaatatgctaccattccagataagtaatagtaaaattaccatttcttcttgctaatcgaatgtcatttttgaacacaaaagccactggctttggagtataaaacataaacataaaatatatcatatactatctgtgaggttttcataaactcataagatctttttatatttttatataaaaatgaaatactttacattaaaatcgttgagataattaaatgagaaaatgcttgtcaatgttattaaaatgtaaaattttatttttcaaagaaagaaaattgtcacttttgatttgtgctaaaaaataacagtagaagcctgcttttaaatattttaagtgtgcaatatcatattacttcccatttactctttgcatttctagacagccaagtttattttttttctcaattcagtttaaaatcagagggaacaaaatttaaaacatgatataatatcaaggttaacatgctagctatgtaataaatgtaaaatttgtccagaaatgcatttgctttgagaaacacaaccatgtgaaattcctaaatattttggccatatggaagatgatatcagaagaataatatattgttctctgtacatcaaaggagggggataataaaaactgtagctattaggtttgtataaaaacagttacagtgttttccattgccaaaaactgcaactgcttttgcgccaacctaataataaaaatatggttgagtttctgtagaattctggcaaaggatgagcatccttaatctgtaaactaaaatggtccaaaattcgaaattttgggggtgtcaatatgatgccacaagtgcaaaattctcacctaacctcatgcgatgtatcacagccaaagcacaggtgcacaaaacagtttattcagtgctttcaagagaaaattaaaattaacatgaggctacatgtaaatcaattttgtttagacttgggtctcattccaagatatctcattatgtatatgcaaatattccaaaattcaaaataatcctcaatctgaaacatttcaggtcccaagcattttgattaagaaatactcaacctgtccctgtttggaaacagttccctctagatagactaaactggcctaacagagacaaaaggtaatatctgttgctggacttgagaaagaataaatatttacacacaaaagtcagggcaacagaagatgacaaaagcattgaaattaaataaaattatgcccttttctctatgtagctctttggccaatttgaatgatgaatacaaagagccaatgactgaattctaattatatatttgatgattaagctcagatagacttgaagacagaaatttcataagcatcattttggcatttgattttctaatagcatcttcaaaatatttttattcttcataactcccagaattattttttttggtaaatcttccatacgactgcaacgtgcaagttatttctaacattatccatagcttttctattcttttggaggagaaaatattccacatatatatatatatatatatatacacatatatatatgcacacacacatatacatacacacacacaagctacctgtatagtttatatattccaattctgccctattaatctatatatgtatgcactaagaaaatatgtaattactaggactgtaaactgtatttatatcagataaaatagataaacaattctattagttttgtttttcaaatatatctgtgattaagccatttcctcacggctgataaagacatacctgagactggccaatttacaaaagaaagaggtttaagttggactctcagttccacgtggctagggaggccttacaatcctggtgaaaggcaaggaggagcaagtcacattttgcatggatggcagcaagcaaagagaacttctgcagagaaactcccatttttttgtttgtttgttttgttttgttttttgagacagagttttgctctgtcatccaggctggagcacaatggcgctatcttggctcactgcaatctctgtctccggggttcaagcggttctcctgcctcagcctcctgagtagctgggattacaggcatgcaccactatgcccagcttatttttgtatttttagtaaagacggggtttcaccatgttggccaggctggtcatgaactcctgacctctcaggtgatccacccgcctcggcctcccaaagtgctgggattacaggcgtgagccaccacgcccagccaaaactcccattttttaaaaccatcagatctcctcattcactatcatgagaacgtgtgggaattgtgggagttacaattcaagatgggttttgggtggagacacacccaaacggtataaatacatttcctgaaatttgctctttgataaaaagttaagaatcagattatctgagtcaaaaaaaaaagatataaactggcattttagcttagctacttataaaagtatagattaatttaagaaaagctgagggttttaaaaaatatttagttttttgcacagaaaaaaggtatataaaaacctgctcacttgggtattaaaggtataagtgttaagtataaatgttttattttctaattggctactcatttatgtacttttatttatatctttctgtatattaatttttcccaaaacattctgaaagtttttgttataatacttttctattgattttcacaatttttcaacttcttcaatccaaatttatcaattagtaatgatgttgcttttttctttttaaagtttttacctattatgttttctgccatattaatcagtactttaaaaaattactaatggctttaataggagacacacacaatttgtttccttgttaatgagaatgcattgtttctcaccattaagcgtaatgtttatctgtcttcatatagccatatatatgttttatatatgtgtgcatgtgttcttttgtgtacatgggttgcatatgtatgtgtagttattatgttaagacataccatattctttattaaactcattgaaattaagaaatgttaatattttcaaatgcattttggtatctttggagataatactgtgatatttatttagtaatatatgatgaaaaacactaacaaaattatcctcacattgttgccatgaatctctcttggttacggactatcttttaatggaatgctcaattcaatttgctaatattttatttggtgctttttggcataaattttcaggtttttaattggaatttaattacaatgtcatgctgacttcataaacataattccaagattacctttctctgcaaatgttctgaaacattttaattatcaagggaattatctgttcctgaagtttggataggtattactcaaaatactggtgaactctggtatctattctggaataggggaagtgatgagaataaaaaggtgaggccttttgtatcttggtgatattctttttatttattttgtctttattcagtaatctgctttgatatcctgaatcagtatttccttaggtggagagagttttcttatattgagtattcgattctttctccaattttacttttataactatgcttaccattctgtacttagatctccaaaacttattcatcctgcctaaccgaaattttgtacactttgaaaactatcttttcatttattcttagctcctcatttattctttttctattttctagaaacactgattttgtgtacctggggtatacatttttattcccccatatatatccttttctttcttatctctcattgcctctttgcccctttcccttggatcctaaggaagagtcctacattttcattgacatcacttattattctatagctttaattcttttctccgttggttctaatgcagcctgtagcattcctttaatattttaagtttccttataatgctttcttaattcagctctttttcttgccctgtaatcagtcagaaaaagacatttgctgtattttatattttctattattttttccattttaaaatattttactgttaacatattataaaatattttactcttaaatattttaaaatattttgacacagtaaaatattttacctgaaatatacatttatagttcttataattattttattcacagataaaccttttatctgatgttttctgttttcttattacattgttaaacatttctgaaattaacatgtactatgtatatatgtgtatatacttatctttaaatgaggtaggatatacacgttcttttgatatttcgtaaacagagtatataagtttatcttggttccctctctatccatctgtctcagcccatgttatgctgctataacagaataccacagactgggtaatttatttaaaaaacagaaatttattggctcatatttctggaaattcagaagactaagagcatggcaccagcatgtagacagggatttcttctttcttcatcttatggcaggaagtggaaggtagaagttgaaagggcaagagagtgtgttcacaagacagaagggaaggcagctaaactgattattttatcaggaaccggctcccaagacaatggcattaatctgtacataaggccagagccctcatgccttaattctctcctaaaggtcccacttctcaccactgtagcattcgggactaagtttctaacacatgaactttgggagaaaaattcacactataaccctgtctgattattggtagagttctcaacagatctcgggcagaaggcttttgaatacatccagccctttatcaattgtagataattagaagtgatacacatctttaccaggcttaacgccttccttctgccaagcttacattcctaaacataaagcacatcctcagtcacttgaatttttcacctgcattgaatttcttggaattctaggcctcaaatcaatgcagaataaaaggagataatggtaaatttgaagaaataaaatgatcatgaccatttttaagtcaggtctttcacaatggccatggccaataatggcgaagacaaatggagatgaattataaatagagtgaataaattaaaatgtcacctactcttctttctccagaaggcttcactgttctatgtgggcctcacatctgcctttttattaattaacctttctactgaagtttggatgatctccaatcagtattcttagtttgtggtattgtagaaatatatttttgtgttttaatgagtcaactaagcatttgtaagaaatcaagttataaaaatatattaagcattcattttttgaccaaacatttattgcataaaataagtagatatagtgaaaattctccttgatggtgaagaggtatcaccgtaaaaaatcattatcatcttgcaatacatcagtaaacaaagagtttttgatatatataggacttattttgctgagcgtagctatgctctctgtattttgtttcttggcccttcttgtcaagttgtcagcaatcacttcacactactgaaaatataactgcctttagcagttccctccttgcttcttaccttatactttgaagcagaagcagaaaattactttggctgagagtcagagctaacctgaatgttgtattaagtgcaggtcataagtctctgaaaatgtactgggggctttatttattcctaacttttatacttacaaccattgtccgtaattttatatattgcttcatatctcctgtattccacacgaatggaaggtactgcatcttatttatccttcacttccaagttcctaccaaagtgcctgacatatggtaggtacttagtgaaaattgaatgaaaccaaattactgattatatattctcccttggatatctcacgtgcatctaaaacttagtacgtggaaaactgaactcattatccttcttccatgctcaacattgtcttttccttcctatgtttcctattttgatgaatagcccgtattctcaaccagtcacctgggccaagagctttggagccaacctgactttctattttcccctcacaactaattgataaccaactcttgtctattctccccacccaaaaagagcagtttaatccatgaccacctccccactctcactgtactgccttggttacgacccccaaaattcttagtctggaatgtagtatctcctaatagtcctatccattccaattcactttccagattcctgacaaaaatgatttttctgaagagaaatctgatcattaaatttagctaatcgattgcaaaatttagttctccatgtcagagatgagaatttgggaaagagaagtcagcaagacttcacaaagaagagtaacagagatcagaaaactatccacagagagagcttcagagattttcaggggatgtacagatttattgaatcttccaattaatactgatcaacacaagtatgtgaggaaacgatcaagggcagggtacaaaccactagaaagggaaggcagaaaaatctccagaattcacatagcatcataagtagtttgtgtttccactagccagagtcaaaaaaccttgaatcagttagaatactcagaagtgtattgtctcactaatgtggaaaaaattctccctagactaaaaggtgctctggtcttaccaagcaaagcttaaaagcaaacttcaacgcaagcaaattattcctaagtaacttaactgcatcccagaataaagcttaactattcggcacaaaataaggtaaaattcactatgtccagcatttgataagaatatatcaggcatacaaacaagcagaaaaatatgataccatattgaagagaaaaaaaatcaagagaaacagactcacaatgacacgttgctaaaattagtagataatgacattaaaacaggtatctatgtttgaaaaggtaaaggaaagcatcaaatgagaaacatggaagagagagcaaaatgtgaaatcaacttctagagattaatcaaacaaggaaacatcatgtcttagatgaaaactgtagagatgaaatcaaaagcagattatcaattgtagtaaaaaaacagtgaatgtaattgtttaacaatagaaagcaactgaaatgaaaaaataaatatatgggaagagaacatcagtgggataacttcagtggcctattataagggtaattggattccccaaaggataggggagaggaaagttttcagaaaataatgtatgaaagaataattactgaaaaaaataaatttagtaaattgagctctcctcagcctaatgagtgtccaaagtctcttattttcttggactttatattgacctgaacattgctttgagacaagtctacataaaaaaataaataaataaaatgaggcagaggtaaagaaaaggaaaccttctcttggtcaatcaaggtgagatggctgaaaagaatgctaaatcctcatcacaggtgatggagtgaatggtcaccttggtccagagtgagaagacagtgagcctcaggatggttctaacacaggatcacccactcatctggctgcagtccctgtaattcagacccatttttagggctcttccccccatcccaagtcagcttcctgttttctcttatactcctctttctcagattttcttagtctctctctaagctctacagaagtgtcttctttgttgtttccttatatattttatatctacctatgaattaccatcccctgaatgttaaggcttctatgaaagataatgcaataatgtttgtaatctagttatttatcaggggccaccactcttgtctgtgtttagcacaaagaacaaggggcagagtactcgtcaactcaggggaaggaggagtcagcagagaaagcattcatgaaaaaaggtttacatctcagcaatttctaggcacaaaagacttatgaaattctaacattttattttgacacatttgttttttagtcttttgttagatacaaatacagattttgaaaaatcattttatagtaattatagtatttgccaatctgtttacaccatataaattctacatataaataggtggagaggtagtcataatattgaggggggcatgttgcatagtatcttgcaccatagctcactgtcttttacataatatcctttagtaagttcagtaaacatttttagtaaagggctcagaaattatgatagagtaataccagtcacagaatcaagaaagtcatctagttttatctacaaaagattttagaaataatcttgtaacatacccactaaattcaatgatgaacattagatcactttttatccattataatcttattttctctcataatgctgtcctttaaagaatagattctattgtaaaagcttctaaaaaactatcaaatcttcctttgttccattccagctaagctgtgtttcccacctgttctgtacttgctaaaaataaaatgaaaaaataaaatgactatctaaagtggttttacaaaagactgtatcatagatactgtgaaatccttcctgatttaaatcctttgagtggctggatatcttgaaatggcaaatgaattggtcacagaacagtgtactactcaaggtttgttcatggagtcttatttatcacagtgatctgtggtcataataagataatctatatagtgctcatttttcttttaggtggtctgggcattcttaaaccatttattcaaacattatcttttcaattctaccttataatttttatttctaaagctaagtgagcaaaaaccaggtatctgtacatgggtaggggttttctaggatatggtaaaatgcaggagacattgaaaagcaaatgggtgcagatgaattgaaaactcttccctccccacatcgaagcccagctgaaggttagcatttgaacagaaaacatcttcatagacatgaatgggaaaagttaatgctcagagtccagaagtaaaatgcaaccactcctactcactgcttctagaaattactttataagtgatcctgaggatttttttttttctctctctctctctctcactctctctcactctcccttctccctctcctaattctggctgaaattggcacctaagtcaaatgtagctaagcaaagaaactagagtctcagtatgagacagatatatatgtatgcacaatatacatatatatttgcatgtatatatatacacgtgtgtatgtatgtgtatatatatacatatctatgtattatttttctcctaattctacccaaaaaagaagcactaataccttaagacccataagtgaactttgtgcccagatgttgttttgttttgttttgtttgagactgagtcttgctctgtcacccaggctggagtgtagtggcgcgatctcggctcactgcaagctccacctcccgggttcacgccattctcctgcctcagcctcctgagtagctgggactgcaggcgcccgccaccatgcccagctaatttttttgtatttttagtagagacggagtttcaccgtgttagccaggatggtctcagtctcctgacctcgtgatccacccgcctcggcctcccaaagtgctgggagtacaggcgtgagccactacgcccggccccagatggtttttaatacctgtccctactgaaaggaacaagagcctcttggagaaatgtctggctccaaggctgtgacaaagaaggtacatgatgaatctggaacacctttttgtgccagaaagaaaggaagtgctcaagaaaacaatggggacatgccaaaaagaaataggcaatagcttgaaggggttcccactgaccaaatctagggacaatttgagtatcaaaatcaatgaggattgcaatggattgtaatgattaaataaagtaggatgattaaatgaagtaggaaattattcatctattataataaccaaacaaacagatatatgcatacataaataagcagaggggaaatagaacgttactttcaattagtgtgccagctgatacaagtgaaaggagtagtaatggggtggcgggggaggggaggatgggggtggcgaataccatttgcaaccatggtggtaaagaataattcaggcaagaaatatcacgagaatacttatctttgggaagagctgggtgagaagcaggctgcttgcatgttctcaaagtgtctcatcacagactgctattcattacaaggagaaaagtactgactaaacagtggagaattcaaatgacaccttgaccttttgctgcaaattaacctcaccaataagaggcatgtagatgtcttgtatttggggatatggtaccccgagaaggacaccacatcactgctgcattattccacttgcagctgtataaccgagtctaatcatgagaacacatcaatcaagctcaaatgaagaaacatccggtaaaattactagcctgaatttttcaaaactcccaatgccatgataaagaaaggcagagaaacgctgatagaataaagaaggtgaaagagatataaaaactaaatgcagtatatgattctagacatggaatatgaactacatagattagatgaaaatattactttagtgttaaatttcttgaattttattatcttcagatgcttatttgaggatatttaattcagtctggagagttttattgcagtttattttacttcccaattggtttgaggggaagaatttcttcagctgaaatgttttgactcatattttctgttcctacagtagcttttatattgtagtttttgtagttatgttttttattctgttcccaggtatcatagaaatggagttcctagttcaagagtatccttttctataaataaagtaaaatgcatttatttaataagagatgttggcactttgggcagaaagggagtggtaggcatgtgatacttctctttcatctggacatattccttaattttaccttatttttttcctttctgtgccatgactcctgatcaatcagatagacagctgaaattattctcagatctgaaattttttcttattctgttaccagatttgtagctcttcaaagcatgtttaacctgtacacatagtctcattttcactgctggtgttgacagaaaaaaaaatatttcaaaaatagaagctagggattgtaatataatgtaggtatataacggcaatgacactatttctggttttcctctgctttgggtctacctgaacagtagtgtgcacttgctgtgaatggtagggcccacctacattaggttggtgatttattgttgaagtaaaaaaaactagtgaaattttactgagtagactcttgatcagcaggatagcagatgtctcccagagtattttccttctcaaatttacagggcttctacctttcataaaaatccatcctcacctgtgactcatctttggatatagcctcctcttggcggtctttgggaatgcctcaaagcagaattaatcctaccgtactcagtgttccctcgactcttcttccattacatggtagtccattggtgtctcaacaggtctgtatattattagactgtgagctccctgctccctcaaccagatagagattgaagaggacgccatctctgtctactaaatcgtgtgaggccgttacaaatggccgacatttgtaggccactacatctgggctactactcaaacacttatgttttacccagcccttgagtttgcaaagtgtgttgagtcaaatttgtagttagacagtttagccgaggggagcttaaatgttccatgtagagcagtgggagaaatatgttattgttattgttgttgttcctgaaatagaagaaacagaggagagagaaaagaagtgaagaataaacgaaaagagaagtagaaatgcagtctgcaacagatgacaggagactgaagctagaatccagaccaggccaagggactttatgattttaaggaggttggctaacgcacaactttaggtatttgcagtgctacaacggtcagttatatacatgtttctggctcttgaaaacttgagtaagatctgttaaaacacacatagctgcataaatgtcttcttttgagaagtgtctgttcatgtcctttgcccactttttgatggggttgttcgtttttttcttgtaaatttgtttgagttcattgtagattctggatattagccctttgtcagatgaggaggttgcgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtgcggggaggagggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaagaacacacacacacatagcatatgtaagaattttgtttttatgaacactaaggaaaatgctgtgtttgttacatgactggccaaaataattagcaaaagaaacctacacatggaacagctgcataattttgaaactaagttaaatcagaggaagcatgggggtaggtaggaggaggattactacaaaattataagcctattgataatttgttaaaatcctgaggaggatttttaagaaagtgtgcactgaaagcttgaagcaatctcatctagtgtttaagaagaaggatttccttgctgatttctactatgtgtttttattcatacacaggcacattacctaacaggctatttacttagataagaggtgagctcaaggtaaatacctgtacctttgctgctagctttagaaacaaatatctaataggatctattttgacactgcaatggaaactagcaaaattggaaaactccttagtaagtgttcaacaatagagaaatgactaaacaaattagagtatatttgccctattttgtacgtgtcacaatcacaagactgaaatctgtctatataagctgacatgttaagttccctaagacataatgccatgtgacaaaagatatgttgtcctactgtacaactgtcctagttatgcaaatgttcaggaaactatgtattaacagcaattgaccccagttgaaggatttgattggagggaaaaaaggtagatctttactttcctcttcctatccttttatgtcactcaaaattttgtcatgagaattaatatatatgcatgaaatattgtaatatattaatatataaatcaatacatgtacactataaaacagaacatctgtttttggaacatggttagctgagctaatgcaaaatgctttctgttacaattaacatggtggagaattataaaaattgtgcatagtgctgggagttcttggaaaagaaatggagatggaaacccacagatactgtaaaaaaaaaatggaaggaggtgagattgcatgaaaaatgagaaccatataaggtaaactttgttggacttatgactcagtcataggctctcaataatataggtttgggagtccctttttactcaactttattgtagtagaatttcagaaggtgacattcactaattctacttgcacaattcaacatgttttgataaaagcatagttacataggccctactacattcaaactttaaaacaatcccagccagaaactcctctggtgcccctttaaagtcaattcctttctaccatgcctagcttctgggcccaggctggagtgcagtggcatgatctcagctcactgcaacctccaccttccaggttccagtgattctcctgcctcagcctcccaagtagctgggactacagtgcccaccaccatgcctggctaatttctgtattttcagtagagacgggatttcactatgttggtcagactggtctcgaactcctgactgggaatctttaaatgaatttttgtcctagtagttttgtgttttctataatttaatataaatgtaatcatgcttgaagaagctttttaaatctaacttttttacttagcataatgcattttaaagtaagtcttgactttatatgtattacgttttccttgacaaaaacctagaaaagagttgctcagtcatacaataagtgcatgtatgaatttataacataaagtgctaatctgttttccaaagtggctataatagtttacattctcatcaaaaacatatgagagtttgattgttcatccttaccagaacatggttttgttatcttatctttatttttatattaaatgttgcaataaatgatatttccttgtggttttaatttgcattcccctgatgattaataattttgatcatttttttatttgtcatcgctatcattggtttttggtgaagtgtcttttcaaatattttacctaatttttttaaccaaattgtttggcttcttaatattgagttgtaagaattcttagtatattctggatacaaattccttttctgatatatgatttgcaaatattttctcccattctgtggattatcttttaattttcttaatgctgatttttaagaccagagttcttaattttcataaagtccaatatttctaatttttatttttattatttatcctgttttctcaccttatctaagaaatcttttcctaaccatgttcataaagattttctcaaatactttctgctagaagttctagagttgtacatgttacattcaggcctctgatctatttcaactgaatatttttataacaagaaaggtgaggatcaacactcatcttttttcatatgatcaccaagttactcaagcatcgtttgtaaaaaagtctcttctttcaccattgaaaatcaatcattgtagaatactagctgactatatatgtgtggatctatgtttagactctataatctgttccattgatctaagtcttactttacctcaatgcaaccctatctttcttactatagctttatagtgtgactttaaatcaaaccatatgaatcctccacgtttgttctttaaaatagtgttttaattattctcaaggtttgcattttcatataagttttagaatcagcttgtcaattcaacaaaaatacctgatgggattttgatagggattgaattgaatttataaataaatttgggtagaactgagatttaaataatatttagtcttttattccatacacatagtatatccctccattgctttatttgctttatttttatgttgacttttttatcaatgatttttaatttccagtacacaaatcttgcttatattttactagatctattctgaataatttaatgtttttgatgtattgcaaatggtattatgttttttaatttcaattttcagttttagctcatatacaagggtgtgattttatatatatgtaaacatatacatctaactatctgtaaacatatatgtaaatatctaaacatatatatgtaaatatatataaacatgtgtgtgtgtgtgtgtgtgtgtgtgtgtgtgtgtgtatataaacctggcattctatgaccttggaaatttcacgtttaaatcagtttagcttttctgtagcctttttgagattttctaaatagctaacatctgttaataaagacagttttgtttttcccagactgcatgcatctatcttttcttcttcccttattattttcactaagacctcagcctaatgttggatataaattgttagaacagacatccttaccttgttttcaaccttaggggatattcctcagtctttcacaatttgctattatattcaccgtaggttttgtcaacttaaaagtgttccttatctttctgatttgctaagatctttataactataactaacaaatgttgaattttatcaagtgcatttctgcatgtattgagatcctccaggtgcttcgatgtcagtgctcctgtttcagggccaggcaatgagatttgcctgtgttttcatacaaaaagctgaatctaagctgcctacataggctcaggaataaatacagcaccctcagttgacaggaactagaaaattcctcctctccggttgaagacatgacaaggaatcttggttctgctctgattctggacaccaagaaaatctcatgagataatcaaacctcaagcagagtttgaactctaatctgaaatacaattataacaatagagttccagagttcagacattaacataaaaattgttttgagtacattatagaatcaaaggctaaatattctgaagagacatttctgccataaaggccacatggtatctttaattgagaataatggaagctaactcttctgaactcttcttactgtattgaaatttaagtagaatatatgatagaatatatatatttttcattcattcaacaaatatttattgaatgtgtctgttaggggtccaggcatttttcagactctaatatgatgaaaggaaaacatgacaaatcatgtcttgttccaaggggagattattattatgatttacatggtactgcaaccaaatgtgttcatcttattagagtacatattgattgcatataacatgatagcctctcttaggatataaagtaattttatatctaaaatgcttgtgaaaccttttctaaataatcactaataatctaaaatatatacatatgtgattatatataatcttcacttcattatttttggtaagaacataaaaaactggctttgttctaggaagttactttgctttgtgatatttctgcatttatcctctatacacctcttattagatagaattatgctgagttactacaaatgaaaccaattttgatacattatttgttttgtcaagaggcaacatgctcagtctttgcaatgcatctattcttttggagttattttaagatacatgcttcagtttagcaccatactaatcattttataaaaatataagaaatctaattgctgatattcaatattaggcatattttatgctcctattttatcaccaaagtaaagccacctcctagtgcagatttaattatttgggtagccaccattcacctctgctatcaaatatttccaaattaattagttatttcaatgtttttgccctattttgatttgtccaactatttcatttctaattaaactcattttacttaagttacaaactaagcagatgtcttgatttgttgtttcagacattaagaaagttatattcagtctttaatatatttaatagaacaaaactcaagttgttgttttgctaattattctatacatagattaaaacattgatccctgttaaaatcatgctatttaatgctaagttttgttgaatgaagggaggatcaaactggggcatgtcattttttgacaacagagttaactgagtggctcccaattgctcattagacgtaactttcctttaacagcattacatgtgagcttccaataggagtgccttctcatggagggtggttattcatcaggcaagaggatataagtatgtataataaccagctagaaccttcagtatgcaacaggtttccttctgccttcgtgtataatagtcacctttaaagctggagcttttgctgaatgttgttgatatattataacaatatccagaaaatgcactctatttcctcgctaatccaaagcagacaatggcatatttctaaattaataagaaaactgaaaaccacaaacatctatttccacaatcttgttgctgacattaggatacatgttaacatttaatccaagttcaatttaaattcttccatcagtttttgtttagttgctgtggagttttataggaaattcagatagctataggcttcccctataagctctcttcaataatttgattcttgccaataataaatctgtccatcatagtaagtgatgcttttgttattcacattgctttgtttatttaacaaaactctatttgtatatctccactgaaatccttggtaatttttgattgtctataaaattgtgttttaaaattggcattgagtttcaaatcataatgcataaactgccaatggtatgacactcattgtttattttaaagtcatgataagtataattcacttttctgctacatggaccagtgccaagtagaattacaagggataacaaaatgtctttgaaacaaactttttactagagaaaaaagcaaacagtccctgatatgaatcaagaaatttagattaccctcctggccaagcaaccacctgcctgtaattttgtaaaacaaacttggttcattggtgtctctctccttgtcagtaaagtaagacagtaataattgaattcattattctccctatcagaaaatagtttattactcttaaaacgtaatttccttaacctttgaaactctgtgactttagtttatgattattgtctttaattattggcaatacttcgaataatttaaaaatgctaggctaggcaagtccattgtactcattttatgcctcagaaatattcacaattgatggattagtcttattatttagaaaaccatgtagaactttaaatataaagactcaatgttgatttgagggatttttgttgttgtttctcatcataagttcacctgtaagattttactttcaatgtaggttagtatcatagattttacttacatctgttatttttcatttttcactgagtatacaatatacctaattcttcagtgttattgtttgtatgtcaggtaggaatgctgatcatttagggttttgaatttttcaaaacctatagcattttgaagtcaatgccatacgctttcaggataacaagtgaaacagcaaaaggactcattttccatttgatatcttacaaatataatcatataaggaaagtcccttcacacactataggattctgccctcagaaatgtctctgttttcagtgatttccagagcaaatgggctgcaaatgaaaatttcacttaatacaaacatgcttccaaatatttttgacatgttaccaattttagctcaaatttaatattttaataattgtgttatgaatactagtactaaggcatcaattgtaaatcagtattaggttctatgatggaaacacagtgcatatacaggccagatattcttgaaaaaccacataatagtagagctcatgcttgaatagtttaagaccttctgagaaaagtaaacctgataaattaaaatttgcatatatttatgaaagtccctatggagattttgcccattaatggacttaaaaaaagacagcataccttttgtatgaataataatcattggtatacagtgaaatttttcttttagggtttccttttattaattttttaaaattttactttaagttctgagagacatgtgcagaacgtggaggtttgttgcataggtatacgtgtgccacggtggtttgctgcatctattaacccatcctctaagtttcctcccctcatcctggtgtgtgttgttcccctccctgtgtccacgtgttcttattgttggactcccacttatgagtgagaacatgtggtgtttggttttctgttcctgtgttactgtgctgaggatgatggcttccagcttcatccatgtccctgcaaaggacatgatctcattcatttttatggttgcacagtattccatgggaatactatgggaccttgtgatcttgtgagctaatacttaataaactcccctttatatatatatgtatatctatcctattagttctatccgtctaagagagacctgaccaatacaccatatgaaaattgaaaaaaaaatagagttactttgtagtggagaaatttgacaaacactaccccagccaagtgatcaaggtgaaaatcaacagtgatatgccttgttgataatatgtcattgaaatggtgtgatgaaaatggtacttttccactgtagtcttctccagaacacataacctcagtctaatcatgagagaaacatcaatcaaatcccaattgaggggcattctacaaaatacctgacaagtacttctcagaactatcacggtcatcaataatgtgaagatctgcaaaagtgtcacagccaagaggagcctatagagacatgacaaccaaatggaatatatgattgtggttgggatcctggaacagaaagaggatgctacagaaaaactaaggaaatctgaataaagtgtgggcttcagttaataatatatcaatattgattcattaattgtaaagaatgtaccatactaatgaaaaatgttaataataggagaaatttgatgtgggctgtatagaagtctctgtactatcttagtaattttttggtaaatctaaaactattttaaaattaaaagcttattaaaaagaaatttaaaatgtgattgataattaaagtagtataattatgcagctgatgctataattaaactaataagaatataattagattcacatgtactgatatggaagaacgtcaaggatacattatgtaaaaaaaagcaaattgcaaaaatattgcatttttgtgacccactttatgcaaaaatgtgaacacatatgcatacacccaaatatttgaagaggtacatactaaagtgtggttacattaaagatagcaataatattgagggttataggaaatggggtaaatgtgggcatagggtttttttctatacatttctcttatttgaatattttataataaacatatatttgcagatacttacaagttatttatggtttaaaatacttttctcagatatattttaacttctttttgctaccaagctttccttaatccattattccctttcattaatgtgacatcaagtgtcttctccaatgcttctttttgctaggcatgtaaagaagaataggtttctctcaggttaaagaggaaaataagaaaacaaaacaaaaaagctaccttatgccttttagttaccctgtattttttttctgccaaatttcctgatttcattatttctacttcctatgtagagaaaactatgtagttttctctgctggttcactgcaggctgtcttctgcctttacctctctactcagtctagagtgtggcaaccttcctgaccgtggtggacagggtaaagctctgggcagatttggactgtgtgtctgagattttgcatattttactttactttcctaatctcaatgtcgttacctctaaaatgaggacagtatccttcttgctaatttctagtatacaaactgatacataatacattttaataaatattgatcagatgatctaaaaagcaatctcatcatagcatcatggcaaagatgcaatcccttatcatctttcctctagattcttgcaatggtctactagtgttatagatgaactaacttccctaaaagagtctcagtgtgtctgccctcacaacccttcaaatctctgagtcaacacaatatccagcgtgggcccattgtagcctaaaaagtgtgcatctctcctctcctcagaaccttccagagcttactattgcacaagaatgtgagtttgtgtagtgtttgtatgggtgtgtgtatatgtgtgtgagagactacaatgtgtatttgctgaggtaatcctaggactcaccaacactggagtggaaaaatatgggagggaagaaagtaagccaataaaagttttgttatcaagcagcgtactgctgtgggcaccaggtgcctaggctcagcaggaaactcagaaggatagggtgaatatgacccagagcagttccaaccaaggttccaagaagctgacaatttggtccataccatctgacaattattggttgatggctgctttggggaaggaagtggaagggatgcattcgtttctagcatgcccaatctactttatctttaagcctggcaaactgtcgcagccaaagagagtgctcagttgaagagttgttgatagggagcatacccaagaatggtgaaagccaggaagatacggatgggctgcagacagcatctgctaaaatgtctttttttcaaatatctcatgtatttgtatttcctttctaaccccatgcatcacttaagattctttaggaaatagaaagcatattcaaaggggataattaaagagaatgtaacaaaatggctatttataaatatgtaagcagttttcaagaatttcacaagttacaagaaagctagatggactaaagctatttccatggtctaaaggagcaagggtaaggaacagacacttgaaccaattagatgtgtaatttctgtggccttacacataagtaagtagcagaaatcaggcactgccaagctatgcctcagcagggaaggatcctgagaaatcacactcagattgatctctcctccaacttctgatctgctgtctttgccttttgttggtcaaagcaaccagagtgaagtagtacttagtcagtgcccagagctcaaaactcagtgaagtatgagaactgaagccagaagagcaggtggagaatattcagcatgactagggcaatgcaagttgcaagagagcctgacttttatccttctgtgtcccacactatcccccacaaatagaacagtgccttgcacagagtcagtactaaatagatatttgttgaatgtttcggtccattcacaatacttttgctattctttgtaaattattccaggattgcactttgtttaatttttgccttccaaaaagtgcaaactgatatctcaatattgtgaatgaatacccttaaaatgtttaagtgcctcattataggggagagtcacagcttctaataatcatgatgtaaagattggttttttaaaaaaactgttatcttcccttataactcaatatttccatttccttttctaaatgaagcaataaaaatggttttccagagttgtcagatagagtccttattcacaaattgtttgacttccatgaacacaaaataattccatttgataaggcatattttattagtatttaccattactgttaaggaaaggcttaactaggagactgcctagtgctgatataggatgaccatatatcagaaaaaatatattaaattacacttgaccatttctatatttctaatttgagagaataattctgtcagtcagtgattcaggatcctgcatttaattagctgttaaacctttattacgattttggattttgtcacttttttgttgaaatcgtttgacaaacatgattcattgaaaataatattctcatgtcatgttaaaaatagttttgtaattttatttttatactcaactctttttaccttgtattcatcaaaaaaaaaaaagtagaagtaaatgtatccccccaaatttcatttctacctgggccctgtgaatgtgactttatttgaaaacagagcattttcaaatgtaataaagttaagacgaatttacactggattgctaaagatctgaaatccaatatgactgatgttcttataagaagagggaaatttggagacagacacaggcacatggaggagatgcgtttatagatggagacagaggctggcattaggttgccactggcaagagtaccaaagattgctggcaaccaccaaaaactagggaagaagcctgagttagattttccctcagagccttcagaaggagccaatcctatccacaccttcatttcaaatgttcagactccagaacacaagagaataaatatctgttgtttgaagtcaccaagtttgtggtaatttgttgcagcagtccaaggaaatatatacagaataaaatacagtaccaaatctgttctcatccaccggcaaacattttttgtaatattctggaaatgaagagttgattgcttttatttatttatttatttatttatttatttattttatttttattttattttttgagacagagtcttactcttgtcacccaggctggcatgcaatggcacaatctcgactcactgcaaactccgcttcctcggttcaagcgattctcttgccttagcctcctgagtagctgggattacaggcatgtgccaccatgcccagctaatttttgtatttttagtagagatggggtttcaccatgttggccaggatggtttcgaactcctgacctctggtgatccaccctccccgcccttggcctcccaaagtgctggggttataggcgtgagccaccgcacctgttcggttgccacttttggagtatcaagagtcagcctttgttagtaagcatttctatctgcctgtttgggttgagcaaaattagaactgacaacagaccagatgcttctattaccagaatttcaacctccagaggatctggataacagttttcaagtaactctcatagtagcctaagcttacttaaactctaaaatgaaagaatagaaatagactcaggatgccaaaaagtcatatatttatctgatttaaactcatcaaactgaaatttaaaataaaaattatcttgaaaacctgctacatagcaaacactgtattaggttctgggaatacaaccttgaataagacaatttccctgacttcaaggaattcgaagtataactgtaatatacaatgaaatatacaatgaaaagggaaacatgaggctacagaaaaaaaaagagttatatcatgttcagctatacactgaaggcattttcaagtcattgaggagtttgaaattgggaagcaacaggataaaatttgttgtttagaaaacagcacagggcagagtggaaggtagtttaggcagatacaagcctggaatgactgggagatcagctaggccattatagttgacattgtgagaaaaaggtgaggtggcttcaaatagagaattagcaatgaaaagacacagtgaaaaaaatggatgaattaaaaggatgtttaagtggttaatcagcaaagtttagggatttaattggggtagagatgtgaaggagagaaagggaggagggaaaggcggattccagttagtggaagttagtggcatcatggtgcagttttctccaggcaggacacccaagatgaagggcagggcccaggtacacaatagagaggcaggaaccaatgggctacattcaaggaaacagattttctgttatttacattcaagttatttatatacccacccactcacaaacatgcttttctattctttcaaatgaattagcctacttctatttatgaactgcatttggttgttttggctcattatttacctaaactaagttcagtcaactttcaataatagcaaaaacaggccaaagtgggaggatcacttgaggccaggagttcgagaccaacctgggcaatatagtgaaccccatttctacaaaagcaaacaaaacgtatccatgcatggtggcatgcatccataatcccagctactcttacgagtctgaggacagaggatggcttgagcccaagtgttcaacgctgcagtgagcaacgctgcgatgagctatgctctcacaccgcactccagcctgggtgacagagaccctgtcttaaaaagaaaaaaggcaaaagtttttttgatattacacagctagatattttcaaaacacaattaaaaaagaaatgaaataattttaggtaattgtaaaagacacaattttaagtaaattttaaaaattaacatgaatagtctttgctctcattagatggtgaatatttaactgagctttgcaggtgatggtggagacacaggttaataataaacatgataacctgaagcagtaactcaatttattattttaagatatattaaagttaagtatgataaatatatttaaataaaaagaaaaagtcatatttatttcatggaaatactaagtaaataaatagtacatacattgttccagaaataaaactgcaaccctttaatgatctgaccaaaggcctcagcctggctctcagttctaaagtcttttcatgctaagtgtttgctctaacactggatccctgtgtgttttactccaagtctagatcccagggtgcaagaataagacaaattggcatgtaatcaagagggaaaataccaacaactatgattaaattagagacacaactggcacggaagagtgttagtcagaactactagttttctagaaggttttttggtttttttttttttttttttttttttgaaattccaaagttgaagtatggacaggtgtatcctgtgaaggtgtgaggcaattttaaaggccaccctttcagtagcatcaacattagtaacctcaatgtaaccacattctttgcacaatgaatacttcaaattttccaagataagtctgcagaaaacaggaaatggattcttcactctgcaattttttacttctaaggttacattcttttaactcttcagactgttactacagtctatatcacatactgagtgtttcctagaaaactaataaagttgagatcatctgaattgcttttctatttttctatttttttgcaactggtatgaatcatacttctctaagcaaatatgttccttaatgtattacttttcttgttttgaaaactctaaaactacctattatcatttataatatcacagaactttactctgtgtttattatacacttaccccaattctgtcatttttattctacatacatccttcatcagattgtcactgtctttcttctctgtgtaggcattagtcactagactggagaattcttggggtgaaaaatatcccaatattcataattatatgggctagcttccaccatcatacatgagatatgtattttatctgttgttgaaattgacagagcctcataaaaccacataattactcattggtttggcattctatatggcaatatttatcaatcattatgaagcgcaagacacaatacaaggtgtatactcaatcttatacagagcatttggggacatctatgttgcaaaatttagagttctatgtattcatttggatttgagaatgataatgtgacatgtatacccttttaaagccacacctgttccagcactggacagcaccacgttttgcctcccgtgtttcctcatcagattttgccaccgaatgagttcaggttgtgtcaagttttgttgtgtaatacaatatttaaaaatcttctagcgttaagagctgctattttggttttgttgttgttgtttctgttgtttcagaattttaaactgtggaacacattgtcagacagacagtgatgcaaagaaggaagagataggcatttcaggaaaatgacataaagcataaggaaatagagatgaggaaaaaaagaagaaatatttcagaaaagtcatgtaatccagagggctgggagtgtagatcttgggaaggggtcaagtgcaatacagctggagcaaggcatcaaggttgaattataggagatgtatgttttgctcttatttttttctggctttactgagatataattgacaaagaaaagttgtatatgttttgttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccttatgttttctttagagaaatgtcattccagtcctttacccatttttaatttggtctttcttttgctattgaattgtagtttcatatacaatttggaaattaaccccttaacagacatcgggtttgcaaatattttctttcactccctgggttgccttttcatttggttgacttttttttttttttttttgcctcttccagagcaattaaatacactattagctatgctagcccttatttattcgtgactccctatctctagaaagaaaactctgaggaacaactggtccatatatcctgctgcttactagatgtgtgtgttatatagacactttaaattcaatttgtgtaaccatattcatccattaatttaacaagccattatagtcaatgtataagacattggagggtcaatggtgaaagttgtaccaatttcatttttggtgcaattacttcaataatgtcagacattacaatgttacaaactgaagcatactctgatggaaggaatgaatgtccttctcagagggtatgtaagaaggtagcttttccacatctggtagggctgatgttccctgaggaagtgatagctgatctgggatatgagagtgaaaagaaaaggaaggaagtctatcagaatgggaacgagcatgtgcaaaacccctgtggcaaggcagagtgggaggcatcagagaaagagaaagaaacccgtgtggaaagaaagccaaggagccactgcttgtatatgaaaccatcactgttagccctctagaatccttctgtctgctcttccagtcacagccccctttgttccattgaaggaatactaactacacttttcaaatatttatggcagtaattccttattacatttagttaccactcttaagaatttcctttgaagtttatatgaatggaaccataaagcatatagtcttggtgtatgattttacctatagtacattttgttttttcaatttgtttatgttcttgagtcacgtatttcattcattttggatgcttgataggattctttgtatgaatatacaattcatgtacctaatgctttgatgatgaacattatatttctgtgtttctagtgatcacaaattatatatgattaatatgattaaacagccagacacacataggcacatcatttctctagaataaacagcaagaggtgtatgtatatatgtgtatatataaacatatacacacatacatgtatatatataaatatatacacacatacatgtatatatacatatatatgcacatatgtgaacacaaattcatgcataatactaatataaaattatgtactattctcttttcacatatttttttttgtctctcttttcatcattattgatggtttcttcttccctctcttccacgtaatgatctctctgcatcttatccattgaattattaatttaggctattttgcatattgcatttagttctagaatttctattactttcttttctgaaaaatctgcctaacagatctcttagtctacataaacataatctaacacaattttctattatgatggaaatattccctaaatcagtatttcccaatacagtattaaccagccacatatagctattcagctctggaaacatggctaatggaactaaagaattgaatttttatttttttaatttatttataattattttaaagttaacatttctaacaacttttatattagatagaagttctcctatgattttattttcaccatccacttaaaagaaacaaaaaacctaactcacacagggcagggatggtggctcatgcctgtaatcacagcactttgggaggccaaggcaggagggttgcttgactcaggagtttgagaccatcctgggcaacaaagtgaaaccccatctttaataataataattagctgggtgtggtggtgtgcgcatacactcccagctactagggaggctgaggttggaggatcacttgagtccaagaggtaatgtctgcagttagccatatcatgccaatgcactctaacctgggcaacagaatgagaccctctctcaaaaaaaaacataaaaactgacatgctcagttggagaaatttgaaaaaaaaaaatagacaattataatcaattaagactcaattgtcaacactcagtgtataaattatacacactaaatgagattgtgtacatacctatccatatctacacacatatacattatataaacaaaatacattttagtaatgttggcttatatattttatggcctattttttcaaacaatattttataaaagaattttatggcattaaatagtgtctaaaatcatagactataatgattatgtaagatttgccctttggttctgtaataatttaaatattctcctattgctcaacatttagaatactattttgatactgttgctaacatgattatctctggctgatttcttaggattgttgagattaaagtaggattgctggaatataatatccaaatattaaaacatttttggtatttattgtcaagttgtttttcatggaagttatgccagcttaaatcgtcattagagtaagataagaatacagtgtgaatttaagtcctgtttctcctctacctcttcctatctcttctttctctgtatcaccaaatgacatttgtcatagtcctgttcttcttcaatatctttgttcaataacctctgttttaaaggttccctctccccattccatattcagctctcctgtcttaaatgctaaatcttacatccatatttccaatctgtcatgtcttccaagatcaagtcccacttttccaatatgtctgctatacatatatttgcttgtccctactgactcccattacatctagagctgaacttttaacactagctctgcccccagcccatcgtaataactcaactcccaatgtgtttagattgtccttttctgtaagcaatcccattgtcacttgagcacaaaacccccactctttctctctttccctttatctcacaaatgccgacattcatcaagaatgattaaattttcaattgcaatatgaatccaaggcaagtcttaccttgcatactgctacttccatgctagaacaggctttcgtcaccacggcagttttcttttaaatactgttcctgcatttagactttccttccattaatctattctactcaatgcttctaaactaatctactcaatttatcaagttgaggggtaccactgtcttcatcaaaagtcttcagtgtccccctgttgtcttttaagcaaccccaagttgcataatttgtcacttatccatttgtcccgccagccagccactcaaaatttattgagtgcctacatgattttttcctttggataactgccactcagctactggagctacttggcccttgcttaaaaaggtcgtgaagtgcctgggagtttatttccccttgaggtttccactaaccagtgaccgaaagatactcaccaaagtcccagatccatagtctggattatagtagctctaaagtttagtttacactccaaagtttccctgtggaatcaggctaaagctgttctccttgggctttgcatggcaatcacactcttgcctgacttccttctcttccttgccctgctccactaattgccttatttatctaccctggagcccttccttaataaattattttcacgtgaatttttctcttaggttctgcttctggaaaatccaaagaaaaccacttttgttaagaaccaaacacatgatcactactgtgaatgaactcacgctaagtagaaaaatagacatgcaagccaacaatttaaattttaatatgctataacagtgggatttgcaaagtcctgtgagatgaggaaagaataaacacctacctcaggtgagggaagtcagactggaaagtcttcacctaaagtaatgtctgatctgaaattcggagaataatttttttttaggcagaaataaaaactagttataacaaatagtgtgggaaaaatttaatggtataagaacatgaaatttttcaggaactacacataatgcaatttattattatcagagacaatatttgatacaagggagggggatggaattggttctgataggtgagtaacatggcagaaatgtgaattcaagatattctctgagtgtcgtaaaaagagcttatctagtttatctgtcaaagatggcaaacaggtggggcgcggtggctcacgcctctaatctcagcactttgggaggcttagacgggcagaacatgaggtcaggagttcgagaccagcctgtccaatatggtgaaaccctgtttctactaaatatatatatatatatatctactatatatatatatatctactatatatatactatatatacacactatatatatactatatatatatactatatatatacactatatatatctactatatatattatatatctactatatatatctactaaatatatctactatatatatctctactaaatatatatatacactatatatacacacactatatatacacacactatatatatacacactatatatatatacacacactatatatatatacacacacacactatatatatatatatatatatatatatatatatatatatatatatatacacacacacacacaaaaattagctcggcatggtgctgcacgcctgtagtcccagctacttgggaggctgaggcagaagaatcacttgaacccgggaggcagaggttgcagtgagccgagattgcgccactgcactccagcctgggcgacagagtgaggctctgtctaaaacaaaaaaagatggcaaacaatatggagaacctgatgccttcaattatagagttgtagctgttgctctggcaacattgtggaggactgcatgtgaaagttgtatgtaaggctagtctggagaatgaatcatcagaaatcaaataccatggtgagcacaaggggctgagaagagagataatgtgagatattagaaaagaaattggtggtagttggtgattgattgggtctgtggtaatattctaggctttggatcaccctgccagtcaccaaatccaatagattttttttttttttttttacttaatcaagatagcagcattttacttccttcttcagcttcctgttggattgttttgctaacttttgtacattttccaaattatccatgttgacaatacattattcttttatttgaaagtggagtagggtaaaaatgaaatcatagcgtatagacaacttactaaaaattattgagttaatcagaaaaagcctgttgataatcaatatgcatgtgaaaaaatgtccaacctcaatgataacttttttaaaaaagtcaattgaaacagtaagaatatcagattaacaaaaaatttagctgtaaaacattcaatttgggcaaagatagagcaaagaatcatgctaatgcactacctgtgagactataataggtccaaatttttgaagagcgattacaaatatctggcagattaaaatgctcacttcctttcatccagcaatggcaccactaataatttacactaagaatcaatctagatgactagatataaaaatacttattacagtattatttataacagcaaaaaagtccattaatacaaactcatgagttacattataaaatgaccattccatggaatattatgcagatgttataaaggatatgttaatacaaatgtgatcaataaatattgtgttacaaaaaaaacagtagaaatcgagtttgtagagtataatttcatcaccatatgatgaaaatatagatacacggaaaatttctgaaaggatgcacccaaaactgctaacattatttgccactggggcttgaaaatgataatttgctcttctcatttatttttttccccaggaacaacagtaatttggccataaaattaatgaaaagaaagaggcattaacaagataatggagggacagtgtttagtttttatgcttgtggaaggaggagataagaaaactttatataattctgttgaaataaaaataaaatccttatggtcaaaactctaagaaaggaaaggtgcttacagataggaaaatagaggctaatcccacatcccggaagtgtcaaaccaaggactagaattcagatctcttgacccttggccccagtgctctttctttgatcctaagcaatagcatatctatgcctagaaaatcaagccaactgaggtggaaaagacctcggccattatttctgctttctctgaatatacaggattgattttgagttcataaataaataagaaatgttgaagggttgtccgtgggacactaaagtttcactgtattctgaaccggaatatcttaattcaataccattgctctaaaaggatgctttctcaagcactgaaaattatggttccatttatgtccctaatttaagggaagagacattttgaattggaggcaaataaactatgttgtaacacttcaaagcttagtcaggaggcttataccaaatgccttatgtgtacttgtggtttttgtattctgaccctgaatgtatttcacacataaggtgatatgtctccaataattttcctcctacgtatggtataaatgaaatattagcacatattatctggcaccccaccaactgattagtttgttgttataaagtgcaaatgccctgtgatataaaattccaagcattactctactgaaaatgagaaggcatcactagcatgtgagtgaaaagaatattatgtgcttcccttttctatatgttagaattgctttatattgaaaaaataagttacataaaataccaacccaaagcttgtaaattactttatccatctacttctaggaaattacaaagaacaaatttcattattttagcataacagggatggattttcttttgtgatattgaatatattaacaatggatttttttccctagtgttgtttaggatacttcctgcaatgcctcattcaaattgtcagtgatttttactgtgtattgtaaatgatacatagccactgtatataaacatttgctgaattcaagattgctaagttaagaaactggagtaaataaaatggaaacaggaaatcagtgaatatttaaggatataatctggcaattgcatgtttctgctggcttttcataatataacaaaccatgttttttgttctaattaaaaaaatgctatcaataataaaaatgctaattatacataatcaatatgtttatacatagatcaattctgacaaatgttctaatttcagtttagtaaattgatgtgtaaatatactttgtaagacaggcaattttataagaagattagtagactagtgaattaaaatttccatttcctatgctgcagagcacttttaatgcaatttgaagggagaacattagtgctcagcatttataatttatcatttgacatttggactaaaaactctaagtgtatagaagaattacatatatttcttaaatttccagtactgcacatgctaccataatgcagacttttacaaggagattagtgtaattcaatggtttatcacaaatatttccaagaggagctatattgtggaccttatattcccctcatagttgcttcaggaagggatctcatttgtcactccttctcggcatttggttctattccattcttaactgaaaatagggaaaaatgccaccctatactgaagcatttcaacagaattggaaacattatgcataattttcaatagatgagggtatacatttcaaactattcacaaaaaaagatatttttggccaaaatttggttgagatttgttgaaaggaagtacctctctgatctactgttttttagaactgtctgggtttcgaggtcttaaacagaggcatgcatgtgcacgcatgtgtgtctgtgtgtgtacggaaatgtactatgtccataaaaatgccactgttggtgtttccaaaatgaagctactaaaaagagaggattggtgtcatctagagagggagacgaattggaggactgataatgcagagagtgcttggaaaataaaacaatggaaaagaggccacagtttggaccagaaacaattatctgatcaccaaaaaagagaggagagagaaaaagacacagcaaaatacggtcagagagacaagaagagaacaaccaaacagtatatttggcactgtaaggagtaaaagattgagagattttttcccctttctattcatgggttatgaaattgaggttttctgtgtaattaagaaaggatggatcttagtgaagggcatattgtcatctatgagagagctgcgagaagtgtagggaagattggagaagatggctgacattgctgctttggggtacttgctctaaaacttctgccattcagccgtgcagatgaggtgaacaggtatttgcggacacgcttgactcttgatcacatgtattaataagacatattacattttttaaaaattatatcataattcatgtgttgagcaggatatagctcaacaatgactattcagcaactttacctaaaagccagttcataagttattctataattgttgttaacctggtgggcatattttctagggatttcaagtgagcaaaaattgtcaaaaactaaaatccgtcaggagtaatgtctgctttgcctatgaatcctagacacactaaagaggtatttaacattttagttagagctataaatgctttaaaatttaaaaatatcttttctttaaactttggtttcattttcttaggcatttgttcaaatatacatatgtgtgaatgtatgtgatttttagaccataaaatactttgaaattgttaaataaatgtttgctaataatatatttcattatggaaaaattttaggattccttttgctctcagtattgactattgtcattgtagaagttctgataatatgatatttatataaggactctgagttcaaatgcatcatcctaaggcagtgaaaacatattttcctcttcccattttatatttatgcataacagaaatgggaagactaaaagatttcattatcacaattttggagggcagagaaagtaccaacaatctgcatttccaggctaagtttaagctatttagaagccaaaccttctcactattcagttggaatatcacattcagcaagagaatgtttcagtttttttcatagctatgtttaactttaaataagagattacataattaatgctaaaattgcctgtgacttatattccttaaggttttctattctttcttagcttaagtcatgatttttattttcattgttgtcattgttatttttcttttcatagaaaagtactacttagctctataatcttttatttgacattaagggaaaaatacttttgacacagcaaaaatatgcttgaataagtctgtggtcttctgtaacggtttaaccttatatagttgtattttttacattttaaataataatgattacataaactttatccaaaaattgttataattattgagattaattttgaatcaattacaaagtttttaaataaatgttatttgcagtgtttataagtcagaaaacaaatgaaaagattaatggttatatatcaataattgcttatagtgtaaatgaaaccatttgttaatttctagaaatttattgcatatttgattctactttccaggcaatattcccatgtaagtttgtcttcattttaataaaattgtccccagaaaaataatactactataatttgaatatacaaaaaattcaaataatgactccatatatgctcagtaagtttaatgttctaactttaatcacaccaaagacttcttatattaatataattttgtatatatgcaggggtttcatttctgtatgtaatcaagaactccgctaagctgtttatcctctccatgttcctccagaacattctgccttaaagatctaatttatggttacttcctactccatttttttatttcaccatgactatgcatctcatttacattttatttcctggtctttcctcctctctctactcaaaaactacccagagagcatgacagcagccttgtcttgacttacacaccttacacacacatacacttactttcacaaatatgtgacaaggagaacagtgatgctacatttatattattcttgacagatgaaactgagcacctgtttgctgtatatcgtcggcttggccaatgtcaggtggatgctgcccagatgtcctttgttcatctagaaacatggagccatgatggctacctcactttcctcacaccctaaaccgaattgtccccaggtcccaatcagcagttgaatccatttcctttccttcattttcctttctgctacccaggcatttgtcctcttggaaagcaagacaaagtcttcctgcctcatgcttaatctgctccagtggcattagcctacactcattcctcagagagaacagatccttcctaactcagaattgcacacaaggcacctactcaggagtcctctccattctactccaccccatgtcccttcatagtcaatagccataggctttagtctagagtgacacctctgggacaatgtaccggaatccctagacaaggatctttgttatttgccgtcacacaatctatgtttttctacatttataccaataatttttgtttaaataatttttaatattttagtccctctcctcttaacatataaactcctaaaaatcaatgggttgctcactacggatttccagcgcctagcacagtccttagcatatggctggaactcactgaatttcagctttataaagaaatgaattaatggctgttgtacgcatgtgtgaggagccatgtggaatgtaaatggcagcataccaatgtgtaaagttgtcagaatcaaggaaatggagctaaattgggagccagaaagctaatccatatggatgccaaggagacgaggcttgagacacagagcagtgatcaatgtgaggcatccaaaggctagggaagtcccacagaaacacaggagatgattcaaagaacccttggttgtcctgaaacattgcttttattcatgggctagaggactttcttggcagagggctgaagacaagtgcatgcaaaagtagtttctctaaatgtctcaccagcttgtgttttgaatgtataattccagaactatatatcagccatctctcagtgctgttcagttcttttcatcctgctaaatcttttccatatctctatttagatgatttctcattctttccatctgagactgaactaatggcacaaagttggtgtttccatgtggggatgttactaagaagagtagatagggtctagttagcaaaaacagaccatagaatttttttaaagtctgcccagcatttaagaagatatcagcctgttctccaagtgtccagtcctatctcttgtgtctacaagcctttagcctttttctttttctaaggataagctctcacttttcaaattctgtgtgacattcttaaggccacatacataaacacattttcatctattccaccttgcagtcctggagcagtaacatgactactttttgtggcaaaaaggctgctccttggtctgatctgcattttccagggaacttgcttggcagcctacgatccatcaaattttccccttagtaaatctcagaaaaagatcacccgtaagcataatagtacaggggtagtctgaagtttgactaatattttagagtgctgtagatcctaagatgaaagcagtaagaaagttgaaaaaataatattatttattcaacagacatgctagaaatctcagagcttccctagtcactattttctgtcctgtgcatgtgacataaaactctgcaaaatcagaactgagttctctgtaaaaaaaacattccgaaataaacaagaccagccttgaagggaaggccttgtaatccatggtttattctccttttcttgttatggccaatggcagcacctagattagagtaggtgctcagccatggattcactgaaataatgctttaaaagtatacataattcacagaaatcctctgcgctttcaattacaatgaaaccatctatccattactccaaaatgtgtgaatattaatcattctatttttctagcttttctgcatttgtgatccctttgtactattttttctgttaggaaacagtcaagaaaactgaaaccatggtagtaggtattttaaagagggaataggttaccacatgttagaaggctctagaagttcttgagcagcagtaattatggacataagtttaccttaaatgggcagaattcagatagataacaacaacgaaaagagactgtggttattcacagtgggctaatttgtgtgggaaaaataagtaggtataaatctgtatattccagtatctgtgagacaacaaaaatgggaaattatttttctgagttagttgggtaaagtttaaaagggttgtgctttgtcctgtagacgattgagagtggtttccatatttaaaaaggataaataaactgttctgtgtgcagggtggattagaaatggaagacattggaagcagagagaagttaagggagaacgttgacattatcttaaagtgttaagaacctgaacaaaactcattgcaaaatcattgccagggaatatagtgcagggccattgactgactctagtagtgaatgaggacaactcacagagagaaatctgacaatccatgtttagcagagggaaggaagccaggaatagttattaataagttccagacttcagttttgttgggtattttttttactcccagcgagctaaatttgacaacaatgtagctcaatttctcccaacctcattttgttaatctctacaatcttgccccagaaaagccatttgtaccccagctcagaaaattatgtattaatttgtcttcacaagattgcaaaattttcaaaactgtctgttcatgataattagagaaatacaaatcaagaccacagtaagataccatcttataccagccagaatggctgttattaaaaagtcaaaaaataacagatgatggcaaagttgtgaagaaaaaggaatgcttatacactgttggtgggagtgtaaattagttcagccattttggaagacaatgtggcaattcctcaaaaacctagagacagaaatagcatttgacccagcaatcccatactgggtatatactcaaaggaatataaatcattatattataaagacatatgcatgcatatgctcactgcagcactattcacaatagcaaagacatagaaccaaccaaaatggaaatcagtgacacactggatcaagaaaatgtggtacatatacaccatggaatactatgcagctataaaaaggaacagagaccatgtcttttgcagggacatggatggagctggaggccattatccttagcaaactaacataggaagagaaaaccaaacaccgcatgttctcatttataagtgggagctaaaggatgagaacacatggacacatagaggggaataacacacactggagactttcagagagtagaggcagggagaagggagatcatgaggaaaaataactaatgggtgataggcttgatatctggatgatgaaataatctgtaccacaaacccccatgacacaagtttacctgtgtaacacacctgcacttgtacccccgaacctaaaataaaagtttaaaaagaaagcaaaaaaactcaactttaaagtagctcaataagttttatattgatatcaactttaaataattttttatgcatgacataatatgttattaaaattcatttacctttttaaaaaaagaatgcaagattttagcagagttttcaacaacaatgttatatttaacaagagataaatatctctgatgctttacaaactggtgtttcagtgaattactcttttttttctttttctttttctttttttttttgagatggaatctcgctctgtcgcccaggctggagtgcagtggcatgatctcggctcattgcaacctccacctcccaggttcaagtgattctcctgcctcagccttccagtaccttccagtaccagaaggcacgcaccatgatgcctggctaattttgcatttttagtagagatggggtttcaccatgttggccaggctggtctctaactcatgaccacctccccaactgctgggattacaggcatgagccaccacacccagccaaaatgaattagtcttaattgtgttctattcgtttgtttttcctgcattttcatttcatttcatttcactttgatgaaccaacagaaatacctgatggaatacagtgacagcttgaaaatctatcattccacagtagataaaataatatgtgaaagtaatgagaatttattaattcttctaaaatcaaaatttaaagacataccactgaccctttgttaaaatagcttacagaacagaaatcttagaaaatgggtattagagtttcagaaagctagtcatgttaaaaaacacttttcaaatcaaggctagctacctcataaataatggaatgaaggaactacttataaaaccaaggttccattttcaattgtaaaaaaatgttgatattaaaatagagtaaaataaacattaatttaaaatattttttctgctcacttccagaaggtggaacataaaccacttaagggacctatttcagccccactaaagcaaatggcaaatattgaaactggattaccaaatctatgccttccatttgattggccgtgtaactttttgttttgtgcatggataatggcttttctccttcagtaacccaaaggaaaagctgacattctaacctggagctgcacattcaagctttgacacgttcctctcactgggttcatctaatgcttgtaacaagcctatacagtcagcaactttagaaagatgggttgaagaagtgtctttatcatactttgaatttttccctggggcacttggcagagtcatctctggtgtttcaagtgtgcttaaaagttatctggctgccctcttagaagtttgcataaaaactgctttacttaaaagcagacaaaattaaggtttctgtaacaaaatcataggaatagcatcgagataggacaaagaccaaatatcctgtttccatgtggcagggaaataatgaaatcaaaaatccatgaattcttgcttcatgaagcaggagcttcatgaagctcttcttgaagcaggagcttcatgaagctcttcttgaagcaagagctcatggagtggcatatcatcataccattattaatagaggacattgctaatttctagaagggcttcatgtcctgattattttatcttcttctttctgttgaatttttaacatctatgtctactgcaaagtacacaaaggaaataaattagaacttagaaaagggctttttcacaacctcaaattatagatatatttctttcagaacctcactttagagagaaaatagcaaaaattcagcatcatcacttttgtgacacttcactaaccaatcaaaatatagaaaaaaagagaaattaagtacatttgtattcactgtacatttttagctatttgtttagaagaaaaacaattagcttatttaaaaaccctaaggtgagtatgcagtttttattgttatctttgctgttttgagttatatttttatttttgtatgtataaaaccagtaaataaacctatgtcaaatacttctttacttttgatactagtacaaaatattgatgacttttttagataggaatatctgatatatatctttcagaaattatcagagagttataaaataatatttgggaggtaaggaacacactagacataagaaacctgtataggcaaatactttgtcaccaaagttgtatatttaaaagttaaatcctattctttaatttgtctcttaccaattcaaaattaattcattagaaagcaattttcctcaacacttaatccctagttgttcatttctttcactagctagtataccattgctcattgcttcatagctaaactctgtttaaatctgttaactgaaatgatttttaaaactttttgtccatttttcacctattccgtttgacattggtcttgtatgatatcatgatacaaaggaaaatgaccctacaatgatatgattcataattccaccacaaatttccttgatgcttggaaagtgtgattaatgtattttgtccccctccttttttttttaactataaagcaagtacgtgtacaacaatgccattttttcaactccaaataaatagaaacagctataggactaaagtttcttatatgaatcttatagtttacttagcacgtgctttaataaagtttcctctccaggaaactagaaaattgtaaatggtgtaagtcttgatgttttgtcaaaaacatatgtaatattcatatagcagagctttggtcttatgccatgaacaagcaggaggtgcttctggaactgtcctattgattttcacacattatttattagaaatgactgctgccattcccacatagtgctaagtgtgaacacttactgtatgtatgtggtctcaatattattttgttgttcacaaaaccacgtatatcctcccatcgaaatattgtcctcatcttaaaagtaaatggcactattttattcaatggtttatattttggaatcctaaccagatattttttgccatgaatttcaagcactgcattacttccaacgacatgctatggctataaggaaattatatcaaacatgagtaaattttgttgaccaagactatagatgtagcaataccattatataacagacattgatggttggtgaaaattacccccaaatgtccaatgccatgagtataatttgaatagctcttagtttagtttctattaatattatatgaaggtcatttgtaagcctgcagacataattcatagaatatactactcagatatttgggaatgtactacttaagtatttggatatatttaattccaaatatatctctactgtgatttttttaggagatacaattgccatcacagtaagatattgctgattcagatgaaatttttaattaactagaaaagtcaaagaatgcaattctttttcaagatttcttcaaataaagaaacacgcaaaattaggctgtggttctgtgaataacaataagaagtatggagtcaggcaaacctcaggttcagtcacagttcgactcgactgttaagtagataataatgctaagggtgtgtttttgttctcttaggtttgtggagacaggtagcattccacagaccgacattgagcctaccccacgactattcaacctgcccattattgggtagctttcatataatcagttagaaagaaaacatctatgaaaactatttactaaagaattatatcttttaattaagagtaccgaacatggtcaagttagagaacaattgagtagaaaccttctattcaaatataattgagaccagttgtttgatacttaatctaaaaagtgagttaaggaggaggatcatggggttaaaaatacacacacacacacaaatgtaaattaattggccaatattttgatataagtccaggaccctttgattatcactctattaactggagtttctatacattgtcttctttgtataaattatgatcataacaagtcaattataattctaaatttttatttgtttaaagtagaacaaaaacttaaagtaattgaagtacgaaaacctttaacttattaaaattttgttattctgattattctaattttacaattttttcttaaaaattttacagttgcttagccctcatattaatcaacttagctttttctaatcttttcaagacccaacatatttttacataaatagcaccactcttttataatcacatcactaattttatttatgtcacaaaagactaacttgaatacaacctaaacaaactggctggtggataaattaacataatgccaagttgaggcagcagactaggcataatagaaaacacactgttattttacagggagaatgtacagtgtcagttcattcaacaagttagttaaacacaactcaactaaaacaatgtcaatgaaaagtaacaaattctgtgtttgttccatggacttacagccagtgagtcctgagaaagaagagataatttaaagagcttcattggcaggtgaatctggacttggccttttagcttagagactgaagctccatattaaaagcaggagaaggatagagaggcatcccacatgaagaaagaaatcagaacagacgtgcagaggcaaaagtagtcatggtctgcgtcctggctcaggaggacagtatgtgttgaagagcaaagcctggaatgggctgatgcctgaaacctgacgccaccccacccatgtgctttatctactcacactgtttgcccaggaaatctggcactccacaatgagaacaggaactgggtgtcccagctaatcttcactaatcttcagctcggtgggtcccatagggttgtcatatttgaaaaaaataacaataggctttgattaaaatacttggagatgaagcagaatgctcctgccaaagcttccctcaattaacataagaggaacaagtttatttcccaagttaattatagtataatttaccaggtatccaaataaatgtgtttagaggataagagttttcccctcgaaaaattcttgaccgtaattttacatataattcttttattcaacaaatgttcaatgtatgtttgttttatatccaacactttttaaggaattaggaataccatggtgaataacatagacaacttctgctaaatgcttagatgatgaaaggcaaacaaatatataagaaagaaaataattaagaaatacagttttatgcctaattatgtcaggtggtggtaagtgctgtgtccccaaaacacttactgattttctcaaactattataaaacagagaaggcgcataaagagttctggacatgggactgaagattctgttttaaatatggttgccaggtacgtccttactgtataagaacattctccatcaaggacttgaaggagatgagggaagtcatcaagtggatgtaaaaaataacactgctagtaataggaccagcaaatgcaaagaccagaggagaaagacatctgctttgtttaagggacagcaaataggtctccctgctacagcagagtgaataccgtggaaatggtagaagagtttttagttgtaaggcaagaagagggaccaaccatagagagtcttagatgtcatcgtggagatttctatggaggtgaaatggaagctacagaaggcaatagaggctgatatggttcacagctttaatagtctgctgtctgctgagataagaattgactataggacaaagagtagatccaggtagtgagatgttattgcaatcacctaggaaaaagataggatgatttgagctagagttgtagtggagagaagtggtcatattttgaaaatatttttaaagtagagttgagaggatttggtgttgaatttgacatgggatgtgagtcaaatttcagagcctgagccaaacgtccctatttaattatgattaatataatggaaaaggtggggggaaatggattaagaaaagaaagaagtttgatgtgggaaacaggtgaagaaaccagtagagatgttagatatctaaatctgagttcgggagatttgaatgcatagaaaatttgatcattagcatggggctggtatttgaagccatgagactggacagggtcattttagtttagtgtatttccacatattatatttcaagcatcatgctagatactttaacgtttggccattttaaaagccccttggtaaatttcacaggaatgaggatttgactaacctgttgttctcagatgtctgacctcagtaggatgctttattttattgtatttaattccctataaaattccaaaatatcaaaataagacctatgcttattagcaggatttttcatgtacaatattcctactcagataggactatatcacttaatttcacagaagtatccttccctgaggtgatgatactattatatcacaatcatgaagtcatgctgacttgtaggcaacaatggagctcacattttgatctaaactaatttgcatgaattacttaaattatgaaaatacacactttcagagagcagacagattttactctgagttgtgtcaaactatcacttaatagttctcaagggctcaagtgtggtgaaaccagatgctagtgtatgtgtttcctgttcccttccaatttttttcatcatggttcatcagcaaatgctatgaagtctaattaatataactaatggatctcttggccattggaccatatatttacatgaattgctctgtgaaagagctctctctcatgcactctctctcgctcgcgtgcgtgctctctctctcactcctgcgctctctcttttcctctctccacccccccaccctccccacccccttctctttcaagagcggaacactttagtgacctccatttaactggctgaactaagcagcgatctctaaggtaataatgcactgctaagaaacctcagcatagactataatgctaccactaaagcttctgttcatgttgttctagggctcatagaatggaatattgtaacctagctctgaggaagtttgagattgtctcatattttctcggttaaactagaaaataattaattatagggaagggacaagaattgccctggcagagccagcctgagaaataatttctgttcattctcaatgtattatctgctttgtccctagaggccctcttttgttactcttatatcaaaatcctttggccacttaattttcctgccatgtcaactcaaaaatcatacctacaaaagagattcaactcttttcaacaaaaagagcttcaacagcttcaactcttttcaacaaaagttttcaacttttttcttttgcaaaaatatgtgccagctatgagattgtaagctttatagttatacatagatgtttttatttataatctttctcctgcaaaacaggattagagaaagtgaagcaaaaagaacatgtaataagatgaataatgaatagaaaaataaattgctctaaagacaaaggaaactataaaaggtagatgactagaactgtttagcaagaagagacctcattctttccatcaaatagtgtggtgtaattagcacaatgcacctaatggttaatgaatacatatttgttgaggatatcattaataaacaacatgaccaatgaaaaactagtgaaaaagatttttactcttcaggaagtaactattagataggtattgtacattccatctttaaaaggtagaggaaaatatatattgatctgacccataaacgcaacgggaagacacagagtaacaattattgccggtgaatttcagctctcagtctatctaccaacctgtgtcaccaggaaccttcttcagacccgtgcatccaactgcttatttatcttttgcacctggatatccctcaggtacctccatttaattcatcttcttcctccaaactggtcagcatccaaccagatccagagaactgtgaagagctattctagtctccaccctttcccctgttgctgatccagttaagaggtccaaagaatgtagttgagaggacaccatctctgtatctagtagcatttagttttaacctcatcccttaacttaaaatcgacatggccttcagtaagcgatttacctcctctgaatatcaattgataaaataaaaaaaattccaaaattaattgtattgaggattaaaatatcatgtctggtatatcacaagctctcaataaacagttgtagtattgttattcaaattggtacacaggcctatcacttctccttccttttagatctttttttccctctgttctcgcctctgagtgccccaacccaatctctcttcctctgtcacctttttaggaaatccatccccacccaactcaccccaccactcctcacattccttacattcctttctctcctaccctggcctccaccacagctcctccatccccacctgtaatccagcctctacacgactatcagggctgtggttctgaaaagcaaatcttatcatgttgcaccttacgacatctttgaatcacacctacttgtctcatgataaattctaaactcttcagttttaggctgaccgtgaccatttttggtcagaccctgtccgtctcgccctcctaattctcatttctctctaccaaatactccaccccttgttctgaacaacgtggttctgctttcatctcttcatacttaaattttttcctagacccttaactttgctcacaatgttcctgccatctggaatagcattttccctgttggcctagaaaatttgactattcctttgtggtggaattcagtcttcacctccccgtgagtgaccttcttaggacaaattgactgcatttcattttgtagtctcacagttcattaggcagtcttcaaatgtccagtatgacagtgcaagatatttgttgtttatatgcatatttcccccactggctttgagaaacttgagggattgttgtagccatttgtatccccagtgtgtagatgcatagcatgcatctatttgtgttttgaatgaatgagtgaattaatgaatgatgagaaagcaatgacctatgttttgtctctacctcttacattataaatagactgattcaactgaagtttccagttcctattccttttgctgttgtcattgtatatgttagcaaaaagcttcatccctttcaaaaatttattctgtaatagcaataaattcagtgtcttctgggagcaacattgtgctctctctctccccgttttgcctattgctactttgaagagtatgtgtttatgactttatagattaatttgttaaagtgcacgtaataggagccctgctatttcttcataagtggttatgaaaaaatattcacacttgcttatgttttgtgaacatctatatgtggtggagcacatgttattataatcttattttaagtggaaatatagatttaaggattttcttttactgttcttaatgtaaagcttctaaattagatatacataagcactcatctagaagataatggaagcataagcaaaacacagaaaaagacttgccaagaacaaattataactaacaaacaagtgttagttttattgcaatacaattactgaattagtacatgatagaacaaaagatctataacaagtttagatgtcagtaatttatcggacacgggttgtatacattgtacctacaaaattttatcaaatagtttctatttcaagaaattttcagtttattcatgttcaacacaaaagttaattatacatgaaatataaactgaatggaaaacactggcattgtatttcctggctttctgggaagaatgtgggagtagggttaatactgaaatgcaagacaaagctcttttctcctctccttgttcccaggatagaacaaaatacacacggccaagaatgaggaaagtaggacaaaacccagtgtagtcaagagagttatgaccctgaggtgtgaggtaagatctggccctgggagtgttgactgacactgcagtatttagtgtctagactggaatgattagatatgaagtgggttaacttggggtctttagagatggcgctattcccagaaagataaatgagatccagtcctaggacaaaaggacaagcatcattggtcagaaaaagaaaaaatgatttagaaaaaaaaggaaagagagagaaaacgtagaggaggagaagaaatcccaaggatggagaccaaagggtttgccagacagtctgttccttgggaatgtgggttacatagcaacctggaagatgacgctacttccaagcccaagattctgtctccatgacttagcacactagtcatgaagaaatagaacacatctttctctttctagatctcattctcagttgaagaaccgctacttatggcctgctagagtgaaactcatttgttctaggaattaatgaaattggacctgctggaggcctttaattattatgtggacatcagaactgatgaggattgatgtgggttatttcaataaagtgttataaataattcatatatgaaaaatttactttttctattaatttataattacattaatattgcatttcagtgttgttattcaaactaaagaccatgtcagttcttagacacaatctctcactgtgtattaatctgaataagacattgtagtaaccacatatatatattactttttgagctgttttaggtttccaggcaaaaattagtgaaaattaaagtgtgtgtccaaagactctctcactccacccccatttctcctatttttaacatctcgtggtatttttaacattagtatgttacatttgttacaagtgatgagccaatgttgataaatcatttttatctgaagttcataattatattagggttcactctttatgttgtccagtatatggattttaatagatgtataataagatgtacccatcatgacaatattacacagaataatagtttaactgccctaaaaatcccctgtgctctacctagttattcctcctttctttcctccccaggggcccctcgaaatgactgatcttcttactgtctgcacagttttgcctttttcaaaatgtcatatacttgaaatcacatagtatataggctttcatattggcttctttcactcagtattatgcatttaaggttcttccatgcctttttatggctttctttctcttttttattttttattttttttgtttttgtttttgagacggagtcttgctctgtcacccagggtggagcgcagtggcacgatctcagctcactacaacctccacctcctgggctcaagggattttcctgtctcagcctcctgagcagctgggactacaggcgtgcatcaccatgcccagctaatttttgtatttttagtagagacaggatttcaccatattggccaggcaggtctcgaactcctgacctcgcgatccacccacctcagcttcccaaagtgctgggattacaggcatgagccaccacacccagccggctctctttttttatatagcactgaataatattccattgtatggctacaccatagagtgtttgtctatttgcctattgaaatgtaccttggttgtttctcttttggtaattatgaataacactagcataaacacttttctgcatgttttgtggggcataagttttcaactcttttggcaaataccaaggagcataattaaggaatcatatactaagagtgtgcttagtgtcataagaaactgctaaactgtcttccaaagtggatataccatttcgcatccccactagcaatgaataagaattatttctgctcattgttttaccagcactcagtagtattggtattttggattttggccattataataggtatgtagtagcaaatcattgttttagtttgcaattttctaatgacatatgatgttgagcatcttttcatgtgcttatttaccattagtagtatgctgccatcagtaattttcctttccctttccattgccagtgagatccagtagttctatttatttatttatttatttgagatgtagtctcactctgtcacccatgctagagtgcagtggtgcaatctcagctcaactgcaacctccatctcacgggttcaagcaattctccctgcctcagcctcctgagtagctgtgattacaggcacccaccaccatgcccagctgatttttgtatttttttagtagagaaggggttttgccacgctggccaggctaatcttgaactcctgaccttgggtgatccaccctcctcagcctcccaaagtactaggattacaggcatgagccactgtagccagccagatctaatatttcttaatggaaactaaaacttcacctgttaccacatttttccacatatatttgtaataagttctgatgtctgataaggcaagtctgaccctctgcattttaaaaaaataatcaagttatttatgaaaaattatgctcattttttttttttttaattttttttttttttattatactctaagttttagggtacatgtgcacattgtgcaggttagttacatatgtatacatgtgccatgctggtgcgctgcacccactaacatgtcatctagcattaggtatatctcccaatgctatccctcccccctcccccgaccccaccacagtccccagagtgtgatattccccttcctgtgtccaagtgatctcattgttcagttcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattaccattctaactggtgtgagatgatatctcatagtggttttgatttgcatttctctgacggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtacttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgccctgctttggtatcagaatgatgctgggctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgggtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgctttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcagaacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttggctctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttgtttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgttgataccctttcctccagttgatcgcatcagctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaataattctccatccagctttgttctgttgctggtgaggaactgcgttcctttggaggaggagaggcgctctgcgttttacagtttccagtttttctgttctgttttttccccatctttgtggttttatctacttttggtctttgatgatggtgatgtacagatgggtttttggtgtagatgtcctttctggttgttagttttccttctaacagacaggaccctcagctgcaggtctgttggaataccctgccgtgtgaggtgtcagtgtgcccctgctggggggtgcctcccagttaggctgctcaggggtcaggggtcagggacccacttgaggaggcagtctgcccattctcagatctccagctgagtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttccaggctgctttgtttacctaagcaagcctgggcaatggcgggtgcccctcccccagcctcgttgccgccttgcagtttgatctcagactgctgtgctagcaatcagcgagattccgtgggctaggaccctctgagccaggtgtgggatatagtctcatggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctccctcaattatgctcattttagaatcaaatattttattaaaatcaatgaccatattagatttattggaaaaataatgtaatttaatattaaattatcacattcattaacatgacataattctccacttatttggatttcctttaagatcaattcctaaaattttctatatagatggttttagggttttttttttttataccttaaactacaagatactttatagtgtcccaatttttattacagttttacaccttcaattcaattattgctgatatggaaaaactttttatcaatatctattttagatttagtgggtacatatacaggttttttacatgggatactgcttgatgctgaggtttggagtacaaatatttccattaaccagatggtgagcataatatggaacagttaatttttcaacccttgtccctctccttccctcccccatctaatagtcttcagtgtctattgttcccacctttatatccatgtgtaccctatgtttagctcccacttacaaatgagaaattactgtatttatctatctgtttctgagttagttcacttaggataatggtctccagctacatccatgttgctgcaaagaacatgacttcattttttttatggctgcatagtattacatggtgtacctacaccacattttcttgatccagttcaccgatgagggacacctgagttgattccctttctttgctattgtgaatagtgctgcaatgaatatacaggtgcaaatgtcttttggtaaaatgacttattttcttttagatatatacccagtaatgtgattgctgggtcaaatggtaattcagctcttatttctttgagaaatctccaaactgctctccacagtagctgaactaatttacattcccatcacacacaggaaggggaacatcacactctggggactgttgtggggtggggggaggggggagggatagcattgggagatatacctaatgctagatgatgagttagtgggtgcagtacaccagcatggcacatgtatacatgtgtaactaacctgcacattgtgcacatgtaccctaaaacttaaagtataataataaattaaaaaaaacaaaacaaaacagtgtacgtgtgttccctttcctccaaagcctcaccaatatcggctattttttttttttttttttttttacattttaccaaaagccactctgactggtggaggatatctcactgtggtttggatttgcatttttttgctgattagtgattataagcactaatatggtttggctctgcgtccccacccaaatctcatctcaaattgtaatacccaggtattgagggagagacctggtgggaggtgattaaatcatgggggtggtttccctcatactattctcatgacaatgagtgggttctaataatatctgatggttaaaaagtgtttggcagttcctagctctctctctgtcctgctgtcatgtaagacatgggccttgattccccttcaccttccaccatgattgtaagtttcctgaggccttcccagccatacaggactatgaaccaattaaacctttttccttttaaaattgcccagtctcaggtagttctttatagcaatgtgaaatggactaatataggaaatgggtaccaggagtgtggcactgctataaagttaacctgaaaatgtggaggcgacattggaactgggtaatggacagaggttggaacagtttagaaggctcataataagataggaggatgtgggaaaatttcgaacttcctagagacttgttggatggttttgactaacatgctgatagtaatatgaaaagtgaagttcaggctgaggtggtctcaggtggagataagtaacttactggaaactggagtaaaggtcactcttgctatgctttagaaaagagactggtgacattttgctcttccctagagatctatggaaatttggacttgagagagataatttagggcatctggtggaagaaatttctaagcagcaaagtattcaagcggtgacctggctgattctgagagcattcagtcatacatgttcgcaaagagagtatctgaaactgaaacttttatttaaaagggaagagagcataaaagtttggaaaatttacagcctgaccatgaggtagaaaataaaaacccattttctggggagaaattcaatccacctgcacaaatttgcataagtaaatgaggagccaaatgttaatagccaagacaatggagaaaatgtctccagggcatgtcgagatcttcacgacagccccttccatcactggttcagaggccttgaagggaaaaatgatttcatgggtcaggcccagggccctgctactctgtgcagactcaggacttggtgccctgcaacccagcagctccagctgcagatatagctaaaaggggcccaggtgcaactggggctgttgcttcagagtgtgcaagacccaaaccttggtggcttccatgtggggttgggcctgcaggtatgcagaagacaagggagcacaatgcctagatttcaaaggatgtatggaaatgcctggatgtccaggcagaagtctgctgcagaggcagggccctcatggagaacctctactagggcaatgaagaggaaaaatgtgtaggttgtttctcctaaacagagataccactagggcactgcctagtggagctgtgagaaaggggccaccatcctccagaccccaccaacagcttgcacatgcacctggaaaagcctcaggtgctcattgccagcctgtgaaagcagctgcaggggctgtactctgcagagccacaggggaggagctgcccaagggcttgggaacctagtgtttgcattagcatcccttgatgcaagacatagactcaaaggagattatttcaaagctttaagatttaatgactgcctctctgtattttggatttgcatgggcctgtcatccctttactttggccaatttctccaatttgcaatgagaatatttacccggtgcctgtacccacattgcatcctagaagtaactaatttgtgtttgattttaaaggctcatagatgaaagtgacttccctcatctcagaggagactttggacttagacttttgggttaatgctgcagtgagttaaaactttgggggattcttgggaagacatgattgtgttttgaaatgtgaaaatgacctgagatttcagaggggggcatgggcagaatgatatggtttggctctgtgtccccactcaaattccatctcctactgtaatccccacgtgttgagggagagactaggagggaggtgattagatcggtgtagggtggggtcccccatgttgttcttgtgatagtgagttcttattgtttaaaagtgtttgacagttcctacgtcactctctctctcctgcttctatgtaagaagtgcgttgcttccccttcaccttctgccataatgtaagtctcatgaggcctccctagccatgcagaactgtgagtcaattaaacctctttcctttataaattatccaaactcaggcagttctttatatctgtgtgaaaagggacgactacaagcagtttttcatgcttgttggccacttgtatgtcttcttttgataactgtttgttcatattttttgctcactttttaatggggttatttggcttttgattgttaatttaagttccttatagattctagatattagaccttgcatagtttgcagatattcattttgaatatttgtgtgtgtggttgttcatcacttattaacacccttgtaaaatttgcttataagtcctgatggcattgtgtttatttgattagccttttctatgggtgataacagcatctccaaaaggtaatagattgtatttccttccaagtatttatatctgtttttttttcatcttgtgaaatttgccaagctctccaatactatgcccagaagaagtgatattgatgatcatcgtatcttttcccttaattaaagggaatgccctaaaataattatattagtacatacaacagacttttggtaggacttatgaagttgaagaagttctcttgtattaaaaattttatgagttttttttttttttagttattataagttctggggtacatgtgcagaaagtgcaggtttgttacataggtatacatgtgccatggttgtttgtggcacctatcaacccatcatctacattaggtatttctcctgttattatccctcccctagtcccccatcccatgacaggccccggtgtgtggtgttcccctccctgtgaccatgtgttctcattgtccaactacctatgagtgagaacatgctgtgtttggttttttgttcctgtgttagtttgctgagaatgacagtttccagcctcatccacgtccctgaaaaggacatgaactcatccttttttatggctgcatagtattccatggtgtatatgtgccacctttctttatccagtctatcgttgatgggcatttgggttggttccaagtctttgctattgtgaacagtgccacaattaacatacgtgtgcatgtgtctttacagcagcatgatttataatcctttgggtatatactcagtaatgggattgcttggtgaaatggcatttctagttctagatccttgaggaatcatcccactgtcttccacaatggtgcaataatttacactcccactaacagtgtaaaagcattcttatttctccacatcctctccagcatctgttgtttcctgactttttaatgaccgccattctaactggcatgagatggtatctcactgtggttttgatttgcatttctctaatgaccagtgatgattagcttttttaaatatgttagttggctgcatatatgtcttcttttgagaagcatctgttcatagccttcgcccactttttgatggggttgtttgtttttttcttgtaaatttgtgtaagttatttgtagatcctggatattagccctttgtcagttggatagattgcaaaaattttctcccattctgtaggttgcctgttcattctgatgaaagtttcttttgctgtgaagaagctcttcagtgtaataagatcccatttatcaattttggcttttgttgcccttgcttttggtgttttagtcatgaagtctttgcccatgcctacatcttgaatggtattgcctatgttttattctggggtttttatggttttaggtcttatgtttaagtcttcaatccatcttgagtcaatttctgtatgaggcataaggaagggatccagtttcagctttctgcatatggctagccagttttcccaacaccatttattaaatagggaatcctttccccattgcttgtttttgtcaagtttgtcaaagatctgatggttgtagatgtgtggcatgatttctgaggcctctgttctgttccattggtctatatatctgttttggtagcagtaccatgctgttttggttactgtagccttgtagcatagtttgaagtcaggtagcgtgatgcctccagctttgttctttttgcttagggttgtcttggctatgtgggctcttttttggttccatatgaaatttaaagtaattttttccaattctgtgaagaaagtcaatggtagtttgatggggatagcattgaatctataaattaatttgggcagtacagccattttcacgatattgattcttcctatccatgagcacggaatgtttttccatttatctgtgtcctctcttatttccttgtgcagtggtttgtagttctccttgaagaggtacttcacaacccttgtaaattgtattcctaggtattttattctctttttagcaattgttaatgggatttcactcatgacttggctatttgtctgctcttagtgtataggaatgcttgtgatttttgcacattgattgtctatcctgagactttgctgaagttgtttatcagcttaaggagattttgggctgagacgaaagggttttctaaatatacaatcatgtcatctgcaaacagagacaatttgagttcctcttttcctaatttgaataccctttatttatttctcttacctgattgccctggccagagcttccaacactatgttgaataggagtggtgagagagggcatccttgtcttgtgccagttttcaaagggaatgcttccagtttttgcccattcagtatgatactggatgtgggtttgtcataaatagctcttattattttgagagacattccatcaatacctagtttattgagagtttttagcatgaaaggctgttgaattttgtctaaggcctttactgtatctattgagataatcatgtggtttttgtcactggttctgtttatgtgatgatggattacgtttattgatttgtgtatgttgaaccagtcttgcatcccagggacgaagctgacttgatcatggtggataagctttttgatgtgctgctggaattggcttgccagtattttattgaggactttcacatcgatgttcatcagggatattggcctgaaattttctttttttctttttttttaattatactttaagatttagggtacatgtgcacaacgtgcacgttagttacatatgtatacatgtgccatgttggtgtgctgcacccattaactcaacatttaacattaggtgtatctcctaatgctatcccgcccctctctccccaccccacaacaggcactggtgtgtgatgttccccttcctgtgtccatgtgttctcattgttcaattcccacctatgagtgagaacatgcagtgtttggttttttgtccttgcgatagtttgctgagaatgatggtttccagcttcatccatgtccctacaaaggacatgaactcatcattttttatggctgcatagtattccatgatgtatatgtgccacattttcttaatccagtctatcattttgaacattcgggttggttccaagtctttgctattgtgaacagtgccgcaataaacatatgtgtgcatgtgtctttatagcagcatgatttataatcctttgggtttatacccagtaatgggattgctgggtcaaatggtatttctagttctagatccctgaggaagcaccacaccgacttccacaatggttgaactagtttacagtcccaccaacagtgtaaaagtgttcctgtttctccacatcctctccagcacctgttgtttcctgactttttaatgatcgccattctaactggtgtgagatagtatctcattgtggttttgattttcttttttattgtgtctctgccaggttttggtatcaggatgatgctggtctcatcaaatgagttagggatagctgttgtttagaatagtttcagaagaaatggtaccagctcgtttttgtacctctggtagcatttggctgtgaatccgtctggtcctagactttttttttggttggtaggctattaattgctgcctcaatttcagaacttgttactggtctattcagggattcgacttcttcctggtttagtcttgggagggtgtatatgtccaggaacttatccatttcttctagattttctagtttatttgcatagaagtgtttatagtattctatgatgctagtttttatttctgttggattggtgttgatatcccctttatcattttttattccatctattagattcttctatcttttcttctttataagtctggctagtggtctatcaattgtgttgatcttttcagaaatcctgttcctggattcattgagtttttgaagggttttttgtgtctctctctctttcagttctgttctgatcttacttatttcttgacttctgctagcttttgaatttgtttgttcctgcttctctagttcttttaaatgtgatgttagggtggcgattttagatctttcctgctttctcttgtgggcatttagtactataaatttccctctacatactgctttaaatgtgtcccaaagattgtggtacgttgtgtctttgttcttgttggtctcaaagaacatctttatttctgccttcatttcgttattttcccagtagtcattcaggagcaggttgttcagtttccatgtagttgtgcaattttgagtgagtttcttaatcctgagttctaatttgattgcactgtggtctgatagacagtttgttatgatttccgttcttttgcatttgctgagaagtgttttacttccaatgatgtggtcaactttagaataagtgcagtgtggtgctgagaagaatgtatattctgttgatttggagtggagagatctgtagatgtctattaggtccacttgttccagagatgagttcaaatcctggatatccttgttaatattctgacttgttgatctgtctaatattgacagtggtgtcttaaagtctcccactattattgtgtgggagtctaagtatctttgtaggtttctaagaacttgctttatgaatctgggtgctcttgtattgggtgcatatattttggatagttaattcttcttgttgcattgatctctttaccattatgtaatgcccttatttgtctcttttgaactttgttggtttgaagtctgttttatcagagactgggattgcaacccctgcattttttttttttttttttttggctttccatttgcttggtaaatattcctccatccctttattttgagcctatgtgtgtctttgcacatgagatgggtctcctgcatacagcactctgatgggtcttgattctttattcaatttgccagtctgtgtcttttaattggggcaattagcccatttacatttaaggttaatagtgttaggtatgcatttaatcctgccattatgaagcctagctgattattttgcccactagttgatgcagtttcttcatagcatcaatgttctttacaatttggtatgagtttttaacaaataaatactggactttttcaaatgtgtttctgcttctattgcaatgctgcctaaattttctcttgaagtcaagtctatgaatgtgttgaattaacttgttacattttcttatgttgaaccatctatttagcatacatttatgaccatagcttgtctccagcttttctctgaggttaccctgccacatttgacagatgtgttttcttgcctcatgatagaaaatgaggagaaaattaggcactgttttgccctgatacatacaaaaaagggaaaatagtttagctgcaaaattttccattcagatcattctctgtctttggcatctagtctacatcttcttcaggttacaggtatctttcttagggtttcttctgggttttgtgttagtttctgattgtggtgatgaaattcacatgatagactgtaatattcttcccaattctttgctgtttcccccaagaggtttacacttaagactttgacatcatgctaaataatttgacttgttttatgcaataaaatatgagtgaataaaccaaactggaatgatgattaaacatgtgtctaatttatttttgtcattttaggacacatgacaacatcttaaatatattaaaaaattatttttaaaatttggattgatggccataaaaggaaataagtcatacaaagaaataaccctggatctaaaatgcttattatgttgtagtattcttcatgaaccatcaaatattatgtctctttcaccagaccaacattaaaatttgatgttttggctctcaatgtgtggaaatcacctacacacctaaactcacccacgttgtaaaataatttattagcaagcatttacaaaatccagatattatgtggagttgcattatctattgagaattcaattttcagggatttttcagggtctgaaatgatgctgaatcttgaaatatctgcaacaaaagggacatacatggcagtgaaggagccccaaccacctgcaggagtgtatcaatccagctgcatattgatatgattagacataagagctattaagtatcacagatttcaatcagtggaataactgtaagaaaggaagaagaaattctctttagtgcaatatctatagaggccatttcttgtatatttcacaaatcacaagtttcttcatattcctttatctcataatccacattctagcaatctattttagaatcgttggcgaatagatgaaaaagtgataaatgacttggcataccagagacatctaaaaatggaattcattctgggaagaaatactagggaaaataaaagctaattccagtctctgaactcagaaaagatcaggaaataaaggcctcacatgcattttaaatgtcaggggacaggataggacttaaatgataagctcttccagaaacccctgtcatttcaaagatgtaggtaactacttttctcccctgttataggagatgggacgtgcactctccagaggaactgaatggaagggagagtagcttgcagaataccaagcactgatcctcctgcctcacagtggcatggtccttagttacctcctttgctatattctgcccttttatttaaacttttaacaatgaaaatccatagagtttcatccacaagtatcttatgttctctctacactcacatcctgaatgatcttttccagtgtgtggctttaaatccatatgcatgctgatgatatagctctatgtctctgaattcttgattggtctatccaaatctttattcaaacatctctacccagaatgtctaaacagcatcttaaatttccaaagtgaattcttttcttctcctcttgccccctccccaaagctctgctttattcaccttcctttcaaactaagtaataattctgttcttcttgatattctggccaaaaatcttggatgaatccttgagttaccccatgatccgtcagaagcaatagaaatccataaggaaatcctctcgattctatctcaaaatgtttccagtatccagtcatttttcatcacctctccagctacctccccagcccaagcccccattttctcttctgggttattgcaacagtgtcctaatggttcttatacttcggtccatcatcgcctattcacaacagggcagccacagttatttttgtgaatgcatgtcacttttctgctcaaaactccaatggctctccatctcattcagagaaaaagctaatcggtgtcttgcatatgtaactctatgtgatctccactccctcctccctccatgacttcccccttgttcattttgctccagcaccactggtctccttggctcccccaacccggcatattccacttcagatattcacactggctgcttgacctgcctctaaagctcagatgggaattgttcagagagacctacctattttaaaattcaattcttcccccacccttatactcctcatccctatacctggcatatatatatatttatttatttatttatttatttatttatttattttagtagcacttaccaccttcgaatgcactatgtaatgtagttatttatttctaccttcctccaataatatgtaagctccatgagcacagggacttttatcaattaccagaactcacaataatacctgacatgcaatagggactgttttcaaaagaataaattaattaaaaatagagaatagggaagaatatgtacatgtgtcccttggggggctgggctaaggaataggagagctcaatctttatccttaactgtaggagatatgatagataatatctaatactagaaattcagaaataattatataagtactttatttagaaatagggagataaacacctctctggaaaagcaatattatatctgccttttgaaagtctagggttttttgtctttatttgtcatatagaactctttgaatctgtaaaccatttattttaattacctgataaaatttttcagtatagaaaagggttaatattatataaattcattataaataatttattaagaattattaaaattgatgtataatttttttatatttataagatgttataagtttatttaaaaatttatatttattcataaagaatataaatattttagatatattttattcacaacattgagcagcatgttactgttaattgggggaagggtatacaaatctaaaatgtagattttaattaactagtgttctgttcagtaagtttaaatatagtcctgggaatatcgatttgtaaataaagaaatgagcaaatcacctaaaattttacacacatgggaattcatttaatatttaatagatttttcagagctttagagatcctagtttattctttacccattattttgttaaataccgttgttccatgaaagaaataaaatgtttccatcataattctggataaaattgtattctaatattatcctcattggaaataaaatatgttaacttggactatgcaagtaattctggctggatgacacactgaagtcatttctctcattggcgttggaagtttacatttctaattacccttaaattgttggagtaaaccaagagaacaatgctttgcttaaattccaatttgtaaaatctttcctaagcttttatgtttcaaaaataaccctttctctccaatgcaacaaacataaaaattaataaaaaattgcagccacagttaagtttggtattatgaagtgctgcttagaccactgtgaatgctgaagttgaatggcaatatgagagaatttccatgaacaaatattgactactaatgcagaataaagttttctcattctccaaccaaaacaattaaaaaggaaaattatgtttattaaaagcctatttatctctaggcttttagccaaacccttttgaagatgattttcccaattggaaaattatcagaagcaaaatcctttcaagaatacgggatttcaaaattcatcaaattaaattattctttatatatgatttctttcttaaactcacaaaaccactaatatgtgaaatattacaaatgatgacctattggttattgtcctttggtttaagaaaaaaggaggaaatccacttatggaagaatttacctatgcattttttaatactaagaagtcaattttgcatcatcgggcatatgcagataataagagttctgtatatttgaatattttgcttaagagtatatatatatacatatacacacacacatatatatacttacatatatatacacacacactcttagtgtgtaaatatatgagtgtatatatatatactcaatgtgtgtatatatatgagtatatatatatacacttatatggatatatatatacttgaatacatgtatgtgtctaaatactatgttctaagtaagatctttaatgatctcgatgtgtagggtctttgttaagaacagtgctcatgggactgcaaatatggatgtactagaattaatattatggcaaaaagtttagtgattgtgttactctgattaaattgaaagcatgtgaaattaagtgacatatctctagtggtcatttttttgtcttgccaacaagctccacctaataatttaaaactaacttcgaggaatttttatttagctattcattcaaataagttttgaatttagtgtagtaaggtaaataatttattatttctagtgaggttctatattccaactttgatttctattgacaattcattttacttcgtttttgtcaagacaggttattatgcagtttaccaagactaaatagaatatgaattttattctgagtaagtttttatagggcaatgtctactacagaagcacctagctacatatggctataaaagcaatgaaatgtagctattccatattgagatatactgtaagtgtaaagtatacagcagaatttaaagacataatatagaaaaaataagaatgtaaaaatctcatcaataatttctttctatcttgaaataatttttgtaaatattgggtgaaataaatacataatgtcataattaatctcaactacatgttttcctttttaatgttgcttttcaaaaatttaaaattatatatgtgacttgcattcctggctcacaatacgtctatgttggaaagcaatgtataaagttattttttaaacttctatctttctcttactaaatagtattaaacagtgagtttgcaagcttttaaaaggcaataaagggctgggcacagtggctcacacctgtagtcccagcaatttgagaagctgaggcaggaggattggttgagctgaggagtttaataccagtctgggcaatagaacaagacctcatctccaccaaaaaaaaaaaaaaaattgcttggtgttgtggcatacctgtgtaatcccaactactggggaggctgaggtggaaggatcccttgagccctggaggttgaggctgcagtcaaccattattgtgccctgcactccagcctgtgtcacaaaaagaaagactctgttgaggtacccagcctagaagtagtccatcaacaaatattaatataataaataatatacaattaaatgaacagaaaaaaattcctttaatatctcttttcctttattgtacaattgattcatttgccatgtttgtagggaaccattttcaaaatgtcatacgtaatcagttatgcataatccagaaattaaaagttataattcaaattttatatgaatttaatacaaataaggcttaacttcattttcattctaccttatgtgtgattatatctagaatgctattaaaatatattggtctgatcatctggctggaagtatgttgttgactggcaaatgggagaattttccaccagaaaaaaagtttccataagatagcactagtgttggaaaatgaaggtgaaacaaagccttcaaagaagtatagagccagctcccacagttagattctactttgtccaaatatgatttttcgtcttactgcccttagccatcaaatggtcttttgacagcccttactctgcctgctcctgtatattctagtcaagagagttgaaatgtcctctacttccaggatgatattagcctcccctggtaatggaacactctaatattttccgctaactaactaacttatcaagacaaattgaagcattcacatagcctattacaaatctatttaattgaactgtacatacttaaagtgatttgtgtttcaatgttacagaatgaatgtttgtgtccctgcaaaattcgtatgttgaaatcctaattcctaatgtgatgtttcttagaggtggagcccttcacaggtaattaggattagatgtaattctaggggtggggctcccatgattgggataatgcccttataaaaagatgaaaatatgtgagatctctttctctgcatgtacacaccaaggaaaggccatgagaaggacacggccaggaagaagaccctcaccaataacctgaccatggtggcaccctaatcttggatttccagcctccagaactatatgacatacatggctgctgttcaagcagcctccagaactatatgacatacatggctgctgttcaagccacccagtctattttatttcattatagcaaactgaattgacccatatgtacattcagtctccttattctactaccatgctacaaattcatatttgtacattccattgaccaaagcccaagacacaaatagaagtcttttagaagtggataatgaaagctgaacctaacagagaagaaatgcaccctgactgtccacctgtgcctctcgtatgatgcagactcaccttttgagcctatacttattagtcagaatctatttcctctgcttgttgttttgtttccaacggcccttgactagcctgatggccaacaggacaaaagtagcaagaaaggctcactgaatagcacagatttgctatgtatcagtgtaggaaaaagcatgttactaagtttaattgagaaactcagccagtgttcccatgtaatcatagtgagagaaacacaaatgaaagctcttctttaaaaaaaaaaatgcatgtgtactaagagctagactcccttttccaaggaaagaccagccaggttgtaatgaaaacacctttaatccttctcagcttaggctacaatcctacaaaatatacagtatatctgcttggaaaaaaataaactttttgtagccagaggcaagatctcatataagttgcaaagtgattggaaggcttttggcttggtttggatttctggtcctttacctgagttgttaattgaattagatttttggcagagaccatgagcaaagaaatgacaatcagatcccagatctcaaaacttcatgggcaaagatgaccaattattgcaaggagacaccacctcagactctaattagttatggaagtttgtgagcaaggtaaggaatagagcatttccaaagatggaatgaaggcattatcatgaacatggtcatgttcagtacatatattttaagtgtttatttctgtagaatcagcatgagaaacatattctcatggttgttttatttttcaactaacttcaaatccaaagatataagacaaattttgaagaacttgaccattaggtgaatcaagagtaaactatttgcaatccatagctttttccaagtcaatagaaattttcccatgatacttggatttatcagtgctcatagtttttggtacagcagtgtactttaagttatactcaaaggttccaatgatgatcagaattcttctcctttttatttgcctcttctcaactacataccctcttactgcctcaaatagagtaacaactgtactagggtgcttaaaatatattttatgatagtaatctttggcaatagaagtgattctctattctactgcagatataaacaccataagaaaagacatacttcaatggataagtcaaaagtctttgacttttcctgatagtgtttataagaaatacagctctaatttatcagtaatgctaaatgtgttataaagaaaagtcagagagtgaaagtttgatagtagggttagaaaaagttgtggagcaatacgtaaggttggggagaagagatgttattagagacaatacgtaaggttggggagaagagatgttattagagaaaggtcagcaagtgcaaaagtgttcttaaaatactcactataaaatatgttacaattatagaaatatgaaactgtgatttacatgtgcctactagcagcatctagctggaaaccgcctttttttttttttttttttttttttttttttttttttttttttgaggcagagtctagctctgttgcccaggctggagtgcagtggcctgatgttggctcactgcaacctccacctaccacattcaagtgattctcctgcctcagcctctcaagtagctgggcctgcaggcacccaccaccatctggctaattttttttgttgttgttgagacagtgtttcgctcttgttgcccaggctagagtgcaatggcacgatctcagctcactgcaacctccgcctccaggttcaagtaattctcctgcctcagcctcccaagtagctgggattataggtgtgcgcaaccacgcccagctaatttttttttttttttttggatttttagtagagatagggtttcaccatgttgaccacgctggtcttgaactcctgacctcaagtgatccgcccacctcaacttctcaaagtcctggaagtacaggccactgtgcatggccgaaaccccctcttaagataataggtcacatcaccatagcattaatgtccacacacaactcagtatattactccactttgcttcagtaacaatcttacatatcgatgatttataggaagcatatttgttttactcacgtttcatgttaatgcttctgagtcagcaagtgctgctctacctcctgtgtcttctcattactcctgtgtcttctccttaggcgaccttcagtggcagagagaaaagaatgacaggaggggagacatgggtgccacttagcacttctgctcaaaattagcactctgtcacttttcctcacactctactggcccacatcaacaacatggccaagccagataatggggtggaaatgtatactccaccttcaaggaggtacttgaagtcacatagctatgggcagagatgtatacttctttctaaaggaagttatccaacaattgtaaaacataatgcaatttgccaaagtgagtagttcaagtgcaggaagaataagccctagagagtttggtcttggccatagctcctcttcttttaagtggatgccatagcttaagtgtagtttgtagaaaaagatttctaagaagactgaatttgttcaaaatggatataatctcagtggctctccaacaatgctaggtctttctggtaaattctactcatagccactggcagaaataccactgtgcagaaaaagacaccagagaaataagtttctagcctgtacataaacttccagaataactaactccaaacgttttaattgtcataatagtcaaatcatacataatcctatcatagttatatagggcacagcagtgttaatttacaataattatctctgtaaatgatgttaaatatcagatatatcttaaaggaagttgtgaaaatccaacagattggtattactaattcaaaagaagacaaaaaataaatgttgaactcactaatgtcattgaaacagcctccagataatttaccatcctaatgtgacagagaagaagagtaatttagaggaatggaaataaaagaaaaaaagtttttaaaaagtacatgatgttatcagaattgcaaaaaatctgttgaataataattgtgtacagttttaaatgtaaaacatagtagagaatagaacaagttacagcaaagagaaaagtctaaatataattctattcatttgcattttaaattacaaattgatggtctgcattggatgttaagcaattagggaaggatcttcaaattttagcatgcatggaagccacttggggacctcgcttaacacacttattttccagaattccccaggctctggcccagagatgctaattcagcaaacctattggcatctagttatataggttttaatgagctcttgggagagactgataaaagtggtcaggggatcaagctttgtgaaacaatgaactataaaagcaaataagaaatcctttaaatattctttaaacacctaatgatatcctaggaagaattatttttatgtgacaatgatgaatttgttgaaaatataagactgaataatgacccaatttgtacaagtttattttattctgttgttttgaaatttctaaaaatagtctgcattataaaagttactaattatgctgtagttaaaagtgtgtaatgtactgaaaaaatataaatggagtttggtgcactattcgtacagtcccacttcttaacagtgattttatattgaatgttaaatgcatttgagttatacagaagatgtgcattaaaaaataagaaaatgctctgacataaaaaagacataggtcaaatcataagagttgcaagtaaaaattctctgtcaataatgtcaccattacatgcataacattttgccacatgaccctacttattaaaaatttaggttaatatggttatacaatccacaacactttgaattaacatgaatgaatttgaaatttcaccaaaatacttgcctcaacttgtacactgtcatggctggttggtacactaaagtgttgtttgcattatggtagaaaatatttatcatttaaatatacccatttatcatttaaatatacccactgtaaacttttatttttatttcctagttgattgttgaagagacaaacctataattacagttggagcatttaatatctctgtctcactaatcgatagaacaactagaaagaaaatcaaggttacagagaaaatatcaccatcaatcaactgtctctaatctactttataggccattccaaaacagtagaacacatattattttcaagaaccctcagaattatttcaaggagagtttaaatctttgaccataaaaaacatctcaacaaacttataattaaaatcatatggaacatgttctcaaaccacaatggcatcaaattagaaatcaatagcagaaagagtaaatggaaatctccaactcaaaaacacacttctaatgaaccatgagttaaacagcaagtttcaagagaaaaaaatagtaattacattgaacttaatgaagatacaacatatcaaaattgtgccaaactgctttagttgaaagagaaatttgtaatactaaatgctgtgttagcagagagggaaattcaaatctataagctcctaccttaaaaacctggaaaaagaagagccaaataaacccctaacaagcagaagaaaagaaaaagtataaagcagaaattaatgaaatttaaaacaaaaaataaattttaaaatagttcttgtaaagatgaaaaaaaaatgataaaccactagtgagactgacaaaaaagataaaagagacaaaaattgtcaatatcaggaatcaaatgggacattgttacagtgattctgtctagcactgtagtcatcaaaatataataaaggaatacaaggaacaattttactcccaaaaatttgacgacatagatgaaacaggcctatttctcaaaagcacaaaccattacatctaacccaaaatgataagaaaattttatataaattaaaataaatttcatttaaaaatcaacccaggatggtgacaaacttaaatgtcaaaggtaaaaccataaggacaagacagtaaaaacaaacaaacaaacaaaaaaaaaacggcaaaatcatataggaaaagccagtaaagactttggcacctacacaatgagttgttagtctttataccaaaaccacgatccataaaatgaaactgataaattgtatttcatcaaaattgaaactactctgtgaaggactctgttaagaggataaaaaggcaaactatagactggatgaaaatatttgcaaaccacatgatacagactaaattcgttgtgcctcctccagatttacatgttgaagtcctaacccagagtaccttagagtgtggctgattttttgagatagggcctttaaagaggtaattaagggaaaatgaagtcatatgaatgggcgtcaatccaatatgactggtgtccttataagaaattagtaaacacacacttacacatggaagaccatgtgaagacagacggagaagacagctgtccacaaaccagggagaaaggccctcaaaggaaaccaaccctgccaataccttgattttagatttccagcctccaaacctgtgagaattttttttaaatttactccacccaggctatgatactttgttatggctgcccaagcaaactaatacaccttacatccaatatgactggtgtccttataagaagaaattagtaaacacacacttacacacacatggaagaccatgtgaagaaaaagggagaagacagttatccacagaccaaggagtagtggactagtatcaagaatatataaagaactcgaaagaaaaatccagtgagataatgggcaaaagactgaagggacatttcactgaagaagatatatcaatggcaaacaaggacataaaaaatgttcaatctggccgggtgtggtggctcacgcttgtaatcccagcactttgggaggctgaggcgggtggatcacgaggtcaggagatcgagaccatcctggctaacacagtgaaactccggctctactaaaaaaaaaaaaaaaaaaatacaaaaaaaattagctgggtgtggtggcgggcacctgtagtcccagctactcaggaggctgaggcaggagaatggcgtgaacccaggaggcagagcttgcagtgagctgagatcgtgccaatacactccagcttggacgacagagcgagactccaatctcaaaaaaaaaaaaaaaagttcaatatttttaactcttaggaaaatccaagttaaaacaatgagatgagatgacactacatacctatcagaatgcctaaaataagaaaataagaaatgtcttatttcttattgagacctataagaaatgtattatttcttatttagacctataagaatgtctaaaacaagaaaaagtgacaacacaaaatattgacagagaaaatggatcactcatatgttgctgttgggacttacaaaatgttacacccgttctggtaaggagtgtagcagtttcctacagaaatagctgtaacagactttgttcccatagttcaccaagcaattccagaattgcaatgcatgttcttcaaaatagtgatcctctttaacaaatgacttctgtcttcccagttgtatttttcatctgcacatttcttgttggtgaactgaatttattcctgttgtttgtcacgtaatacctagaaaggtgatttaaatactactctggctctagaggggaagaaaatagcttaccagctacatttgataggatgtcatggaagtcaacaaatataggaacttcctgtgttattatgttacatatgatctttccctcccatctgctgctcaaaatttgctattcaatcacttaatgtatattcctgcattagataagaatacagattttatggcataaatcagagcagtgggaactgttgatagatcatcagaagctatttttcatgtgactatgaacaaagaattcttcccagataaccatggatctttggctaaaaagctcccacataattttggattgtttactttttcttcttttctgttttgtttcattagttgtataaagaacattgccatcaacaaccaggagaaaacaacacagaaacatagaaaatttcacaactgacaaagcttttctaccttcattatccatttcaatcgtatgccaaccatgttagatatcatcgttctctctttatagatgtaaaagaggtgagccttggagatattgtggcatatatgaaaatatttcaattgtgatagtaagaggcagttttttagagccatattcaaatgtgaacatttttttccacatcccatataacaactgttttcctaaaaagcacttggccaaacaacataataaaaagaattgcttaggccaggcacggtggctcacacctgtaatcccagtactttgggaggccgaggcaagtggatcacgagttcaggagttcaagaccagcctggccaaggtgatgaaacccagtctctattaaaaatacaaaaattagccaggcatggtggtgggtgcctggaatcccagctattcggaaggctgaagcagagaattgcttgaacctgggaggcagaagttgcagtgagccaagatcacgccactgcactccagcctggacgacagagcaagacttcctctcaaaagaaaaaaagaattggttaagcaacatagtaactttatttattccatggttgagtactcagattttgtacgtatacatgttgcaacgaaaaatataattaaacattattttcaaaacagttgaatagagtgatcagcacaggttcctgaaaaaagacttgactcgtcttttctatgagagtgtgtgcatgtttcttgttcagatgagaccctagaagtactatttatagactgtaagattgaaaaactctacattttgaacatttcttaataactaattccacaagtctatttatgaatcagaatttcctcctatttctcccttttccagcgtgagctctaaattcaagaaatagtgagctggaagaaggcttaggaagggaaataattctaaatgattaagtaaacaaaataatttgatcagtataactctagtctcctgacagcaaataaaacagagaattaacaattaacaggaacatatgatgacttcattcattatcagtaataatgctatctggacttcatgaggggctggacttggatgtttatacttactttggaattttatctcataaattttctcaactctggagaatttatttaactcttgctgtactataccaaggattaaccactgtatacagtagagaaaatacagatatcctgaaacagagaagattctagagtttacatggaagcaggaaagaaatgacaattatggaaaatttatcccacggtgatggacaagggctcatacaacaaacatgttttctgtctatgtctccagttctcacctacaatctaaacttgtgtgtgtgtgcagaatgcttagagaattaatctagtttttgaagattctgatccaacagactatatgcaaaacatggtgattttaacatgtagtttacttattatttctgaaatgcagcacatatttttgcctaagtttttctttttccttattgtcaatgatgaagaaatatccatgatataagactcaggattggagactttgtctctcaccactgagatcagtgaacgtggcaagagtcaatcattccatctctattataaaaccccaaatataagattttattcttcatacaatctggtgctaataataacagtaacaaaaatcatgaatattctttcatgtttataagaagatccctccattttctgctacttcctgcttcttcatttatatgccagcaacacagagttacccatatttctctgaatacctctcatgcttacaattgatttcttaattttgctgtctgaatatccttcctctgcttgtttgccttgctactttcctctcatctttcaagattcagctccaggttgaccacatctagaaagtcttcccaccgaggctcctcagatactgtttttatcccctctcttcatctctttttcatccttcattgtaatggccatttgtttttctgtctccctattagactgccagctccctgggtaaggaattcagatctcagcatagctctatcctggtgctttatagtatctggcacaatgtatgtctacaaaacattttttataaattaatgtatggctaatattttattttaaaaggtagagcttataaagtaggagcatgatattttatcaatctttcaggacaatctttagaagtggaaagagtagcaaaaaaatactccaagatgaacgtctcagactagtttgtgttggaacctggacttgaaacaaattctatgctgaaacaaacaacagcaaccaataagctttctttagtaccactgaatatatagggaatgtggacatgaaattaaaatatactattttatttattcctcatgacagccctacagagggcagcatagataacattatccctattttccaagtgaggatactgaagtttggagagtttatgtgactttcccgaagtggcaggcacaataaacagagaggctaagagtcaagccctgttcgaattcactccaaatctgtgctgtgaagggcaagaccgtaaaacttctcaaaccgtattcttctcggtgtgggtaggattacttttccaaaatattattacattcattgtttctattgttcaaactctgcaaatacacatttggtaacatagcagtgcacattcaaagagatggtatcaatgtgttatcttccattgacaagaatccaggcctccagcaagagggaaaaaggagatcctggttatgtgaattgccagctacagcccttgcctcagagttaggttctagcaagtctacacctctgccgccagacatataccatgaatataatatttactttaactttttggggtgttatattttctaaactcaatttgacatttaattatattcagatatttaaagaaacaattttattctgagtttatcaaaaacaaactctcagatccagaattaatttggggagttttcactctggagagaagctgttgttacatttgaatcctctacactttctccttcttctcctaccacacatcaaatgtgtattttcttcagaagtcatcagcttcattaaacataatgtaatttggctgtttgaaattcacaatgtattaaaaagtcaagagcaaaacctttgagaaataatttaatgctgaaaattatctttttctctttttccttcaattcatacaaacattaaaggtttgttacaggtaatttggagacatcatagtgaatgtgatttcatttattgaaataatgttgtcttccaacacacagaatgggaaaaaatatttgccaactatccatctgacaaacgcttaataagcagaaaatataaggaactcaactcaataggaaaaaatctaataatctgattaaaaatgggcaaaaggtctaagaaagacataccaatggcagagaaatgcaaattaaaactacaatgagatatcatctcaccccagttaaaatggcttttattgaaagggcaaacaataaaaaatgctgataaggatgtggagaaaagggaacgcttgtacattgctagtgggaatgtaaattagcacagctactatggaaaacagtatggaagtttctcataaaactaaaaatagaactatcatatgatccagcaatcccactgctaggtatatacccaaaagaaaggaaatcagcatatcaaatgtagatctgtactaccatgtttagtgcagcactattcacaatagccatgatttggaagcaacagaagtgttcatcggcaaactaatggataaagaaaatgcggtacacaatgaagtataataccattcagccacaaaaagaatgagatcctgtcatttgaaacattatggatggaactggaggatattatgtgaagtgaaataggccaggcatagaaaaacaaacttcacgttttcacccatttgtgagagcaaaaaaattaaacaatcgaactcatggagatagggaatagaatgatggttatcaggggctgggaagggtagtggggcaaaggggtggagtcaggattatgaataggtacaaaaatatagctagaatgaataaaatctcctatttgctatcacaacaacagggtgactacagtcaacggggttaaagaccagcctggccaacatggtgaaaccccatctctactaaaatacaaaacttagccgggcatgattgcaggtgcctgtaatcccagatactccggaggctgaggtgggagaattgcttgagccttgagcaattgcctctgccttgaggcagaggttgcagtgaacccagattgcaccactgcactccagcttgggcaacagagtgagactccgtccccccacaaaaaaaaaaaaaaaaattgttaaaaaatgaaagaataagaatgtttgtaacacaaaggaaggataaatgcttgaggtgataccccccatttaacctgatgtgattattatgcattataagactatcaaaatatcacatgtaccccataaatatatgtacctactaggtactcataaaaattaaatattaaaaaagataataaaagactaataaaaaatgttgtctctaatgactataaaatgtatttgaaatacatagatgattcctatagcccccccccacataatgattttgtaccaagagggtaaagtataagcttatctgattcccaggttatttctcaatatcttacatctagcttttacaaatgacacataagaaaatgaggagttttgttctaataggaaaaaaaatactatttaaccatgtaataagacccctgacttttaagctaaaagaaatcaaaaattttttaaagtaatatttcccattatgggcgttttatatttttctcattgtgatttcatcactaggcattgaataattgcttgtaacattctattccttcagcatttatttcatcctgctgcctcacttcccattaaaggatctaaacataaattgttatacatcatagcttttcaaaactatcagaaacctattttaaacattttactgacctaaaaatagatttattttccagaggttctaacaattccaaaatcctaacaagtatatagagagtaagatattataatcccaaatttgcccaagtcactcatctttttcattgtgataaagaagcagttttggggtagcaatgaaagcccaatttgccataaatcaacgtcacatattgtcttcaagcttcagaaaaattaaagccttagtaagttacacaccttctgttcaaacacttatagtttgctatagatactagcactagtacagggatttataaataaagctatagattagtgatcaaagcagaaataatgggaaaatgaataccttccctttccctcttcttgttgttaagtttctcttcttcacagaccacaggaagacactgaaactgctgttacccataccaaagagtgcttgttattctgttcttgaagctgccccagcaaccagtgacctgtttaagaacctgtgttgacaagctccacaggtgtcctggcttaatgttgctctggagtgcttttaatagataagcatactctatctactctggcaaagaaaaatagggtgggcaatgaaacaaccatttctctaacctgagctgaatacttaacataagtcaagggtaaagaaaacattctgcttttacagtgtcctgagatgccattgaagggctgccctttagtttatatatttatgtatcatccatataggcagaaaccagttcattcaatgaaactagactgagataataaaggtttaaaaaggttttgaaaacataagcagaggcatttggaaatattataaaagtaattcaataatagttcttactttaagagttaaaccttccaaatatttgatttttcatgggcccatgtttaattattcatagatacaatttttggttaattttggttagttatactaaaataatttcataaattaaagtaatgattttataatctcgggattttgtttctgtgtaattgtcagaaataaaaatataagagtataataaggaaaaaattgatgttacataacgtacataaatgcaaatatattctgaaattaaatccactgctacttttcttataaagatttacttattcttatgacaaatgtggtcatggtcatagaaaaaaagactacatagggaaaattttgaaatgtgaaagataaacttcgctgttctacttacagaagatggcaaacttgtgcaaagggtgtgtattttcctttactaaaagttgtttttgcaataaaatcaagaatcatctacccaggggaccattcaaacttgttaattcaaaacgtaggaaaagatgtgggcctgggtttgcatacctatccacagaatgggcctgatttgtggcaatttcctttctggatatctgaagtgttttctctctctgtatatctatagcacactctatctccagagtactgtggagatggaggactctgataaaggtatagtaagaatccagcaaaggtcactggatagatatcagaacaattccatccattatacagagaactggatacacagggaactgaatgaaatgtcaaaaatccttcctggtgcacagggaagatgaccacaagctagtcttacagtatctatatgatgtcccagaaactgtacacccggcagctgctagaccacaagataagggttccaaatgctaccaataaacaagcagaatttggactccagaatataatgtaagacaatgaggaaaaaggtaatgtctatttctaggattaagggatgagcgtatcctaatgaaataggtaaaataaaacaaaattaaaaaccctccaatttctaaaaactggtatccaaaatccatttattctctaagaaaagcatgatcattattgcaggctaaatgaaacaaggaagagaactgccagtttcaaaacaccaatgccaatgacctgaaaactcaccaggatcccttgctgtcagacagtcactgttcacggcaacctttgttgaagtgctcagaaaagaagttttttgcaaaccactttgaactgctaggcttagaaaggaactaacttttgtgtaagtgatagactagagtctttaggaacaaaaggggtgtgtataatttggaattagaatcatctggggaaaatactttccagtgtgatggattaagcaaatgtcttattcacacatgccattaagtcactgtgttattgaagataacagaggggggttcataaaagtcacctcttccaggtttaatgaggcaaggaaaaaacctgtatgtcctatttaggggtcatttccattataaaactgtcattaagttccagttcaaagttaaatttgggaaatagctatttagataacacagatgggcacctagctgaatctttgattagaaacccttaaacaaactggcaccctattgtcttttcttttcattttattcatatcaagggaacttttgcctatatatctcagtataaaatagactttacctcaacctttcttccagttcaaaataacaatgcattcttccaggaaattttcaaaagtcttgttcccaataacttggggttatttcaggatgtaagctcatttcaaacaacttgtcctaaaaggaaaaacaaatatgattataaagtgcatgtagtttgtgtatggttttaaagggaaaatactttgccttcatcggataaggtgcaactagccttcatagtattttctgtcccatttacttatatagacactatcaagagaaaatcaagcttttgctaggacattaaggagtttctaacctttcttttcagtcatgagccccttggtaatccaataaaatatatggaacctattggcagaaaaagggacttagccacttaaccacagaataaagcataaatttccagagaactttatgaaatccaagggccccacttaagagttctcaaacatgagaggaagacattccatcagtctttcttctggactggaaacccttaaacagactgccacctattatcttttttaaaaattttattctttgcaagacaagttttggattttgaaagaaagggtaaaaagcttaatgggatataggcaggtccttattataacaacattattgatgtgttttgaaagaaaaaaggaatagaactccagagtgtgattgggtaattgtgcaaagaaaagtcaggttgtttaggaaagtctaaactcaagaatgtcttttgtatttttatatacaaaaaaatgataaaatcataaactaaattttagattacttgccattttgaagttgtcctttagcaaaaactgtgaaagttaccactcaatgattcatatttcaccattgtgaattttaaactttgagtttatacaaacagattaagccaaaaaattatgtacttagatgatatatgaaatactagaaatgatgtggattttgaaatagacagaaccgggtttaaatcccactcattaacatttgttaataatatagccttgaggatatctgaggcttaatttcctcttctttgaaaaatgagataatacctaccttgagagatgacaggagaattcgatatagctatatgaaacatccaatcctggtactcagaactgaaattaaattttcataattcaaaaaattatggtgagattcatattaagtgttattatttgcaggaatgaaatacacctacacttattcactggaccaaatagagatttcttaaccctccgaataacactttcttctttgtattcgttaaaaaaacccagagtcagagctggtaaggagtcgaatgcacttcattaatttttgccactgaaaatcatgatttgtacttagagttcaccattattacagccatattggtaaaatggccatgtttgactttaaccagatcaagcttgtttagctttataaattcactgaaataccactacaccccttctcatccacctcatccctccccttaataagttctatgggaaaggggctttggagaaaacttgtacttaatttcacaatatatccttatagtaaaaagtctccatatttatttttccccaacttcaactcagtcaggatgctgtgaacccagaaggtaacagataatgcacctttgcttgccttgtgaaattttcattttaggttagtttcttgaagaaactacttgaggaagttactgcctatttctaggactaaaaaatattaggtcttgaggtcagaatgctgtgtatcttctgtgaaatataattctatcatatgctgaaaatctattatagtatgatagaaaaacaatagagtactttggaaaaaatctacccctttctgttactctttaactggtaagactagcttaattgaactgttttttgcgtttcagaaatagagttggaggttaagaaaatataagtttaaaaactccaaatatgatcattttttgctcttttaatgtttatgttgtataagtttgcattttaatgtttttgttgtataagtttaaatttcatcttatggaaaaacataagttaaattatccttactgctttcatagaagttgagttaaagtctaaaattattctaggtcaaaaaataaattaaggctacttcttcagtataagatatttttctcaaaaataagttaggtttttatttttaagcaagctataagagaatttatcatttttagcaaaataaataagtaaaaaaactcttagaaaagatatcaggcacataaatgtgttaataaaaacaaacaaaacacttaccttctttatcatgttagaacattatactttccatacatgttagaatgcatatttttaatattttgagaaaccttcatactgtgttccatagcctattttacaagcctaaatgtctatcaacagataaatgaataaagaaaatgtggtatatgtagaaaatggagtattattcagccttacaaaagaaagaaattttgtcatttgcaacaacatacatgaacctagatagaggacacatggtaagtgagataagccagacacagaagaataaatactgtattattccacttacgtgaggtatctaaaattgtcaaactcatagaagcagaaaattgaacagtatttgcagggactgaggggaagggaaaatggggaattgttcaatgagcataaagtttcagatatgcaaaatgagcaagttatagagaagtgctgtacaagatggtgactataattaacaatgctctactgctcatttaaagatttcttaaaagggtagatttgttaagtgtcctacacatacacacacacacacacacacacacacacacacacacaagaaagaaaaaacaagagagtagctaagatctataagcacagggctgtgtcaccagtcagaccatgcctcaacaaatgaaatattaaaaagcttcatatgtaagactatggagtagacgttaagtcatactttggatagagtttcataaaggtcttccccttaataaatttaaccatgttatctaccgttttctcatcttcctaaatttggtatttagatactgaattttagaagatatatcttctttggctctgagtcctttttatttttcatatcccaagcatttatggcagccacattcgtgcctatttcctggaattgtgattgtctcataaatttgctactatgctgtctaatgacataaactgtctaaatatgagtaatttgtttaagagtaccctccgttatatatctgttctcctaatccttttctacatttaaatgataggcggctgagaaacacacaattcactttcagaattgagtgggctaaacaacatttatgacttgaaaaaaacactttcttctttaaaacaaagaaggcatattagtttggcaattgcaactctagaatcagtttatgagtatgtaaggaactactctaagaattgactagaatatacctagccaaactttatctttagaaattatccctcagtgaaattggaactatttttaacatttttttaactgttaataatccaaaatgcaactatataaacaatgaaaatacaaaaaaatgaaaataaaaatcacacgttcaaattctcatgttaaatcttaacaaaaaattgggcattactttgaactagttgggaatgatcaaaatagagctcttcactggagttattaaacatagaatttgagaaaaatttagatctaaattggatgaaattgttattgacctttaatcacttactcctaatataacctgaaagtagaacatgacttgctattgaatttctttttcaaatactggtatattaatgatgccctctgacttttagcgtagcacattgcatgctaggtcacaagtgtttcctgaaatgactgaactgtatcaggcttcatcttccagcactgatgcaccatcctgaatattgctctaggtgaggtcttttattctctgccaaaagtcacattatttttgacacaagcttcagctgcttcaccaaagagctaaagagtagagtcagagctccagaaaagagatgatttgtaaggtcctggaaaaggtgatgcttttaactgaattctctctcccacttcaggcttggtatcccacatgtttagtttaggcactcttcccatcatgatctcctgaaactattaactcaaaacacccttgatctacataattagatcttgtttaccatacctggaatcaacatattgaaaaataatgtttatatttgctcttaaatctagttgtttcttttagaaccaagaattctgtactatttttttgtgtttgtttattgtttgtttgtttgtcttgagacaggatctaactctatcacccaggctagagtgcaatggtgaaaacatagttcattgaaaccttgaaatcctgagttaagtgattctgccacctcagcttcccaagtagctgagactacaggcccatgccaccatacccagcctgaactatttcttaataaaggaataaaactttttttccaaaatttaactgtttattccacttaaatgcactcactttcttgataggtgatcacatcttgttcctgatcatatgttacttgcctttgatccctggttaaagtcaggtgtttcaatgataagagcaaaagttggattctgaaacaaagttaagctataaactacatataagtggtccataatatttatgaaacccagtcaatatggccaaggaaaattgaggttacttctgtgaagataataagtactcgttctgaatgtactaacaaatcaaagctccaaatatttttgtttatggagaaaagagggataaaagaaaacttattgtgagagctataattccaaaaaataaaggtgtcacctgaaatgctattgatagtaggaacataaaatttaaatatacttcctaataatgttgcctcttaattttagtagaaatgcattcagactctttttatcatagcagtaaacaaaaggcatgggatatctgtgtttaaaccaccttagcttaacacaatttgtaatagccatcattaggagtttatgcagagccctgttttatgtcaaccacgctaagataatgtagctcggggtgctatatccatggtctttgaaatgtgtgcgtaaacagacactttttccatgtatctgttttgtcatttattttgctgtgtaaacactattatgaaatttagtctaatctttttgggttaattcaaacattttcactatgttcagataaatgtaaccaaagccagatgttggtttctgtactaagagggctcacttaatgtaaacatgattctacttcctccatttctttttgtcagtccagatgttgaagttgttcaaaatgcttttcctttgcctcatcacagacctcccagaaatcaagcctgctttccaactgatttctgcatgggtgtccacctttaacttcctattatgcctcacaagctcgataataatattacaagtggccccattcaatcttgacagaaactccaagaaattcatctcttcattatcagctgtcttctttatgcattctcaattcagtagacactttttcaagcttcatttgctgggcagagttgtgctccctaccctctcacttctgaaaagaaacatacccttaatggattctgctgactctccattcattttctagacttcattggagatggctttctttagactgcagcctcctttggactaccttcaccatcctttattctgtcattactcgatcatattggtctttcaatctgcatttctaccttctctaacagtcagtttactatctcctactttttgtctcagtcagtattcacacctcacataaaaatgtgtatgcttttgttcatgctttataaaaaaatctctccatgtttttgtttgtttgccgactcttgattttttaattggtgtaacttaactctttggactatggtgttttaaaaatgtagaactacaatgtttctaagaaagtaccatagaatgacaaaaaaatttcaccttttacaactacttgtctcatacatagcttgtctctcaatgcattatttgccataggcatttataaacgaactgatttctttaccattatgaagtcaaagacagtttctcttctacatgcctctaggaaagattgatgagcatatcttttttgatgaaatgtttcagccctaggatgaccttaatgtgcttatatcttgctttgttgctaatctcttttatatttctatagttttcttattagttaagcagtcttgaatgtatagggatagacaaagaaattgaatgttaatttttttgtggattccccatgattcagccaatacattatttccaagtttagttcagaagaatagatttaagcaaaacatagagaaatttagtgaacttaaaatttcagaacgcatccaacatgaaaaacagagaaagcctcaacatttcttgtattaaaatactttccacttctaggaaaacgggggtaggaatttaaatgttgacacataaaatacagcactgattgttattatttaaaaatgcagtcactatcttaatgttttcctggaacagacttaaataactgggtaacataattgtactgttctatttttgaatgccaactttgacatttctgtatgaatctaaatttcgaaccattttaattcatacattgtaatttttgcatgttgcattaataattgggaagaaaattagagattatctagtttaattactcaattttaaagttgcagaaactaggaactggaaatagtacatttaaatgactttaatcaagctgcatatttagttaacagcagtactagggcaaagagtcgatttacttatcctctcagaaaaaaactatttctgtaatattagcccaggattcaatattcatactggtttggtgctttgcttgcttcatctccctctgcccattctgcacaatttatctgtacaagaacaatattccttgcacacattttttcccctattctcttcacttggactgcccttctccccaaagcatccttacaggctactcatcctttgttatctaccatgtctctaatcaaatgtgatctagataaactttctctgaattccctaagatgatgtaagggcatgttcaaccattttgtatttccatcacacaaattatcatctttcctttcatatcaacccctagatccacgctattcaatgtggtagccactaactacatatgtctattgagcatttgtaatgtaattagtagaaattgggatgtgctgtgagtataaaacacacaatgtatttcaaaatcttagaataaaaaggaacctataacattgtgtgaaatgatatttgaatatatcaagttaaatgaaacatattaagatcaattttacctttttctttttcatcttttaaaaatatggctactagaaaatataaaattacttatatggtttatattgttttcctatacagctctgctgtagaccataaaattagcctttaaagtgaccacagtttttaatttatatactcagcacctaagctttagcaattagctaatgatcagcatgtatttgatgttgattgacatagtttcagatgttgcttgaattgcttaagtcacaaagtaagacaggaaagataggattgaaatccagagtctgatttatcctgcaatttttttttaccacaaatcaatttattccagtgtgtggcaccttgttttctaagctatatatgacttcaaattgaattattgtttctgttaaaatggttggtcacctcaaaaaaaaccagtcttgcaactcaaaataattcccattttatgtacagcttagctaggatctacattgttaagtatgctagagggatttgatacttaatgtgtctaaggacaaggaaatagaaatataaacgaattatagccactttagtgttctttctgactcatagtataaagataatgaggctatattatctgatttcttggtacttctggagtcctacattatatgctgaaagaaaggacacactacttggaatattttcctaaatggacatcatacttattacacttgtattttttaatagacttcatttttagcagttttaagtttagagagaaaaataagtgaaaagtacagaatgtttctttatccaaagtttacccccatcaccattcccccagtttcccttattaacatattataagccacaagaactgtaataaatttctgttctgtacaaattactcagtgtaagatattactatgataccaccttataatgttttcctttcatatactgtgcctttggtcctttggtattgtatttgcaatgacatcaccaaactcaggctcatctagatttttttcctgttgtcttccaggagttttataattttgcattttaaatttaggtctgtgatccattttgaattaatcttcgtgaaaaatgtaagatctgtgtccagacttgcttttttctttttatttctttttttttgcaagcggatgtccaattgttccagtatcatttattgaaaaacaatcttttctccatttacttgccttactgtttctctggagagagaaggtgaaggtccaagggccatgtagagcagagaaaagactgcagatttaaagacttcttgaggctgcaaaactggcaaatgcaagtaggttatctcaagatatggaatagaactgaaacgttcaacttgagttcttgcactggaatcccaaatgggcaagtaccagtagtctgaatgggtcttagcgggtggtgaaaattattaccaattcatattatatagtgactacttctccctcatttgtacttgcatggagatgagattagggaggactccttcagatgactccagagatgagtctttgattgcttatgtattctacatatgcccactgaaacaaaggccagcatatagtcttcagctttctagtgatgatcaacaaggaagctggtaatccactcccaccactagtccaaggaaaagagagggatagagaaagaactcaataggttgagaaaaagaggaaaaacaaaataattagagcaggttgcttatattaagtaaaaacagatggaatgtaagaagaagaaaacattaaaaatcatggaaaaatacttcaatgtgatgtaattagagctcaaaataaactttctgaaactaaatgtcaggatttctaaaatagagttatttaataaaacaaaaatacagtggtgactgtggaaagttaattatgaaacaaaaagtatataaacgtgaaataatgagagaaaactgggggaaatatattcatgaacatataagtaataagcaaatactttgcaaattatagttaaagaaaaaaggaaataaacagatgggggagaattaagaatcggtgaagtaatagaagtaagcattccttgagggcttgagtgttcaaattcaagatatcatgaagctcctagagagattaatggaaaaagaaaatcactttgatatagcataggaaaaattacttaaattgagagtaaatcttacaagctttcaaacaaacaaattacttctaaaggaaagagaatagactctatttaagaaaaatccaaagaggaatattttaacctcacagaaattagaaataatagatctcatctcaagctaggtaaagaaaaagagttgtaaaataatattagacaacagattattaatataaatgggtgttgagtgacagttggaatcatagcattcatatcaagcaagtttctttgaatttggagagctatactgtaatgaacaacctggaaattatcagatgaaagaggtgcggggtgattccatgggattgtgtgaggggagtagagatggtgtaaaagtaccataagaatctgttctttatgtctgtgcaaggagaaacctatgaactcttggtgagagtgctttaatttttttttaaatagaagcatatgcaactggctatgacaactacagattagaagaaaaatactagtgactttttacttagaaaaagaacaggtattcctctcttaccactttcaaaacagtatatgctctttggttacaactaaagctgtaaattaagttttcaaaaattagaaactttacaacctagattcatatgccataacatagtgaatccaaaaaagttactatatatccattataaaatccctcagaggctcaaacttgttattgtcttgagcttctcacttatatttttcctcctttgaacaccaaatattttaatgttatttacaacatttggatactttttattactactgtgcttcatgttttaaaattagggttagccactaaattgtatccaatatgtttaattgtatgcattgatttgatttgattatttcttctttgatttagtgattttcttcttagttccgtttatcctttttgtaaatttggaagttctgttttacatgtccatttataactcaaagttagcaaatgaaagaaaacaaacaagaagattgtgtaattttgagatataaagtaatgtcagatccagacaattccttgaagataattcacatcttaaggaatgaaagaagttaatcagttcctagtatcttcttaccaagcctgctgcacaatctactaaagaatgatttgattttcccacctgaaccgcttcgatgtctctactgttttggtcttttcataactcactggcttgctcctttgaagctgtctgcctcacttaaataattcctgatgtgatcatttcattcctggttctttcccatcctgagattttattcttcccactccaattttgctcccaggtttttgtcacttgccccaaggtccgggaactgattttacttaaccttcctgtggttctctggcattcaatttctttctgctgtttcttgaacaaaatgttcttaccaatacgggacaacaattgaaggattctttatttgataatcttgctctcactaatgacagatatcatcatgcaatttatggtttgaagaagatagaattagttgaaaaactgcagcagatgttatttataacattaagaataaaatacaatatattatttttgagccgataaatctcacaatgaagatgtagaggagcaattgaaactcaatgttgtgcttgtctttagaacctgaatatgcaaagcacatgccttattagattagattttgatctttttttcctacttgtatttaaggagattgagtttttctgtgttaagtgcatcatctttgttttcaaatagtttgtctttcattcactggtaccaataggcaggaagttgaagttactatcattactcaaaatccacgacttggcaaatgttgtctttgttaaattgcgtgggttagacgttttctgagctgtaaccttcatcctgttcaactgagttgattaaaacaagttgtgtgaaaattaaatgcaagaaatatttaataatgaaaagacaatgatagaaaatggacaacctttagaattttaaatgtaaggattgtttaaacagtacatagttcatatttctctaagggttgaattttttcagcacaataggcacatgtttccaaagaagatgattacatctcatattatctttaaacagaaaaacatgtttcttttccttatctctttttatatcattgtggatatttgtattagtaattaaataaaatcatatgacattcagttaagctatgacaggccatcagttcttttaaaatatgtctctatgcatttttttaactttgctatgagaattgaaaaaattatttaatacattggaaaattgcttcactaaatgttagttactaaaatctagaagtgttaaatgtctgagatgctctttaagttttagatagtggctgaggcagcaggggaaatctgctgaactaattgcttttctctctttatatctctaactaaatctctactcagatttttctttgtgatattggcctgtggtcagcatataccacttggccaaaaacacattgtggcttaggcaattgcttatcttctctgattctcagtttcttcttatagaaaggatggatttgggtaagatctccagggtaccttctgactcttaacattttcagactcttagactcattgactctcatctcattcctgcgttagccctggggatatcctctggtgcatgtttgcacttcctcttcctgtcatctcttggtgaattctcagataatacagatattgttagtgtcagcctggctatgatacaaaaagcacaaggacataatcactaggagaaattttgtgtaataacactaagctttgtatagctcatacactgtatactcagtttaaaatgttaatttattgaaagaaaatgaagatgtgtgtaatgaaaaataacaattatgaattaaacaagataaagaagcacccttgttttatttgcagaagtatatttcaaagaaatctgtatcacttcagttatatgcaatgaagttattccccattctcactcttagtccatataaacactattgtgatgtttattaaatatggcattattttcaaattagaaaatgtagtgtacttaatgttttctttgttgcttttcagtggaaaacaaattgctgaagcagcagatttagtttaggtgcctttcttcctaaaatcttccacagaaaaagatccacaacacttcgattccaacacaaatactttgcagtcttcctaaaagcattcactttgttattcttctctatttttcataaaattattaagccattcaaacattcagagtccaatgactatggtaatgatttaaaaagataggttattttattatcaataacataacatatttgaatatacaaagggcacgtaaaacatagcagaattttatctaagtttctgtgctttggaataaaaaaacagctttttaatcaaattctctcttaactacatattgccaacaaatagaaaaatatttgcttaaaaagcagacaaaatacaaacatacggcatttgtattctttaaaagtctcaaggagctttgatttttctcattgggtaaatagtacaaaaatattttaaaatatagtcagtttgctaaaataaaattatgttagttaataagttcctttgctttcatcacaacatcatctccatttccttcaccaaataatgcataactgactatattttcttccaggatggcacttttttattgaagtcatgcattggccagcattttaacccaataacctaagctgagaacagagcatggcctatagcattaagtgaactttatttaaatactgattcttcttctcgatagtgtgaccttggtaaattacattaaattctatggattccatttcctcctctttaaaattgaagatctacttgagagttgatgagaactgcatattctgaaatgcttttaaactacaaagagctatgcaaagggtaggattcttcagtgagaaaatggaaaatgaaatgttatccacatcatattttcctaaataaactcaagcccatgtctggaactagatccaggtctgggttaaaatccaatttctgacattcattccttaagtcaacacaagcaaattacagtatcagctttcgcagctatctaatggggattaaaacaatgccatcatcatggacttataaagattaaatgagaaagtgtaagttaagcatctgtcttagtgcttggcattagtatgtgtcctatcagcctcattaactaggatgtaaagaggaatattgtgtgtatgaggcctcttctgtatacagcaatgttgtaaattgataatagatatacatgctgtaacactggagagtgcaatactcaatcttccccaccacagggaattacataacattatacccagttgtttagataaactaacaagcaaaaatataagcacattatttgatttttctctttactctccaccgtcatcccccatctcatctatccagacattctttctgatttatgaacaaattgtattttcagttgttatgtctttgtttacttctatgctaccactctaaagaagccaccatcaatgtttttaataagctaatagtctccaaagtaaatgtattaatcatctttgtttttcacccaaatatattctgctttgagtagccacagttacctttgtcaggaagttattgcctaaatgtagaatgaaacaaaaactctttgctgtgttctagagttctcttttattgtagctcctgtctatatctctaaggtcaatttaaccccccacccaccttcttcattaagtccttgcaataatagtgcacttgagggctgttgcacttgatagcctccttgttcgaatcattttcccataatctcatgcctcctcctgcctgactggctccttctcatattttgtatgtccacaccagtgtgactttctcaaacaagctgtccctgagcactcccataaaagcagcttttgatgtgctgcttttatgggagagctccctcatgttatcctgcttaaatcctccactgaatttatctgtttaccacaatctttttatttatctctatgaatgtttctgatctgttcttgcttgtctccctaactcccagaatttcatttaaatgagaacagggtgtttactctatgttcagaactatagctgtagcctattttttttttaaaggagcttattattaatatatgctcattaaatacatgtttaatgattaatgaattgaattaatgcattaattcaataataaaattcacaaaatgcagtctatgtttttctctaaatagtcagttgtctcttgttaagctactggatttgagctgggcctaaggttttaaatacctaatacagatgccacttctgtaaggttctaattaattggagatgaaatcagttactttctcctctacttccaaagcaatagtatgtctttcctcatgttatataacagttcatcattgcatagctactttgcagagtatctttctccaactagattactgacaatgtacagacagcgagtatatattttcatctctttatgtctatcacctgggcctagtgaatgcttaataaatgtatgctgaattaaattgaattattgccatgattcatgtgaactgcagtcaaaatagttcagaaaaaatgcagagggaaaactggccacttaagtagctcatgtctccatggagtgttccaatcagctccagcttcaggcccgtcaggaattgcacactaattctagccaaagaaaaaaatctggaccagaagatgcccggaaattcatttgatcccttcatgtaaattgtgccttaaatagaatatcagattcactatgaaatcaagaaaactggaaatttagcaaagttgaatgaaagttttaggttttattcagaagtgtgatgtcaaatggatataacttacaaagtgtttttcttcatttttttccctttataagtggcacagaaaatttgtttttacttatgtttttgcatccagagtatcagtaatactcaagaataaatacagtcttttgaagtgtgtggcaaatctgagtctagaattagatttgaaatggaaaatgacatattttctttctttttttttttctttttctttttttttttttttttgagagggagtttcactcttgttgcccaggctggagtacaatggcgtgatcttggctcaccacaacctctacctcctgggttcaagcaattctcctgcctcagcctgctgtgtagctggcattacaggcatgtgtcaccatgcctgcctaattttgtatttttaatagagacagggtctccattttggtcaggctggtctcaaactcctgacctcaggtgatccacccacttcagcctcccaaagtgctgggattacaggcatgagccactgtgcctagccaacatattgtcttaaaagtagtctcttccactattttggaaatctaagtgtcacctctaaaatgtattggttcgaggaataagattcactacaaccatactgagatatgtttttaccatatatatctatgtcatctctttgacagtttttaccatttccaggagataaaactcctacacatatattattagaaattataaaaagtaattgtagcatccttaataggtacaattctaattattttcttttttatgcaatggtaaagactacttaaaataaattttttgaatgacagattatttgccccttcctgtagctatttcagataatgagattattaagtagttttttgaatgtttttaaaatgtaatattttctttgacttcagacactatttcaaaaatcaaaaatttgagaaaatacacatatgctgggatggttcttttaggaaatgataatgttatagttaatgttgaaaaatatgctgtctgagtgtgaaggaataataatgtttaacgtaaagccaactattcaaaataacaacttaaaggtgaaagctttttgttgataagaccaactcttgatatagccgtaacttaagacagttctttcttttaaattttcctcaggttattctgtctctcagaccaagcatcactttattcaacatttttctaagtatgttctgtagaccaaaaattctgtaggattttccgtgaaaaaggtttacatggttcagtagatttgggaagccatacgttgcatatcacccccttgagaatttacatgcacaaggtaatctaaagcctctccagcatccaaaagtaatgtttagcatagaatttttaaaactcatttgaccacagtactatcttattgtgacatctgttaaaagtcatagaaacagtcttcttcggtccttgccttgtcataatagctatgaatattatatgaattaagatttttgctggctataatcaattttcgtggcacttgttcttaataaatcggattcactgccgcctcataaaatgggaattggcagttcttgtagacttctaagtacacatacaatgtctttcttatttatatataaacatatgtctctatatgtttttagcaaggtgatacacataaaataaattcaagatatttcagagtattcattgtccattttaaatttgtatttgacaaattggtgtgcctgaacagagctagaaatttaaagtgaaaattagaaataaattcaattcgataaggataaacaaacattgacctaaagccatgaagagcatgaggaacaatgtaaaggtagaggctgcccatgatagttgctgataagttctgtttttcattaatgtaaagaaaggcacagaattgtaaacatgctctcagatcattcaacaaagatgagcaattgaacaagcctttctgcaagcttgcatcacatctgcccatctggtcccacaagctctggtttctgtgtttctttgaataaactgaacacaatcttatcaaaattgtgatctaaagcccattttctctcaccttttcaaactatcattacgtcatctctcttcagcaacatcaatttttctttctcttctgcaacatccctaggattgctgttattactcccatcttaaaaaaaaaaagaaaaaaaaagagagagagagagagacaatgagagagaaaaacaaccaaattgaaaaaagaatagtcccttgatccaacattcctctttagtttctggtctacttttctgcttccctcagacaaagaacaaaaacaaaacaaacaaaaaaacactagaaagagctatttgtaggagttgttgttcttttcatttttccttccctaattcattttcagaacccacaaaatttaagcttcctcctcactatcatcaaagtcaccagtgacttccatattatttacctcagtacagcccattggcccctctggaagccctcagcacttgtttcctataaccttccttccctatcctcttctcctccagttgtattggtcctttgctggtcctcaaacatgccaagcctcctcccttctcggggcatttgcagttggtgtaccctctgcctcacactctcttcttcaggtattctgagcccaccctcccactttctttaggtttctggatcaaatatcaccttattagtaagactcccctttaccacttacataaatgaagcaccatgcactttggcacttcctattattctgtcctctgatttttctcagcaacatttatcaattgaataaataaatattaaatagctgttcatttgcttttgtctctctcatgcactttacatctataaggtgagttgggcttggcagatattttgttaccgtgttcttagctactgtccaattgtgaaatagagcctaacatgcagtaggaacttattgcatgtttgctgattagatgaacatgagcagatatcaagtgcttggtatgtatagaacatgttgagcattaaataactaaattattagtaagatacaggtctactgatctttgtaatagtgctaaaatggctaaaagtaccaggaagacttcttcatggatggctttgaactacttctaaaagtttggtaggatgtctacacatggagattgtggggaatttcaagcacataataagcaaagaaccaaggtaggaaagtattgaggaaataatggctgatgtattttttctaaagcaaggggtaggatgattaggaaagaaaagaagcaggtagaatatattgggggaaaagtagcccaaataacaaattatatttatgtatgtatgtatatttatttatttatatatatatatatatatatatgtgcatatgtatgcatgtatgtgtgtatatatatgtatgtgtatatatatatcctgctgtagcatatgatcttcaaagataaaggtctctacttatttacatttctacttaagattattccttctacctggtaggcattcagtaaaatgttggtgcatgctatggtttgaatgtgccccccaaatttcaaatgtatgttggaaatgtaatccccagtgtgtcagtattgaaaggcctttaaggggtgattgtatcatgaggactttgccaagcatgtagaatagcaagcagaacgggcattcatgaggtgatgtttagaaaaccaaaatgtaattgattaatagattaatggattatcatgggagcggaactggttgctttataagtcaaggaagagagaattgagcaatcacattaatgtattcaggcagaccctttgccgtgggaggctctgagctttcctgggactctgcagagagtccccatgaacaaggaggctttcataagatgtgcctcctcaaacttggccttctcagccttcataactataagaaatccattctttttctttagaaattatccagtttataattatccagaaaacaggttgaaacagtgcattaataatggaaggcaactttaggagtaaacataccaagctaaaatattttttgttttttattatactttaagttttagggtacatgtgcacaatatgcaggtttgttacatatgtatacatgtgccatgttgctgtgctgcacccattaactcgtcatttacattaggtatatctcctaatgctatccctcccctctccccctacaccacagcaggccccggtgtgtgatgttccccttcctgtgtccaagtgttctcattgttcaattcccgcctatgagtaagaacacgcggtgtttggtttttttccttgagatagtttgctgagaatgatggtttccagcttcatccacgtccctacaaaggacatgaacccatcctttttatggctgcatagtattccatggtgtatatgtgccacattttcttaatccagtctatcattgttggacatttgggttggttccaagtctttgctattgtgaatactgccacaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgtgtttctctgatggccagtgatggtgagcattttttcatgtgtcttttggctgcataaatgtcttcttttgagaagtgtctattcatatcctttgcccactttttcatggggttgtttgtttttttcttgtaaatttgagttctttgtagattctggatattagccctttgtcagatgagtagattgcaaaaattttctcccatgttgtaggttgcctgttcactctgacggtagtttcttttgctgtgcagaagctctttagtttaattagatcccatttgtcaattttggcctttgttgccattgcttttggtgttttagacacgaagtccttgcccatgcctatgtcctgaatggtattacctaggttttcttccagggtttttatgggtttaggtctgacatttaagtctttaatccatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatagttgtagatgtatggcattatttctgagggctctgttctgttccattgatctatatctctgttttggtaccagtaccatgctgttttcattactgtagccttgtagcatagtttgaagtcaggtagggtgatgcctccagctttgttcttttggcttaggattgacttggcgatgcaggctcttttttggttccacatgaactttaaagtagttttttttttcaattctgtgaagaaagtcattgctagcttgatagggatggcattgaatctctaaattacctagggcagtatggccattttcacgatattgattcttcctatccatgagcatgaaatgttcttccatttacttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtattagaatgcttgtgatttttgcacattgattttgtatcctgagactttgctgaagttgcctagcagcttaaggagattttgggctgagacgatggggttttctagatatacaatcatgtcatctgcaaatggggacaatttgacttcctcttttcctaattgaataccctttatttctttctcctgcctgattgccctggccagaacttccaacactatgttgaataggagtggtgagagacggcatctctgtcttgtgccagttttcaaagagaatgcttccagtttttgtccattcagtatgatattggctgtgggtttctcataaatagctcttattattttgatattcgtcccatcaatacctaatttattgagagtttttaacatgaaggctgttgaattttgtcaaaggccttttctgcatctatcgagataatcatgtggtttttgtctttggttctgtttatatgctggattacgtttattgatttgcatatgttgaaccagccttgcactgtcctttaaggagagagctttaaacagaggagaaacatgatctaatttgcagttgataaatatccctggcctcagtgcagtgagtaaaatggtggcagcggtggagtggcagggaggatccaaagaattgggaagggaattgcaacaaaccaaaaacccaggaaagagattagggtcatctcctctagattactggcagtgagatagaaagtagacagagaggtttcaaaagtaagttcactggatttggtaattgcttagatgtgagaatggagaagaatgatgcaatagcatttagccttctggtttggaaaaaaaaaatatgtacatagagctgaaatctacaagatagggaaagtgagagcaggagtatatctgagagaaaaagtaatgagattcctttggatatgtggcatgaaggatgtttataaccattcaatagaaggtaatcactggactggtataagagcgatttggaactgaggaaagagatcaaggctgaagattatggaattgatataatttaaatagttatgtaggtcttagcaggagatgagactgactttaggaagactatacaggaaaaaaaaaaaaaccagaacatgagatagaaccctaagaatacaaaggtatcaggagcacacagaggtatctaaaaagaaactgccaaggagataggataatgagcaaaactgggatccataaggtgatgtttagaaactgaaagtaataaagatattgaaggaatcaattaaagtgatgaaataacgctaattgaaaatttatggcagcataattatagcagtgggtgatgggagtgaggaattatctagggaagagaataagcctaattctgactatagcaaacctttgagttagatgaaaatatagtgtaagtttatatagatatatagctatactaaaagatggccagatggatagataggtagacagagatacccattccactgtatgtcctcatacatgttgatgactttataactgtgtttaccactgcctcattttgtactgcaagttacctgagacttgccttctctagtccttattgtgtcctctgatgtgtaataataattcatatcaataactgtaaaattataaaaaattttgagtgataatatattgaaatatttagaatgctttatttgtttaaaacattttgacatttgggattcattttcaaattttagcccaaaatttcatattttggttatatacatgggaaaatttgtataaagcaattcagaactttgttagttcaatataaacacaatttgggtctttttactttttggaaattttctaaatgatgattcatgctttgagatgctcatagcaaaaaaacacaaattctttgtattttagcatcactgatacttccaacacactgggtgcatttctacagcacacctggcacttttgaaaatgttacatcacatctaaacaatttttttgaattccattcctatggaatcactggtacagaaggtcccttggtaaagcttagttctgaaataattgcatgtttcttttcctcataatttggactcccatgttttatagatacttggcattgttctgaaaccttccctccagccagcttgctactccagatggcattgcctttctgaacaagctgagtcctctggtcattagggtaaaatagcatttacttataagtccttgtctagtcttgcttaccactattattcacttcattgatcatgaatataaggttcttagctcttggtattccagaatagtaataggcaattctaaaattctccaggctaattatttaacaagtaaaatactaatcatttttttcaaaatttcgaaactaataaattttcaaaatcacattagtttcatctctacatggattctgtaaatgtcaagttaaacataaaattcactttctatgtagctttcactaagtcatttcttatattattggataacatgatttattctttttcctttttatggaattgtattatcgataaatttgagctcaagcattaaaggtttctaaaggaaaatttactcatgaacacaagccttcagaaaacacatttaatcaattagctatatctaatcagttgtttttgtgaatcccacattcttgaatattcattttaaccagtccaacaaaacctgtaagattgggccccatcctgtcgtctagtcattccctcaaaatggagtattcagctgtacatctaacttggtaagagcaaaagaatgaatccaagccagtaaagtagctttataaaaggtgcttcaaagggatacctcaattttcattaaaaattttaattattaaatcatttctggcttcagtctttctgcaaagccaaccaacttcaaaatatatcttgttcactacaatttcaagtgagacttttcaagtaataaggaaaggtttttggaaatttagagaattaacaatattttctttagaaccacctacatctgtttcatttttagttgcattttattctaagtgattcctgcagtaaataatcatgagcatgatgcatcttctcagtagtccctctgtaggtgcctctcaatgcaaaggaattaatacaggtttctctgtctgccttctgtttgcataagataacactaatacccaatgtgtctatcaaaaaccacaagatacattttgaacttcatcagagtttacaatattgtttaatgacactttatgaagtggccttaacttcatagatttcgtagatttttaaggacaacacaatatcctgatgtgggtaacattcatgtaaacaaaggtatttatctcttaactttattgatatctcaaactctcacaaatagaaggatttggctccttgattcattaacatatacagtcatgctttgctaggtaacagggatactttctgacaaatgcatcattaggcaattttgtcatgtgtgagcattatagagtgtacttacacaaacctaggtgatgtaacctattgcacacttaagtatatggtatagcttattcctcctaggatgcatacctatacagcaagttactacattacatagcgcaggcaattgtaacacaatggtatttgtgtatctaaacatggaaaaggtacagtaaaggtacagttatacaatcttatgggaccactatcatatatgtggcccattgttagccaaagcgtcattatgtggtgcatgaccatacatgaattgaatattccccactgacatatccatttttagtatttttgtaaattggcctaacggttatttgtgctctatatgcacaaggtaagttattttatccccattttacagatgaggaaatcgttttaaaggacttaaagcattgtcattgcttaagaccagtggtattctcttgcattattcctttaagccagagataaaagaaattaataagaaaaaaaatcagagaacaaatccataacagtttacttcagccaatgagtggttatatttagttttatcttgtagaaagagaagtcattttatgttttaaggagagagcatgagtgaaaactgtggaaaataataagcaagtcactgggggtatgcattgacctcctcctctctcctttagtaaatgagtctgaatactggttatggattgtattgatcatatattaaaatgacaaattgcctccacattagcttgcacacaagtctcttaacgaaacccattgtaacttgtcagatgcaacctaagaattgaactagacattgatggacaagaccttccactgaccattgaaaacatgtagattctccctgattaaattgatgcttctgactttaatgagctgctattgattgggcatttactgctacaatatattatcatattgctgttcccagtgccatacttaagaggttataagcatttctgctataaatcctttttagaagcttgtagctcaaccaaaatatatgccagtgatatcatacataagatgtaaagccactttgactgcagattattttccacagttaaaaattatacatatatatgtacatttaataacgtcagttttctttgaataacccaaacgatgatggcctgaggtagtctgtgaattatatgaatatgcaaaaaagggttcttgttgaaaataagttttaatatgatatgctttactgatctaccttataagactacaagaaacaggtctaaaaatggtgaatgaaaaatagtatgttgccagtttgtccctgagtttaaatcatggagtatgaactcagtacttacggtagtttgatatacatcataataattaaagtagtaataatgtaagacaaagattattttggactaaaaacatggagaaactgacatctgcattttattttattattattattattattattattattattattattttgagatggagtctcgctctgtcacccaggctggagtgcagtggcatgatctcggctcactgcaacctctgcctcccaggttaagcaattctctgcctcagcctcctgagtagctggtattacaggcgccctgctaattgtttgtaatttttttgtagagacggggtttcaccatcttggccaggctggtcttgaactcctgaccttgtgatccacctgcctcggcctcccaaagtgctgggattacaggtgtgagccacggcacctggcctgtcattttattctaaataatttttctgaagcctgagaacacttaaacatatacaaatagttgttttttgtttaaaatataaagagcttactttgaagtacatttttatttaaaatgaatactcctttttttaattgttaatagaaatatcctttttctgcattacatttataaatatgatacaattttaagcacctcatacattatttctctggagtagacatttaattatttgctgaatgctttagtgtatggatgaaaagggatgaatgaatacaagttatgagaatcttgattttatcttttctaatgaaattgtgaataccactttaatcaaaagaatatcagtttctgtgtttaacacttcagttctgtatctacttttcagaaacagttttagagcacttgaatcattgtttgtaggtaccattcaagatatattttggagttcttggccagacaagaatacactgatctactctgggactactcttacattctcagatattttaatgtacttagtggatttttaagtgtcaccaggaaaccaaaattaataacatagcttatttagacgaaataggtaaaatccaaacaaatttggcagagtttgcttattgcttaaaaagcatattttagcaattaattgagccattttttcaatatattatgtataatataatgttttacatcattgctaggtatttttaatataggttgaagtttggtaaatcatgttgtattaatgactacataaaagtcactatatacaataaactttcattgtttgtgattatgagaaaatagttcatccggaaaaaaaagtatgctattttatgtttcacaataactgtaaaatggctagttatattgatagtattctgtttgattttttgatggaattaaatgaatatatcatttaaatgtgattattaagacgatggaggtgattgattctgacaaacctttttaatgtttttaaagtatatatgagtacacatcaataataatatgcttctgttgcctgacacatggttttccataacatctttcaattgcatatctactataattttaattcaataaaatgcaggaggtgcatgaatggagagtacaacaatttgtagttatgctgaaagacatctacagttcatagacccgctaatttgtacaattaaaattaaaaagaaaagacttattcagagaatgtagcttatctttgtcatggtcatgaatgaacaaaatagggagttgcaaaaaattagagggcaaacttctctgcacactaaaatcaatgggaatgttatagtagaagtatctgaaccaaactgtttctctcccagccagaggctggttcactgagctatgcagcttgataactgccaccagtaatgaagttggactgaatatttttccagttctacccacagacagaaaaggtaggctgaacaagaatactcctaatggagcatttgaataagtgtctgcataatgatgttttcaatttttgaatatttaatattttaagcctatttttctcacactgtgtgagaagtcataaaaggtagagtcctattaatgctaattcccaagactctagaaaaaaaagttttctcgcaatcattttgtaaactgtaagaaaactgattatgtcttcaatctgtgatgatactctacagaaatatgcacatttttgtcttgtctctcttgatattttatgtaaatttcattatatataagtgaactctatcattctgttttccgttttggggttaaatcttcttaaaatactattattgaagagaaaagacaatgctggaagaggaaaagaaaaaaaatgaaaaacagggcagaaaaaggagaaaatgagaggacaataagcctgaagaggcataagaaaaaagaaaatagattatgtgcagctatcaacttctagtgtacagaaaaggaaattgtccttatgaattatctcccgtctgtacttccttagagctctcagctactgattgaatgccctactcctggtagttacactattttctacacttgtatgttaataattcaggctcagaatttaacctgtcatccaaaagagggttaattcttaaattcagttcattctgagttaagcacaaacttcaaaacaatgcaaaggctgcgtggagagtcatgtaattgtatcttccctctcagagacctgagctattagctaacccatcatgttttttgtttatagtcaagtatgatatgtatgttttctggccttcaacagtgctatatccataacactcccacactaaaagcatttctatagaaacaaaaaagaatgaggaaaattgttatcacgtacattgttctaggatttttattttcatccattgtttaaaataggcatgcttgtagtataaaacagcacctctagtgtataatgaggcacaaaatgtactgttcatgaaaaattgatatatataaacctttttactaaaccataacacaattcatcctttattagaagtccaatttaagatgtagacattttctaccaactgggagctaaggctttccaaagactgaactagagaaagaaaattgttttttgcctgtgacaatgtgtggaaacatttgaaaaggtacctacgtaagaacagttttggagaaaacctttggtcatccagaaacatttaaaaaaaaaaaaaaaaaaaaaaaaaaaaaaaaccttccaacctcataaaatcttattttgttctaagtttctccagttctggaatctagaattaagatgcacaattaacttaaagaagcaagtcttggaatgtgccagtccaacaaatgcaggaagaattctccagctcaaagcagagatgaatgagttcattagcagcagctgcacttatacatcaagtacctttcggtaacacatgagtcttggtccttctaaattgtgcagtggggaacatcacacaccagggcctgttgtggggttgggggaggggggagggatagcagtagaagatatacctaatgtaaatgacgagttaatgggtgcagcacagcaacatggcacatgtatacatatgtaacaaacctgcacgttgtgcacatgtaccctagaacttaaagtataaaaaaaaataaaaaataaaaacacttcaatacttagcgtatgagggacatgacttaaaacattaagtttgcagccccatagttaagtcaatctatgtgtttctcccattttccgttttcacaacagtggccaactaggttattgcctcaagatggttacattgtttcacttgcgctggatctactcgttttcagttactttgttaccttgtaaaaaaaagttttcatttgtatctaattatgttatgaattgaatataatagtatctgttttaatttgccactttgctttacagatttaaataaagaggaatgagaaccttgaaaaaaaaaaaaagcaagaactctagagcagagtttctcaaacttggcattaccatactgacatttcgaaacaaatacgtggagtgtgtccgtgtgtgtgttagcatttgcgtcacagtgtcctgtgctttgcaggaagtttagccctatccctgacttctaccaactagatgtcatccacactgcttctcccacagttttgtgacaatccaaagtatctccagacattgacaaatgatccctgggggacaaaatgctctggtcctcttcagaaccaatgctttagagtaaaattagcctaatttctgatttttcccattgcttgtagagacaatggaaatagtaattgcactaagttgatggaattgttgtaaaggtaaaaaagagtgctaagaatattttctggatggggggaggagccaagatggccgaataggaatagctccggtctacagctcccagcgtgagcgacgcagaagacgggtgatttctgcatttccatctgaggtaccgggttcatctcactagggagtgccagacagtgggcgcaggtcagtgggtgcgcgcaccgtgcgcgagctgaagcagggtgaggcattgcctcattcgggaagcgcaaggggtcagggagttccctttcctagtcaaagaaaggggtgacggagggcacctggaaaatcgggtcacttccacccgaatactgcacttttccaacgggcttaaaaaacagcgcaccacgagattatatcctgcacctggctcggagggacctacgcccagggagtctcgctgattgctagcacagcagtctgagatcaaactgcaaggcggcagtgaggctgggggaggggcgcataccattgcccaggcttgcttaggcaaacaaagcagccaggaagctcgaactgggtggagcccaccacagctcagggaggcctgcctgcctctgtaggctccacctctgggggcagggcacagacaaacaaaaagacagcagtaacctctgcagacttaaatgtccctctgacagctttgaagagagcagtggttctcccagcactcagctggagatctgagaatgggcagactgcctcctaaagtgggtccctgacccctgacccccgagcagcctaactgggaggcaccccccagcaggggcacactgacacctcacacggcagggtactccaacagacctgcagctgagggtcctgtctgttagaaggaaaacagaaaggacatccacaccaaaaacccatctgtacatcaccatcatcaaagaccaaaagtagataaaaccacaaagatggggaaaaaacagaacagaaaaactggaaactctaaagagcagagcacctctcctcctccaaaggaatgcagttcctcaccagcaagggaacaaagctggacggagaatgactttgatgagctgagagaagaaggcttcagacgatcaaattactctgagctatgggaggacattcaaaccaaaggcaaagaagttgaaaactttgaaaaaaatttagaagaatgtataactagaataaccaatacaaagaagtgcttaaaggagctgatggagctgaaaaccaaggctcgagaactacgtgaagaatgcagaaacctcaggagccgatgcgatcaactggaagaaaggtatcagcaatggaagatgaaatgaatgaaatgaagcgagaagggaagtttagaaaaaaaaagaataaaaagaaatgagcaaagcctccaagaaatatgggactatgtgaaaagaccaaatctacgtctgattggtatacctgaaagtgacagggagaatggaaccaagttggaaaacactctgcaggatattatccaggagaacttccccaatctagcaagcaggccaacgttcagattcaggaaatacagagaacgccacaaagatactcctcaagaagagcaactccaagacacataattgtcagattcaccaaagttgaaatgaaggaaaaaatgttaaaggcagccagagagaaaggtcgggttaacctcaaatggaagcccgtcagactaacagcggatctctcggcagaaaccctacaagccagaagagagtgggggccaatattcaacattcttaaagacaagaattttcaacccagaatttcatatccagccaaactaagcttcataagtgaaggagaaataaaatattttacagacaagcaaatgctgagagattttctcaccaccaggcctgccctaaaagagctcctgaaggaagcgctaaacatggaaatgcacaaacggtaccaactactgcaaaatcatgccaaaatgtaaagaccatcaagaataggaagaaactgcatcaactaatgagcgaaatcaccagctaacatcataatgacaggatcaaattcacacataacaatattaactttaaatgtaaatggactaaatgctccaattaaaagacacaaactggcaaattggataaagagtcaagacccaacagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagattttaaaccaacaaagatcaaaagagacaaagaaggccattacataatggtaaaggaatcaattcaacaagaagagctaactatcctaaatatatatgcacccaatacaggagcacccagattcataaagcaagtccagagtgacctacaaagagacttagactcccacacattaataatgggagactttaacaccccactgtcaacattagacagatcaacgagacagaaagtcaacaaggatacccaggaattgaactcagctctgcaccaagcggacctaacacacatctacagaactctccaccccaaatcaacagaatatacattttttcagcaccacaccacacctattccaaaactgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgataccctaacatcacaattaaaagaactagaaaagcaagagcaaacacattcaaaagctagcagaaggcaagaaataactaaaatcagagcagaactgaaggcaatggagacacaaaaaacccttcaaaaaatcaatgaatccaggagctggttttttgaaaggatcaacaaaatagatagactgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaataggaaaagagggaatcctccctaactcattttatgaggccagcatcattctgataccaaagcctggcagagacacaaccaaaaaagagagttttagaccaatatccttgatgaacattgatgcaaaaatcctcaataaaatactggcaaaacgaatccagcagcacatcaaaaagcttatccaccatgatcaagtgggcttcatccctgggatgcaaggctggttcattatatgcaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacatatttaaaaataataagagctatctatgacaaacccacagccaatatcatactgaatggacaaaaactggaagcattccctttgaaaactggcacaagacagggatgccctctctcaccactcctattcaacatagtgttggaagttctggccagggcaatcaggcaggagaatgaaataaagggtattcaattaggaaaacaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaatcactgctcaaggaaataaaagaggatacaaacaaatggaagaacattccatgctcatgggtaggaagaatcaatatcgtgaaaatggccatactgcccaaggtaatttatagattcaatgccatccccatcaagctaccaatgcctttcttcacagaattggaaaaaactattttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctctgaaataacgccgcatatctacaactatctgatctttgagaaacctgacaaaaacaagaaatggggaaaggattcgtatttaataaatggtgctgggaaaactggctagccatatgtagaaagctgaaactggatcccttccttacaccttatacaaaaatcaattcaagatggattaaagacttaaatgttagacctaaaaccataaaaaccatggaagaaaacctaggcaataccattcaggacataggcatgggcaaggacttcgtgtctaaaacaccaaaagcaatggcaacagaagccaaaattgacaaatgggatctaattaaactaaagagcttctgtacagcaaaagaaactaccatcagagtgaacaggcaacctacaaaatgggagaaaatttttgcatcctactcatctgaaaaagggctaatatccagaatctacaatgaacttaaacaaatttacaagaaaaaaacaaacaaccccatcaaaaagtgggcaaaggacatgaacagacacttctcaaaagaagacatttatgcagccaaaagacacatgaaaaaatgctcatcatcactggccatcagagaaacgcaaattaaaaccacaatgagataccatctcacaccagttagaatggcaatcattataaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatgccattcctgggtatatacccaaaggactataaatcatgctgctataaagacacatgcacacgtatgtttattgtggcactattcacaatagcaaagtcttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccacatattctcattcataggtgggaattgaacaatgagatcacatggacacaggaaggggaacatcacactctggggactgttgtggggtggggggagggatagctttgggagatatacctaatgctagatgacgagttagtgggtgcagcgcaccagcatggcacatgtatacgtatgtaactaacctgcacaatgtgcacatgtaccctaaaacttaaagtataataataataaaaaaaagaatattttctgttatatagtatgtgggaaaaaatgtgtgattactattatcatgggccgaaaattatgaattacaatttatctgaacatagagtggccattctttggctgttatagccatttagccagaagatgagctgacgtcacttgtgtttatatttattttcaagattatactccttaaaataatcccatttctcttctcgttttattaagttatggttttctcctttacctgtaaaaaataataattcagaaattacatgggaatgtgtttcctgagttttttgtgtgatatccaagaaatcattgccaagaccagtgtcaaggggatttcgcctatattttcatctaggagttttatgatttccagtctcatatgtaggtcttttatccattttgagttgatttttgtgtatggtgtaaaagaagggtccaatttcattggtttattttcagatgaggaaatccagtttttccagagaatatccttttcccattgcggtttttttttttttttttttttttttggtgctgtcatgaaataatattagttgaccatgtatgtttggactatttccggactttctactctatcccactggtccactggtctgtttgtctgtttttatgccagtaccatactatttgctttctatagatagctgtgtaatataattttaaatcagtaagggtaatacctccattttttttttcagaattgcttggctattcagggtctttatggtttcatacaaattattggattgttttatctatttctgtgaagattccactgggattttgataagcatggcattggatctatatattactttatgtattatcaacatttaagacactacttttttattcaggagcaatgggatatctttccattaatttgtgttccctttttttcattaacattttatagttttcagtttttcaacttggttaaatttattcctgattatgttttatactatgataaatgagattgttttcttgatttgtttttggctagtcattgtttgtctatacaaatgccatagatttttatatgttgattttatgtcctgcaatttcactgaattaatttattgggttgaacagttttttggtggagtctttagggctctctatacataggttcatatcatctgcaaatacagatacttttatttttcctttctgatttaaatatcttttatttctttttcttgtctaattactcttgatagtatttccagtactatggtgaatagaagtggtgaaaatgagcatcctcatgcattgtaccagatcttagaagaaaagttttcagtatctccttattgattatgatgtcatctgtgggttcttcataaatagcctttattatagtgagaaactttcctttacacctaaacagttaagagtttttatcaagaaaggatgtcaaactttggtaaatgctttttctgcatcaattgatatgatcgtgtggttttgtttttcaatatattagtgtgatgtataacattgactgatttgcacatgttaaatctgtcttgcataccaggattaaatgccacttgtttgtaatggacaatcttttttattgagaatttttgcattgatgttcatcagtgatatttggcctatagtttattttcttatggtgtctttgtctggtttaggtaagaaggtaatactgatcttgcaaaatttgttaggaagtatttgcttcaaatgtatttctttggaggagttaaagaaatattggtatcacttttcctttgaaaggttggtagaattaggccctaatgccatttgattttgtgcttttatcaagaagtttttaattattactttaatgtctttgttattggactgttcagatttatatgtcttccttattcaaccttgttagattgtatttttctaggaatttgttcatttcatctaggttatcaaatatcttcacatgcaatttttcataatagtctcttatgatcctttcttttctgtggtgtctgttgtagtgtctccaccttcatttctgattttacatatttaagacttgttttttttattctggctaagagtttttcaattttttttttcaaaaaccatctgttctattgatttttttcctatgatttttctttcatctgtttgatttacttttgtttcgatttttattattgccttccctctgctgactttgggtttagtttgatctttattttttggctttttgaggtgtaatattaaactatttatttgagattgctcttcttaatatatttgttgctataaacttcccccttagaactgcttttgctgtatcccataggttttgatttgttgcatttctattattgtttgtttcaagatatattttaaacttttccttttaattcttctttgacccattcattgttcagaagcatattgtttaatttccacatatttgtgaattttccaaaattcttcctcttagagatttctagtttcataccattgtggtcagaaataatacttgatatgatttagatcttcttaaattatataagggttgttttgcggcctaccaagtggtctatcttgttttatgtgcactaaagaagaatgtgtatcttgctggaaagttctatatatatgtgttaagcctatttctccttccatattcatttttatagaggcagattctcactgtgttgctcaggctggggtgcagtggctatttgcaggcataattatagcacactgtaacatcaaacttctgggctcaagcaattctctgccttagcctcacaagtagatgggcctataggaatgcccctctgtgcctggctccattaatttttgctttgtatatttaggtgcatcaatgttggatgtatatatatttataattgttacgccctcttgaggaatagagccctctatcattaaataatgacctgttacgtttcttgtgactttaagacaaagaaatcattacctattttctggtgtctttaattcaaagtctattttatttgatataagtagagtcatccttgttctcatttggctaggatttgcatggagtatcttccatctcttcactttcagcctatttgtgtccttaatgctaaagtaggtctcttgtagcagcatatactcagatcttattttagtattcattcaaccactctatgtattttgatggtagaatgtaatccatttacattaaagtaattattgatagataagggcttactactggcattttgttaattgtttcctggtcattttgtagatcttttgttccttgcattctttattgttctttatctccgagatttggttatcttctagcagctttccccacagaaatcttgtgagctaggagaaaatgtgctgaaagagaaaaagaaaacctggcagctgagaatattatacccagcaaaactgtccttcagaaataaaagagaaataaagcctcagacatgtaaagttgatggaaattatcaccactggatgtgccttagaagaaatgcttaagggagtccttcaaatagaaaaaaaaaagaacactaattaataatatgaaaacacatggaagtataaaagttactagtaaaggtaattatatagtcaaatccagcatactctaatactgttatgatgctctatcatatatatctctagtatgaaggctaaaaaaaaatcagtcaaaaataatgacagtgacaataagtgattaagaaatacataatataaaatatgtaaattgtgagatcaaagtataaattgtgtgaggggagggcctagagtttttttatgtgacggaagttacgttatcagtgtaaagtagtctataataactataagaaggtttatgtaagcctcatggtaacacaaagtagaaaactataacatacataaatggtaaagaaaaaggaataaaaatacagcactacatttgtctaacaaagattttcttatatgtgactcgttgcttttctctcactgcttttaaaattatctcatctttgattttgacaatttaattataatgtatgtcaggacctcttcaagttgaacatgtctggagtcttttgagccccatgtatctggatgtccatatctcttccaagactttggaagatttcagcatttttattattaaataagcattctttttccatctttgtctcttctcacgaaatgcctacaatgcaaatatttgttcacttactagtatttcataagtttcatagtttgtcttcactcttcttcattgttttctttttttctcttattgggtaatttcaaaagacctttttcaagttagagattctttcttcttttcaaaagacctttttcaagttagagattctttcttctgcttaatctagtcttctgttgaagctctgtgttttatttttatttcattcaatgaattctttagccccaagatttctgtttcctttttttttatgatatccatctctttattaaatttctcatttgatcctggattgtttttctgatattgttgaattgtctatctgtattctcttgtatgtcagtgagtttcttacaaattattttttaattcattttcaggcaactcataagtttatttttcttttgggtcaattactggagaattattttattcttttgatgatatcatgttcccttgctttttcatgtttcttgtgtccctacactgatgtctgtgcattggtagaacaatcatctcttccaaactttatagagtgtccttcacatgaatgatttttatctgcagatggatcttaatgtaccagttgggaaggccatggtggctgattctgagtagatgaaggggtacagcttccattcagcttcttcagctttggtcaatgtttgttagcatgactatgggtggcctacgctgcagaagttcgtggcagtggcagtgtaggttgttggggtgcttagtgacaagggctttggcagttctccttttctcattttccccataatgtggagttttagctcagaatgatcctcttggtatcaggtctgacacagcccacaagctgctgcaggagctctgggctccagagcacaggtactcagagctgctatagactcaagaccctggggtcaggttctcataaagagactttgccacctgggtcttgtggtgcagcttcattctccaaggaagaattggatgtaaaatgtccaaaaagccaaggacggtgattctgaggcacgctctagagtaggggcccaaaaaatgggttgtagctatgaatatgatcctgtgggagaaggacacagcactggcccaactctaaggaggaagtggtgttttggaggctttgtcctggggagcagcgtactattgcaatagaaccaatagagcagagtccagctcagctcccaccatatagtgcactccgtagtagtgactctggcccctcagatggtggaacactgtggtaatcccagactctcagtggactagccccctagagtctgttgttttgcctgtagggctgggctgtcccagctccacctctgccctgtttttcaggtcctcagagtaccatgtcagctcagccgtggatgcatggctactcagctcagccaaggcatcggttttctagaaggcaatgtactgctttagctcaggccgatggacaaatgcaacagttactggtaggggtagatggaccagctctgtgacaaattgacctcacgaggtagggcatagtagcagactggcttagtgaaggctggctatcaggcagaggtagttcagtggtgacaagacctcagggattgacagatgctacgactacttgccctcagagcaagatgcattccagcaatggctctgagtttacagtggtgcagctcagtagctgtatggctcatgggggctaggacatagcgtcagttccctcttaggaggaacacagccatatggactcgaggcagctccctcaactggaatcagtccctatgaaaactgcagaagtccccagtggtgaggactgtaggtgtccaaggtggttatgggggctgctggcttcttgcttaccttttccctgcaaggagaagttgctgctagttctcagtcgatcccaactgggagatagagtggtagaggtagagtgtttccttctgttctctaggtggccttcctgggtttcagtgcactataaaactatttttacatgctccagtgctctcttttggttattttcatcgaaatgtaattatttattcatggttttgactgtctttggggaggggataggtgctaggggcttctcagtggccattttgctgatgtcattctccccaaattgtctaattttatggggaaagggtggaggtcttaagtttatgtcattacaatggatgagctaatttcacttttttcatttctaagcaaaaaaaagggaaatttgaatttaatatgtcaagactcagaccacacactttgtgaaatataattgcaaaaatacctcctggcaaaattaccaagctagatttttaaaggccttttttccatcaatctcatatttcttcagagggtttatttagtgaatgagaaatgactttatgagaatgagatacgatggacaagttggtgattttgttgacagcagtgtagaatagcctcattagattaataagctgccacgtagaactcactgcataggtattttccccatggtcttcttattgatttggggccagatgcatgttgcatacagcctgatgaatttaagaacagattcatggctgcttaatgtgtccttcaaaacatctttcaaaagtcattaagcctataaaatgatagggtttttacccttgaggcatcattctacagacaaatagatttcaatttggattttctttcttaattcgttgcaagtttatatggaattcattaggccaatacaagttttgttctactaaaaagaactctaaatctgaagccaaaagctgtatctgaaatataattctgataccttacaggtgtgacacggagtgagtgacataacgtattggccccaattccctccaatgtagagattgatgtagcccaggagttctcagcatgtgctgccaggactagcagcattaccatcgcctgggaccttgttagaaatgcaaattctcaggccctgcaccaagcaatctgaattcaaaattgcatatgtgaccaagatatctgtgatttaacaagccttccatgtgttttttacccatgataacatttgaaaagcactgtactaggtcagaaaaccttttaaggggccagatagtaatattttaggctgtatgtgccaggaagcaaaatcaaggatattatataggtatttatatagaaagaaaataaattttattaatataatttaaatataataatagtaaagacttgttctggcaatataggtctactaatgagaagaatgaaaacctttttaaggcagataggctttgctgagtttgggctcaaagttaatgtttcctatcatcaaatttattgcatatgttcacctgtaaaaatcattcttagctcctgggccatgtaattttactgacaggctacatttggcccgttggtcatagtttgcaatccactatatagagaatctctaaagctctttctgtttctacccttatatgagtctacctgcaccaatgctaaagttccttagctacctctgcttttttcctctttatgcaatattaagaactcaaattgcaaaatcctgacactgtgtccttaacctaaacccatccacccacccacccacaccaccactgcatgtagatctttcataaaaaccaaacaaaaagtaactgaacaacatataaagtgaaaaatcttgtatctcagaactgattttttcaaaatacagccaaatagtaataatggtatgactttatggatagactttaattatgatgtagtgtctatcaccaatatccttcatgagttctttgttttctgttgggggaaaagacttaaaaagtcaacaatgtttcagagattagctgaaataaaacatatcaaagtcatgagttattttaagaaagatataagcagaaactttgtatcccaggcaattagctgttatcagattcggtataagacatattagtcagacttccttttatccatccaggtgggaatactagaaacagatatcttttctaatcagtttccatcttaagtcaaaatagagagagagagagcacaaattagttgaataaattcatttgcttttaagggaacttgcctcctgcaattaattcaattgactagttcaatttctttatacattcattagggcattggtgagaatatgattattcagttttaaacattgcttgggttctattttctctaattcacttgaggcagaactattacaatgcctctagttgctatgttccatgctatgtgaaagaagagtccagtatttcctcaaaagtgtgcaaataatataatgaacccactctgggctggagcatatctattgtgggtctcgtgcacttgtgtatctggtcaagaattgaatcaaggtccttggaatgagacaggaaattgactccatgggagaaagaagcagtgaggcacattgtttttgtttgtttgtttgtttttctctgttaacggtgtaaattcagaaaaatcttccaggatgggtgcggtggctcatgcctgtaatcccagcactttgggaggccaagcaggtggatcacttgaggtcaggagttcaagaccagcctggccaacatggtgaaaccccgtctctgctaaaactacaaaaattaatcatgcatggtggcatgcacctgtaatcccagctacttgggaggctgaggcaggagaatcactcgaacctgggaggcagaggttgcagtgagccgggatcgcgccaccacacttcagcctgggcgacatagcaagactgtccaaaaaaaagaaaaaagaaaaatcttccttcttggattggggtaaaattactttctttcactttcttttcgtatttgcatttggacattgcagcaaaatcttcaagatgtgataacttcacatctcaatccttgtatttctcttcacagaaagtgaaacttcacctcctgcagtctctgttagttacactgttagttacactgacatacagacaggtttactctttattctttctctttcattttctaatgaggaaagtacgtacacaatggaatacatgaagcatattcggctgtacctcataatgaatttttatgtctatacctgagtggaactacccatctgtgtcacaagagagaacatttcccacattccacccagttgacacccaccctagatggaaacactattttgacttccatcactacaagttagatttgtctatttttaaatttttatggaatcttttgtgtatatcgttttgcccaaaattgtgcctgactagatttgttcttaagtaatacatgtagaaacacttttgggtccacagtgtaaaaacctaagtcaggtatttccctagaaaatatgtgaaaaccctcaatccagataaatgaatgttaacaaaatgcattaaccaaatataaatagtgaaatgctactgtatttcttttctgttttctaacataattgcagttttttcatacgtagaatttcaagaacagatataacttttcagctaaaatacaaacttacaaaatgcattgtaagttttgtactttttggtgattattgatatcttgtagattttaaaacctacctgagttcaaaatgaattactttaagcaaatttatcattttcatctactttacttcacaccttatgagcctaatttttcagggttcattaattcctgttcctccagtggctgttatatattatttggatttccatgcatgtcatttttgccttctacactgtgctcctttgaaattcttcgtttttatctaattcatttctctcatttttaagcaattttctacatataatgttaatttaattttcctgcactgggttcaagcatgacattttattgttccttttacctgatttctctaattttctttaaaacaaaatagaatgaaaaatctttcccccatagtcagtttcccctgtccactccttcctttctgttatttgcaccatcattctgccaattcccgaagctggccagtgggagttctttgactctcttccccctgtcttgccactgctgctcataattcatattctcatcaccagaaccctgactgcacttatgatctaatatgcctgcctggtccaccctctcccagctgcaatttatctactatcttctccctaaacctctgatggcatcaggcaagtcatctgctgaacaacttaaatcagtatttctccaacgtcgaggatatgtgaatccattttaaagggaaaaacatcccatagatcacccgtgctgacttaaattagtttcattgtagtatcatataaataagtacgaacataagcctattcataaaatctttcttcttacagattgtatataactataaaatcaaatggattgtaattaatactaacaatgtaatgaaactaatatcactcaagtgaataagatggatgaaaataaatccccacccactatgtgaatattgtattaattgctactttttgtgcactggcaagcttaagaaaagtgctgggaaggttgcatcatttcatggactagaatattatggcaggactataaattatgccatgttctgtaagatgatgcaatcctcccaacacttttcttcattcaaaatattccaaaacattcatgctttctatatactgcaatgtcatttgtcttccctggtttcaaatgcatcatttatttcttaagtccacctgtgtttttttttttctcattagttcattaaaattaaagcagcgttggctgggcctggtggataacacctacaatcccagcactttgggagactaaggaaggaaaagaagggggattgtctgagcccaagagttcgagaccaacctgggcaacatggtgagctccacctcacccctgtctctattttaaaaaagaaagaaaattaaagcagtgtgacctgattaccatgcaatgaatgataaacacaacataagtgaaataatcctggtgtttgcaggtaggagactgccatccagatgtcagagaatgtatttacattattttatagattattatttaaatgaaaaccccaaaggtgatagatatgtctaaaagtacatcacaggacctcagcttaaacaactgagctaaatgacagtttactgcccattaattcatactcagataatcaggtagaccttgtttatatgtttgtcctgtctcataactagattttaattttctaaaaggcagaagcagatcttaaactcctttgtgctttcacatcctagcccaagaccttgtacatataacctccactaaaattccccatcagttgattactgagttaatgaatacctttcattgcatgttccctgttttctattttcccctatagtcagcactgttccccaatggcttattcctttccttttccttaccccaaaacctctccaccttaaaaaatgcacagccaggagtgttggcccatgcctgtaatcccagcactttaggaggctgaggcaggagaattacttgagcccatgagttcaagaccagcctgggcaatataggcagtccctatctctaaaagatatcaaaaaattagttgggggtggtggctcctgcctgtcatccaagctactcaagagactgaggtgggagaacattcttgagcctgggaggtggaggctgcagtgagccatgatggcaccactgtactccagcctgggtgacctagtgagaccctgtctcaaaaaaaaaaaaaaaaaaaaagcaccaaaaacatgcttacaaccacaacttcattcacatccatttaaagtaacttctctgctgactgtatcactatgtcttatatctcttagctgaccttcttttatcttgtgtttctttgttgagatttcctatgttttacatttgccccatgcatgtttgcagttgctgtttgaagcatttttaggatggctgctgtaaaatctttgctctaaaacatctttgtcatcttgttgttggcatctatttattgtctttaagttggacatcttcctctccaacttagtttaatgagtggttttcagctgaaacccggacatttggggtattatgtgtaagggactccagatattatttcaaccttccgttttagctgatttccacagactccattactgcaggctatgggagagcaccacctaatgcctgcgaggtgtggataaaagtctggattccccacttgacctctgctgatattcatggggaagatactcctcattatttatggtagaagtggtagttctatttccccctacctctccactgacacgaggatatgggaggtgtccttacctctgggtggtggtaaaagtcctgactctccacaagcctagtgggaagagaagaaatgcctcacatactgccgagtgggtgggggctggactctccctgtgatctcctgacaacagagtgagacctcattacagcctgtcagggataaaagtctgtccctttacttcaccttctctaacaccatcctgttggggagtgagaagagcttccttgcagcctgttggggctaagtctaggctcaccacttcgctttggggcattactcatgctacccatctcaagaaataggatctagacttctggcctactctatttttcaaaagatcttcctttattatccagtttttctttcgagacagagtctcgctctgtcgcccaggctggagtccagtggcgtgatttcggctcactgcaacctccgcccctccaggtttaagcaattctatgcctcagtctccggagtagctgggattacaggcgcctgccaccatgcccggctaatttttttgcatttttagtagagatggggtttcaccatcttagccaggctggtcttgaactcctgacctcgtgatccacctgcctcggcctcccaaagtgctgggattacaggtgtgagccactgtgccccgcccttatccagtttttctaaggagttaattatcacaaagatacctctagacgacaattttgcagtgcttattcaaccatatttacctctccacctaaatgtatttcttggagatctcatcaaaccccatacctacaaacaccatctgtatttcttacaatccgtaaatttatagctccagcttcagcctctctcctgaagttcaatcttacatatattatgcttacctgacatctccattttgatatctaataaataggaaaatcaaatttcattctatcccacctcaactaaggccttaaatcttttttttaacttccaatttcctcactcagaaaacaagttcattctttcagaaactcatctccaaaataatgaattcccccttttctttcacacactgaattaatccaacagaaaatcctgtagacacaaatttcaagatacattcataaccattttttaaaacatccacagctgccaccctagtctcggtcactattatgtctcacctgggcccctgaaatagcctcccacttccctgattccaaccttgttttctaggcccagagtctcttcccagaaatgctacagtgattcatttatgatggaaggcaaggcatgataatcctctactcagaaatttccaacgtcatctcactttatacacagggatataaagagttctgctttaattcctaaccctgttcatcttactcagattgttccacccagttggcctccctgcagctctaaggccaagccaaacactctctaaccatggggcctttgcacttgctgctctgtacatgtacaaagctcttctcccagatatcctggtgttatttttggttcaatttcctcctcaattgtcaccttgtcagagaggacttccctgactttctatcccattttagtattcttccaatgtcatttctttatcattcaccctgttttacttttgttcatagcctttaccactacctgtcatagagtagtttgcttattcgttgattctgactttctccatggaaaggaagctccatgagaatgtgggctttcttttgttctctgctgtatttccaatgcctaaagagttagtgatacacagtaagcagtaagtgcttgataaatatctgttgataaattcaattcaaaaatatttcttatcacagttaagaatttcttttcctggttgacatatactctgccaaatagagttcagataaaatcaaagatatatatttcacatacaatattttatttattattattatttttccctaagtaagcatgtgcttaaactagtaccaaaatataataagaaaactagtaatagtaattcctgttaaaagttggtgcattcagaacttggtatagccatattcctttttccgataataaaatttccaagttcttttcaataaaatgccaaaaatagagatccttcattgtaatacccttcctgataactgatatacaaaagaaacacaaaacagtagcatttttccagaatttagtataatatattgcttctgaaataaatacacattctctttaatacttactatcagcttacatgttttaatggtagggcttatgtcctatatccacttccatctcactgtgaactaataatctcataatggcaggtggaggtgctactctagaagctcctagaatttgagaaatgagtatgtattactttttttttagattgactgaaatctttctgcaaatttctgctggctgaacatgactgaaatctatttcctaaactggagttcactctcctcatgatgaattcagaaaaataattgggcacctgaataaaggatttcttctactgagattttcagacatatccaatgattatctatatctttgtcagactaaaattcaccagatgacgtaaatgaaattcacaaatattatttttcagaaaaacaatataaagtatcttccacacttataaatgtattataccagcttattaggccttctaattgtcttaggaaaattgcaacgatgtactaactagttttcttgccacttgactatctaatcaccctccaaactgtcttccattctctctttgtaagagtattccttgatcttgaatttcatctgttgaaaatattcctaaagcttttgtattagttggttctcaagcttctaataaagacatacccaagactgggtaatttagaaagaaaagaagtttaatgaactcacagttccacatgtctgaggaggcctcaccatcatggtggaaggcaaaggaggagcaaaatcatgtcttacatggcagcagacaagagagcatgtgcaggggaactcccatttataaaaccatcagatctcatgagacttattcactatcacaagaacagcacaagagaaacctgcctgcatgattcaattacctcccaccacatgtggggattattataattcaaggtgagatttgggtgcggacaaagagccaaaccatatcagcttttaaatgctcaagaagaacatatttcacacataaagcccttcaaagtccctcacagcttaacctcagtcaactttttccagccatatcttctctacttaaccttgcaggtatagccctgtaggtctataacaatgacccacctgttataagcatctcatacctttatacatagcacctttcattcttgcctaacttgtagtggtctgtacatttgtcaagacttatttaaacatcactttctgtattcagggtgcattggatagtttttcccaggtttctgacattgcttgggtgtgaataatctataactgaaggatacatagttcctaccctcctggagcttgcaggctgggaagacttccctgcccacttgcctatgaactcctctccaatcagaattacgtgtttccctagctctaccataatgaactgactgtatacctaaatccatcactaaatgatgcacttttcaggatactgacttctcttaatcatccatatttattcctgaatctagtccaattcagcacagaaaaaatgaaagtttaatgtttgtaggtttggtattaagaacaagacaaaatgaacttatgaaagattcatttaaccatttgaatttgttttcttcctaaggcaacagatttttaatatttatcaattgggcatgaagaaaatcatttatttcttatagaggtgaatccttaatctctaggaagaatttttatccatgtgaaattttgtttaacatactaaaaaaagattaaagttgtctcctgtccaacattgacaaaaagagacaaaattaacttttcttttatgtgaagttgtggtaattttctctaggctgaaaggacaccagccacacattctctgtgtcctccatttctttacattgaaaatgagataccaggcaatttacccatcaggtttttaatgagtcacagtatttgaaggctatgaactgagaaatatcattcatttatggtcttgtcctgcagctgttgtgttttatataagacagtgtgatacaaacaaaacagagctctttaataagcttcactattaagtgcaactgagccatttcaggaaataatggcatttcacagaagagaatgaaaaacacgaagtgtaattttcctcaaataacaaagaggtaaatggatttaaaaaaagcataaatgttaacatagtgaccaataagtactttttggcatctaaaaatctcactgtagcacaactctttgcaccttagtttttgcttcaaatatgccagtcatgagtcaattatggtatatatttgtcaacaagtccttgtctgttttttcctaaattagggtcaagcaataaagctgccaaaaaaatttatgctttttttaaaggtaacactagaactcaaattcaggctagaatccattgtccaggtaaatccctgattatcaactgatcataccttagttaagtgacttcaatcacaatacctccttcctctcctttccctcatccttgtctcagtaaaaaccttatgactccatatctacacattttaatacctcttagctgtgttttctttctgctaccccatctatttagctcatatctataagagttcagttctaaagtccaaattgaatcatatcacagtcctgctttaaaaacattcattgacaacggtcttaaatcggcttccaataaatcatacagcctgttgtttgtaatctgtcatttttcatgttcttgatgaaatcttcattcaccacaaaataacttttaagcacctactctgtggcaagaataagatggatttatgactctcttagagaaatacaagccttgccctcttggagtttacatgttggattagtttcctacaggcgctgtaagaattcaccacaaacttagtggcttaaaacaacacagatgtattatctgacaagtctggagatcagaatccttaaaatcaaggtattagaagggctgctttccttctggaggttccaggggagaattcacttccttgacttttccagtttgtagaggtcacttgcatttcttggctcatggctccctcctctatcttcaaggccagtagtgtagcgtctttaaatctcagactctctctcttcctccctctgtctcctttcctctctctttttcccacagcgagctctctctctctttcttacacatacacactcactcactccccttcctttgcctcctcctgcctctgaatcatctgcttccccctttccattataaaaacccctgtgatcccacggggcccacccggataattcaggataaacctcacatcttaaattccttaacttaatcacatctgcaaagtcctttatgtaacacactcagagattctggggataagggtgtaaatctctttggcagggccatggggagaggcagtcattgttctgtctactcaatgtctgatagaataggcagatacttgtgatatttttactgttttatattttccaaattttattttattattacatagtattcttctaattgtgggggaatgttttcaattttcataacacccaatcaccctatcagatatagtccaaaatgtatgtcatgctataacagactaagccagacctgatcataccctgtctttctggcttaactgcagacagtctccttgtacctcaattatagtagggtactcaccatcctttaatagactttccttctttaataatgctctgtgtcctgcacaaagactgggaagcctgtagtctcagctactcgggaggctgagcaggaggatatgttgagcccaggaggcagaagttgcagtgagccaagattgcaccactgcactccagtctgggcaacagagagagaccctgcctcaaaaaaaaaaaaaaaaaaaaaaaaaaaggctgggtgtggtggcttaagcctgtaatcctagtactttgggaggccaaggcgggtagatcacgaggtcaggagttccagatcagaccagcctggccaatatggtgaaacctcgtctctactaaaaatacaaaaaactagccgggcatggaggtgcatgactgtagtcccagctattcaggaagctgaggcaggagaatcacttgaacccaggaggtagaggttgcagtgagccgagattgtgccattgcactcaagcctgggcaatagagggagactccatctcaaaaaaaaaaaaaaaaaagccaggctcagtggctcatgcctgtaatcccagtactttgggaggccaaggcaggcagatcacgaggtcaagagattgagactagcctggccatcatggtaaaaccctgtctctactaaaaatacaaaaattagctgggtggcacccgcctgtattcccagctacttgggaggctgaggcaggagaaacctgggaggggaggttgcagtgagccgaggtcacaccactgcactccagcctggcaatagagcgagactccgtctcaaaacaaaacaaaacaaagactgggcaagtcttacctcaacttttcaatttggtaaatgccttcaaatgtcttcaaatgtcccatcccttttctatttgttccctgatgccctgggcatggtcactttctgcctcctctgtctctccagagcacagtggagacacagtttctcataattttacagaataatttatggcctgcctctatcacttactccacatgccttcaggacagggattacactctgatattgtgtacacctagcacttaccacaatgcttagtagtgccactgaataaaatcttaaagtttgcttgactaaattaaatgatgttcctttggaaatggtacacacaaaaatatttctgacaatgtgtgcttgaggctccaggatgtggcaaatttgttaggataaactattgggatgcttaaattattttcatgggaatgagcaatgcctgaaattctaacatgacactgaaagagcatattttgctgtcatattttaagatgaatatgtatagacacaatttttcacaaatgttttgttcaaattcaaataacctgcctaataacatggtgatctgagtgacaactttttaattatattatatatatgttttataaagaatgcttccagttgttgactattttaggttgtacttcataacgtggtttataatgtatggatttctagacaagaatcagtcttataaatgtgccattattctaaggagagctgttgacttggacttttctcagtttactttctgttgatggtcatcagattcagaatcacagttcttaaaaatttaattaaattcttgtctttattaagagtaagtataaaacaaaattggctggcctgaattatggactaaaccacacattatttaagaaacagataacatgtacttaatgcatgtgacattaactacaaaaatatattgtcttgatactaattccaatgccacctcactaaggaatggtgaaatagggagatctcggaatggaatcgtgtctattctgttcttacatacatcttcaaccattattttactcttttagttctgcgactgatcttcctctgtattccacataagacagcttaaatatattaacatcattagacttagctattcacataaagtgtagatagttcttctatctgtctgcattcatgcaaaatgacagtgactataaaacacgatcaataatttaaaaaggacttcaatccctgtcacttgtttctgtatgtacctgcgaaatagaacatgaaagcataattttccactaagtgttattcctcataatgcttgttgcttgtgtatgaatatgtgcaagatatacacacacacacacacacacacatatatatatatatgcacacatatatacactatgcctctgtattagtctgttttcatggtgttgataaagacatacctgagactgggcaaagagacttactggacttacagttccacatggctggggaggcctcacaatcacagcagaaggagaaaggtatatctcacatggtggcagacaagagaatagagcttgtgcagggaaactcccctttttaaaaccatcagatctcatgagacttattcactatcacaggaatagtgcaggaaagacccacccccatgattcaattacctcccactgggtcctcccacaacacatgggaattgttggagttagaattcaagatgagatttgagtgggggcacagccaaaccgtatcagtctcaaagctgtgagtttggactatcctgatattttggtcggaataaagcaatttcaaatttcagtactacctgcgaaaaaaaaaatgtgactctacatgttttcccaggttgcatggagtagcaacaactatgcattttactattctacctatttaatttttaatacagatggggtctttctaggttgcccaggcttttcttgaactcctagtctcaaagccatcttcccacctctttatcccaaagtactgggattgcagacttcagtcaccatgtctggcctcaacctatattttttaactcaccaagtatatggatgacagctactcctatggaatcactgtaggtctaagaccttatacaaggtatacacattcaaaggttaatttatcagtttactcagaggtcactgatctcccaacagacaatacagattaaatttgtaaggacaaactcataaaccagaaacctaaattcttaattatatttagaaatattaatgccaagaggttcagagtgcttgcaaatggtaagcttaatttctttacagaggataatctattttgccaaagattttaaaatcaggacgttttcagttgaaagttaagactgtgaacagatttaagcagtctttcatatccccaggctatgaaattttcatctctaccacaggtagattaattaacatagtggtgtgtctactaagtggaccataatattccagtctgtttgcagtacagtttcccttgaattttacattttggaaacactgttactaaatattatattttaatctgactagtcagaatttttatcatttaaaactcttcttagtaaaatacttaatactttgctacaatgtctttgattatagttccttgtaatttatatttcacttaatataattaagtgtaatttatatttcacttaatataattaagtgtaatttatatttcacttaatataattaagtgtaatttatatttcacttaatataattaagtgtaatttatatttaacttaatataattaagtgtaatttatatttcacttaatataattgcatggtattacctaaatctcattaaagttctctccccaagtgataatttctagtttactttctgagactttgcgtatagacagttaataaaaaacagtatcaatgataatgctcattagctttaaagtcagaggggacattttctaataatatggtcataatcgtgagtccagacttcagtgtataatccagatcccagattatacccacttagaagattggtgccctctttgtgcagaaaacattttttttagaatagtgattatgattgtctttaaataacagcaataaaacaccatcaatatgatagtaggcataaaatgctatgaaagtatattcaatcatagaatatcagatatttagtcaaggtaaaaatgaagtcattttatctataattattgctgcttttaaaggaattttttaattggaagcataaaaaattccctaaattattttatcttgatattcacatttttataaatcagtatcttcattcttttgggaaaattatataaataaaggaaattgatagtagacattacaaaatctatggctatttaaaataaatgtgtcctcatacatgtacgtgcacacgcacacatatacatcttcacatcaaaaagtttatgacaatgaagacagaggttttcttaactgaaggaagctattccttagctaaatagctataatggacaaaattaaacgttccttatattacagttgttgaattatgtaaacataacaaacattaggaaatttaaatattagatgcttcagtaacaaatattgcctttaataaaaaactgaatgtagtatccacaaaatatatatattcattccacttgtaaaatttacaaaaacttactactgaacaggtttactctgtgtgatatttcctttcacttttttttcatttaaataaatgatagttttctggatatctgatacctttctttaaacactttaaaatttcacttatccagaaatttgaatgttatatgcacaaatataataggcacttagaaaatagtataatttcaaattattttgatgtacaggtttgtttagtagatctctagataatatgggggagctactgtcaactgcctctagttcatatatataaacaggaaagataccaacagagaggttgatggaaccatttgtaaaattaacaacaagaaatgcatttctcttcctattgctatttatcagtctgtgtgttaaatatgatcatgatgcaaataaggatgcataaaataaataagggaacgctttcattatttaaaactttactcaaatgtttgtttaaatggccaattacccctgggcatttaaaaatatttgcaaacagactgttcactgtgactgataggcagagatcttcaagctgtagcattagtagctgctgccagccaagtatcagtgagaaatcaagatttagcagctgtgacgctgcagagcaaggtaattgccaaaataattatcaataatgtgcacaaaagttaatttccacaccaattttcaagaataataatatggatttaatatattgtgaatggcattctggcccatggcctattaataagtggaaggaaaggaaaggaagggaagggaagtgaaggggaagggaacgggaaggggagggagaaaggaaagaaggagtggggggaagggagggaagggaaataaggacagagagaggcaaggagggaaaggaaggaaagaaatcataaatcaccaccattcatctccttaggataattttgaaccagttttttatcccctttctactttacattcttccataaagccttaccaaatctccttcttgtgtcctgttatataataatgtcatgtacattatataattaaggcaaataacccatgcccttatggggcttctttttcagaataagaatacacataggcaaacaaggtcactgcagcccgtgctaagttctaggagaacgtagagggatatgatcatgagaacaagggactggatagtggcacagcactggaagaaggcctgtctgagtcactgagatttatactgaatcctaaagaatgtggaaagaggaagcctttctgactgtaagggaaaatatcattgtgagcggagcagagaagaatgctcaaagaccctacggcagtcacgcgtttatcacagtaaaatactaaattataagctcattattttcttttacttttcatggagataatcaatattacattattcttgctatctgtgaatatagactggtttatttctggttactgcacccaagatataaagcatctctgagcttcagacacttatgtaatagccataagacactatggactgcatattaaacgtgcctgggattctgacttacttttgaatataaattctttttttcttatgattcatagcatgctgttttagaaatgaagtcagagaccccatatagctatggtttcatttcattttctttacaaagagtggaaaatagaactagtcaaggtatttgcttagaggtaacccagtactccagaatagctttaggaaactaaattatctataaacttcaatattttactaatctttcagtaatattctcacatattgctagtttaaatattagctaccatttctattgtttatacaatctcaaagagctcatgctgttttatatcactcttgtcttccttctgcactgattgtctttcctcttattttccaactggtaaaccaactcatgactcaggtatcttctgatctagaaagattttcattcactctctcacctctttcacttttccagattgagctagaagagaccattatcaaccaatcacaccatattattcatcacctatagtagactgctgagtgcattgagagtttacaggggttcacttacattgactgactggattaaatgtttgatgatattgtgaagaaatgtcataagggtgactctccctccagtgacctagggatggtcacagtaatgtgggattcactagtctggaaatcccctattttggaaactcttttaagtaaagagacacttgaatgatctatatttgattgttcaggcttcaggagctaaaccgtagtgttgaagaggtacaaaaaatgagggtcttgttagttggatggatcttaccttcataatcaaagggccagaatccattagtttccctgatataatttcacaaaggagctctaggccaaaaacaatgagaatatgataaaatttactttcaaattttgggcttctttatcttgtaggttttgcccttgtctattttcctactgtgactaaaggtgatcccatatgacatcttaggagaaaacaaagaatgtcaggctacaaccctgggctctttagagaagggaaacaatgaactcagaagccagtttaagaagaatgtgtcatacaaagaaaattttaatttttagaaagaaaatgcactaagaacccattttacttctgtttaaatccagtaactgaaaatgatcatcccccttcatatctaaagccagatttttaaagcattcttggtatcagatccctaatagtagaggagttaaagaatttgagacaaaactttaattaaactcctcttacctaaaagcaaagtaatggacaagagagtgtttcatgggaaatatcagctattttaacaattaaagaattattgacaatttggtttcaaacatttggtaaactcaggaacagtgagtgtccttcaattaaaggaaaatcagtccaaaaagtaggttggtttacatttagatacagtattaattttaccataattctagtgaatgaatcaactctatgataattataattagtgggtgcattctacttccagattatgaattattccctattttgtagtgatttgaataaagtttataaaagagtttttctgccactaaagtgatcaatttagttatgatgaaaattgccagagggagtgtgactaattattatacttccagatattgcaaaaagatgtactttactcacagtctccctttttttttttacagatgtaatgtatgggttgataataccagcatatctaaaaggtcacttcatctgtgacattccattggtaatctttccatcaatattaaagatgaaaataaatgttgtactcttttgtggtctacttttgaaaatatttagcaaatgtcaggtcattataattttctagccactcaatatggaagaaagttggagattatgtttatcctatttcagttagtggattaacaaatgatgatgctttccacaaatcaaactaaaaaatcattacccagggatcctaagatatatcaggttatcttccgattaaaaagactcaatcggttaccaggagctgatattcttgtagacagcaagccccaaaccattattatctaaacattaaatatgtaacacaaattattatagactgtattatatcatttagatatttgatatcttactctcttctctcccccaacctaaaaatacgtatactgaacctccatcagtaaaaaagcctggggccaggcatggtggctcacgcctgtaatcccagcactttgggaggccgaggcgtgtggatcacttgaggtcaggagttgacaccagcctggccaacatgatgaaaccctgtctctactttaaatacaaaaattagttgcgcatggtggcacatggctgtaatcccagctactcgggaggctgaggcacgagaatcgcttgaacccgggaggcagaggttgcagtgagccaagatcaggccccttcactccagcctgggcaacagaacaagactctatctcaaaaaataataagaagaaggagaagaaaccctttctcatcatttgcacatagtcatggaatgaagtatgaagggaagggaaccattaactcatttttcatatttctctccccaagcttttaaggcatgtcttgtgttggaggcattagatttccatagaagaaggtagctaagaaaactaatcttcctaattcatatgtgcaaccacaaatatttctaagagaaagaaaagaggccatgcagcatcaatgcaattgagactaccacggtagagtggaaccctttactccaattctccgtggaatatataatcaacctaggaatccatcatatagtggcttgatttatctgttgaaagccacatgaagtgatttttgcaccattcatttgcttagtctatgaaaaggtgctatgtatccaggacagcgtctaggatatggtggctaagagactagactcaagacacagactgcttctgtgtaagtccaggtctgcaatttactgtgtaaatttggacagcacttctctgtgcagtacaatattctgtgcctccgttttttcctttctaagatgaaggtgctcatagtgcctgccttatgggattgttgtgtggattaaatgagttcttatatgttaagtgtttataccaatgctggcacatgagaagttacacgtaaatattagcttttgttgttattatagtttgtactttgtcaattactcaaaaatcaacccttgtcaaaatatggatagtacatgttttccactgatggatgttgtaatcctgaattggggtacaaattggaaagtgtagagctcatctcaaatgtcgattaatttggccagtttacctataatgatcacacaaaatctttatattgctaagccacggctctttacattaaggaaactgtaatccagtagtagaaataaatacaagagattttaataaaatgtgggatgtagaaagttctgaacaaaggcatgtgtacagctgaattgcagcggttttgcgaagttcttactcagaggaggtcttcagactacaagttgaaagatgtgtatgattttgacgaatggacatggttgaatagtgtagcttgttgtggtaagttgttaggtgtaataggagataactggataagcagaataggactagatcaaggatggtgggggatcttaaatgcccccactgagactggcatatctgaaaaaaagagccaaagtgattaaacaaaggcagaagtgaaatgggatttaatggttaaaaatataacactggcgatactagaaaggatgtactagaaactttggcaaaatcttctagtaaaatagtacattgaggtcatgctttgaacttccccatcaaccctaaacacagcacagtaattataaaataaataaataaataataaacatcaaatgtagccacgttcaaggacaaagtaatactctatagatcagaaatgaaacaaaatcccagagtcatgagtgctgtggcattaaagccccggaccagactcactggcatccaaaatcaagaagagttacctgtggggtaatgaggaagaaaggcccccggacatggagaatggagggagccagatacaccgcattccagcaacaggcaaagggatccaggctcccctggaaggagcctgaaaacagctgcgctgctgactaaaacttcacttcatccactccaaaatatatgcaaagaaaagataaaaccacttggactgaccttggttcatattagtctttcttttaacagcttcatgcaagtagaagggccttcattgagcaatataaaatgtattattggatttgaaacaggggaataatgaactcaagataggtccacagaaagaatacacccaacaacacaaggaaaactaaaagtaagtaaaacaacccaaaaaactgtagggttgggaagataaaaaataaattccctgccaaaatggaagatgatagaggaattggagaatatctttaaaatcagaaaattatgatcccgaaagtaataaattaataacacctattataaaaagaatactatattatgaaacaaaatcagacagacatgagtcaagagaatataaacagaaaaatatccctcagaaaaccaggacatttttaaagatgtaattattaaagtaaaaataaaattaaatgtttatgattaaacttacttcgtttcagtcaaagggaaaacagtaaattagaaggtaataaacttataattaaagtaaagtagaatacaggtaagatgggttaggtgcagtgactcatgcctgtaatgccaacattctgggaggccaaggcaggagggtcactttgagctcaggagtttgagaccagtctgggcaacagagagacctcatagctacaaaaaaaaaaaaaaaagaaaagaaaagaaagaaagaaagaaaaagaaaaaaaaattgactggtcatgggcatggtgacacatacttatagtcccagctacttgggaggctgaggagggaggattgcttgagcctgggagtttgaggctgcagtgagctatgattgcaccgctgtactctgccctgggtgacaaagtaagaccctgtctcaaaaaaaaaaaaaaaaatactaccgccaagatgaagaggaaggagatttttattttaatgaaagagaatttaaaaacagaatggaaagaatagtagaaaaataatattaaagaatgaggattttccaaatgtcgagaatgacatggggtttcagattaaaagtgcatatccagtgctgaccagtatgaaacataaacctgtacctgatattaaatttaaatgtaaaatatgataaagcaaaagaaggcctatttcaaaatgagatttaggaagagaacactgagaagaaacacttttgaacacataatttttttaaatgaagatttacaagaaataggaacatgtccatgtatctttctcagatgatagtgtaaaaaaaaagatcaacaaggataaaatttgatgttaaacaacagcaaatgatgaaatataattataaaaacctgaattctacaaatgtagagtgtatatatttttaaaagcatatattgaatcttaacaaaaattgaccatattataggtcaaaaataaatattacacatttcaaagattagtatcctaaagaccacatcttttgacagtggcaattagaaatcatcatagaaatcacatatttgaaaatgaaaaagacattattaagtacttaaaatctaaatttgtgtcagcacatctaaatttgttgctctagatttgggaaataatctttcaagagctcatgaccttcccagtttgtggaagtattttgttaattactttttcaataattttcaatgatcggaaatgataccaaattatgctgggtccgtttggctaatacagaaagcaaacatcagcaccaaattagaagtgccaaacattttctacaaaagtttaaggaaagggagcaggagtgggcagataaagtcatcctgctttgatgctggtctcatatttgtgaaaggaaaatgggaagcattgggtaggaaaagcctcggtgtatggcacaccttgagaaagccctcactaggccaacgggtttcccccagggtatttgctcaatatctcaatattgggtaagaatatctcaatattgggtagggtatttgctcaatatttcaatattgggtaggaaaagtctcagtgtatggcacacctcttagaaagccctcgtcaggccagcggggtttcccacagcgtatttgctcaatatttcaatatggatcctgctttgggacagaatggcccaactcctgtaccttttccatgttcagtcattggctgggagtatcctaaggaaagcacggcttcaacatcaagatttggcagatctcagaggtgtggcagctggaggctgtcaggcaattccactgttctcatgaggcccttgttaggggggtcagttgtcttcatgtacaccacatggactctttatgcacaagtcatgttttctgttgaactttaccatagggtgataagaaggaaataattgaaaatgtttatcttgagcaaaacaggtaaaatgtaggtcaaatgtaaaaataaatttttgaaagtcattttgagaaaactgctgacaagattacacaggggagaagcataaattgaaaagatggtaggaatggtttatttatttaacaaactcaggtcatttatcatgtgtgaaactgtcaaacaccattctatacacttcacaaatattaatttatttaatcttcatagtcattattaaatatatatttttacagatgaagaagctaggagagattaggtaatttgctcaagctcacacagctagtggaacaaataacaaaacctcataaaatagctaaattttaaagtcaaagaagaaagaaaagccagaaaatgaaactgaaggtgtcttagggttctctagaggcacagaactaataggatagatgtatatatgaaagggaatttattagggaatattgacacacaatcacaaggtgaagtcccacaatagggtatctgcaagctgaggagcagggaagccagtccaagtcccaaaacctcaaaagtagggaagccagcagtgcagccttcagtctatggccaaaagcctgacagcccttggcaaaccactggtgtaagtccaagagtccaaaaactgaagaacttggaatctgatgttcgagggcagaaagcatccagcacggtagaaagatgaagcctagaagattcagcaagtcaagttctcccaagttctcttgcctgctttattctagcagcactggcagctgatttgatggtgcccacccagactgagggtggtatcttcaaatccactgactcaaatgttaatctcctttggcaacaccctcacagacaggcccaggaacaatattttgcatccctcagtccaatcaagttgacactcagtattaaccatcacagaaggatagttagaaaattcaaaagagaatgaagagatacaggtttctaggagtcaaaagaagagataattttgaagaaaaatgtgcaatcaagtgcatcaactcttcagagaaaggtcaaagcagaggcaactatggtattgcatttagtagatcttgagtgactttcaagagattgtagattaaaaagagaatgatgggataatatgtagagaagaaagacagctaaaattgtttgtttttgttagcataaaaagaaaattaagtgtgcttgtgcgaagaatgtaacatatttagtgaggattcaaaggacatacctctctatccagtcaagaaatgagatcttagtttgaaaaaggagatggaatacttttcatgtgaagaaggaataaaggaaggaaggaagaagggagggaaagacagaggaaggatgaatgatgatacaacagtgtttgtgtgtggttttaactgatagacaagagacatttcctaatggccttgtttaatgactctaaatgaccttgtccctccttcattgagaagctgatttgattctccctatgtggtaaggcactatttaaaaattagttcaaacaactccaataaacatggatttgttaaaaaataaaaataagattttaaaaaacaaagaaatgttgagatgcaaacttacctaggttcaatggaatgttttcaaaacttttaataaagtaggaagtggaagacaattcttataatttaagatacaagagtggcttggaaactaaaaatattgaaaatatttgaaatatttattctgtgaaattcaacagtcagttagaataaagacctattctgctctgtattcaaggtgaaacactgcatacttttctctccaaagtgaaattgggtatttataatttcacttgccttgataagtttccaagtcacagattcctgctgatgtttttactgtattgctgcacaattttaagataatttttgtatcaatgtcaacttttttcactaactaaaaatttagctgggtcaaggaaataaaaaatgagttaaagagttgccaagaggtattgacacactcacatgcatacatgtatataaatgtacacattcattatacgtgtgtgtaactttgtgagtgtatgtgtgtgagtgtgtgggggggggcgggggagtggtgtatgaagtgtcctcacaaaggagggacaatagtagtcatccagcctagttgcaagcaataaagggattcatcatttgtagagaattttcaaacagcaataagaccaaataaaagtaattctgctttttgttaccaagtggtacctattctacacaaaacagtaataacatactcctcctagaaaaaaaaaatgttagtctaattttcaaacatgatctgtggttacagttacattttagtgtgtacatatatatgtatataagcacattgtattttcttattttgtaacagctttatagagatataattcacatagcatacaattcacccatttaaagtgtataattcaatgatttttggcatttactacattattatttttttaaaactttgtagtagaaacatatataacataaaatttgtcatttaacaattttaagtgcacaatttagtggcattaattagatgactatcatttcatctcattatttcagttacttttataaataaagctgcaaatcaatatcctcatatataatttgtgcaagtgtttgcaaagaatagaaagctctcacctggaagggctagtgataaggatgaagagtgataaagagaagaatgggatactcctagagaagagcaaccccaagacacataattgtcagattcaccaaggttgaaatgaaggaaaaaatgttaagggcagccagagagaaaggttgggttacccacaaagggaagcctgtcagactaacagcagatctctcggcagaaaccctacaagccagaagagagtgggggccaatattcacattcttaaaaagaattttcaacccagaatttcatatccagccaaatcaagcttcataagtgaaggagaaataaaatactttacatacaagcaaatgctgagagattttgtcatcaccaggcctgccttacaagagctcctgaaggaagcactaaacatggaatggaacaactggtaccatgccaaattgtaaagaccatcgatgctacaaagaaactgcatcaactaacaagcaaaataaacagctaacatcataatgacaggatcaaattcacacataacaatattaaccttaaacgtaagtgggctaaatgccccaattaaaagacacagactggcaaactggatagtcaagacccatcagtgtgctgtattcaggagacccatctcatgtgcagacacacatagactcaaaataaagggatggaggaagatctaccaagcaaatggaaagcaaaaaaagcaggggttgcaatcctagtctctgttaaaacagactttaaaccaacaaagatcaaaaatggcaaggaaagccattacataatggtaaaggcatcaattcaacaagaagagctaattatcctaaagatatatgcaaccaatactgcggcacccagattcataaagcaagtccttagagacctacaaagagacttagactcccacacaataataatgggagactttaacacagcgctgtcaatattagacagatgaacgagacagaaggttatcaaggatatccaggacttgaactcagctctgcaccaagctgacctaatagacatctacagaactctccaccccaaatcaacagaatatacatttttctcagcaccacaccgcccttattccaaaattgaccacatagttggaagtaaagctctcctcagcaaatgtaaaagaacagaaatcacaacaaactgtctctcagaccacagtgcaatcaaattagaactcaggattaagaaactcactcaaaaccacacaactgcatggaaactgaaccacctgctcctgaatgactactgggtacataacgaaatgaaggcagaaaaaaagatgttcttcgaaaccaatgagaacaaagacagaatgtactagaatctctgggacacatttaaagcagtgtgtgcagggacatttatagcactaaatgcacacaagaggaagcagaaagatctaaaatcgacaccctaacatcacaattaaaagaactagagaagcaagagcaaacaaattcaaaagctaccagaaggcaagaaataactaagatcagagcggaactgagagagacagagacacaaaaatcccttaaaaaaacaatgaatccaggagctagttttttgaagagatcaacaaaattgatagaccactagcaagattaataaggaagaaaagacagaagaatcaaatagacacaataaaaaatgataaaggggatatcaccaccgatcccacagaaatacaaactaccatcagagaatagtataaacacctctatgtaaataaactagaaaatctagaagaaacagataaattcctggacacatacacccttccaagactaaaccaggaagaagttgaatccctgaatagaccaataacaggctctgaaattgaggcaataattaatagcctaccaaccaaaaaaagtccaggaccagacggattcacagctgcattctactagaggtaaaaacaggagctggtaccattccttctgaaactattccaatctacagaaaaagaaagaatcctccctaactcatcttatgaggccagcatcatcctgatactaaagcctgacagacacacaacaaaaaaagagaattttagactaataaccctgatgaacaacaaagcgaaaatcctcaataaaatactgacaaactgtatccaacagcacatcaaaaagcttatccactttatcaagtcggtttcatccctgggatgcaaggttggttcgacatacgtgaatcaataaacgtaatccatcatataaagagaaccaatgacaaaaaccatatgattatctcaatagatggagaaaaggcctttggcaaaactcaacagcccttcatgataaaaactctcaataaactaggtattgatgggacgcatctcaaaataattagagctatttatgacaaacccacagccagtatcatagtgaatgggcaaaaactggaagcattccctttgaaatccagcataagacaaggatgccctctctcaccattcctattcaacacagtgttggaagttctggccagggcaatcaggcaagagaaagaaataaagtgtattcccttaggaaaagagaaagtcaaattgtccctgtttgcagatgacaaggctgtgtatttagaaaaccccatcgtctcagccaaaaatctccataagctgataagcaacttcagtaaagtctcaggatacaaaatcaatgtgcaaaaatcacaagcattcctatacaccaaaaacagataaacagagaaccaaatcatgagtgaactcccattcaccattgctacaaagagaataaaatatctaggaatccaacttacaagggatgtgaaagatctcttcaaggagaactacaaaccaatgctcaatgaaataaaaaaggacacaaacaaatggaagaacattacatgctcacgtatatgaagaatcaatatcgtgcaaatgaccatactgccctaggtaacttacagattcaatgccgttcccatcaagctaccaatgactttcttaacagaattggaaaaaactactttaaagttcatatggaaccaaaaaagagcccgcatagccaagagaatcctaagcaaaaagaacaaagctggaggcatcatgctacctgacttcaaactgtactacgagactacagtaaccaaaaaagcatggtactggtaacaaaacagatatatagaccaatggaacaggacagaggccgcataaataacaccacacatctacaaccatctggtctttgacaaacctacaaaaacaagaaatggggaaaggattccctatttaataaacagtgctgggaaaactggctagccatatgtagaaagctgaaactggatcccttccgtacaccttatacaaaaattaattcaagatggattaaagacttaaatgttagacctaaaaccataaaaaccctaaaagaaaacctaggcaataccattcaggatataggcatgtgcaaacacttcttgactcaaacagcaaaagcaatggcaacaaaagccaaaatagactaatgggatctaattaaagaatttctgcacggcaaaagaaactaccatcagagtgaacaggcaacctacagaatgggagaaaatttttgcaatatactcatctgacaaagagctaatatccagaatctacaaagaacttaaaaacagcagccccatcacaaagtgggcaaaggatatgaacagacacttctcaaaagaagacatttatgcagtgaacagacacatgaaaaaatgctcatcatcactggtcatcagagaaatgcaaatcaaaaccacagtgaaatagcatctcatgccagttagaatggcaatgattaaaaaggcacaaaacaacagatgctggagaggatgtggagaaacaggaacacttttacactgttggtgggactgtaaactagttcaaccattgtggaagacagtgtggcaattcctcaagcatctagaactacaaattccatttgacccagcaattccattactgggtacatacccaaaggattataaatcattctactataaagacacatgcactcgtatgtttattgtggcactgttcacaatagcaaagacttggaaccaacccaaatgtccatcgatgatagactggataaagaaaatgtggcacatatataccatggaatattatgcaaccataaaaaaggatgagttcatgtcctttgcagggacatggatgaagctggaaaccacgattctcatcaaactatcacaaggacagaaaaccaaataccgcatgttctcactcataggtgggaactgaacagtgacaacacttggacacagggaggggaacatcacacaccggggcctttcaggggtggaggcctgagggagggatagcattaggagatatacctaatgtaaatgatgagtttatgggtgcagcaaaccaacacggcacatgtacacctatgtaacctgcacattgtgcacaagtatcctaaaacttaaagtgtaatttaaaaagcaggggagctgaaaatccttggcatttctcaatgaggaattccagaaagataagaacattaccaatcttagggtaggaagattctctagtgctagaatagaatgcccaactacccttaccatccaccttattcaaaacaaagaaaatgacaatctacttactttgttttttgtttaaattttcttttcttaccctttttatgattgccctaacaatagctatccaatgctacatcagtcagaaaattatttgtatttttttatttttaaacccgatctccactacaacgtattttaaatatgttggttttctttaacatttcacaataaataaccctcacatttctaacttttaatgaaaaatcaatgatatataaaggctgttatatttttaaaacatttctatttttgaatctgttgctttacataattttgtttaatcaactggcttcttcgaaaagcacatgaaccctaagaaataaaatgtgtatagattctgagaccacaaaactcacaagtgttttgtaataccacagtagagctaacccgtacggtgcaacaactctcactgaagcactttgaggtagagagaccttgattcattacttttaaaatgagaatactactacagagaaattgtataaagcttttccatcttggtttctgattaaaggatcaaaatgtcaaagctaataataatgatgaatgttaatttacccattaaatgtaaaacctgtttttaaaaaataatcataagactcaacaaaaattaccactttccatagaattgatgatcacttaatatatgaatttattctctgttactgtacctttgactccatccccattaacctgtttcttgatttatttcctcatctttaacataagatttggttacataatcattaggatcccttccagctcaataattctatgacagtgcttctttcagtctgtattttctctgtatttcttatacaaatagtttactttcctttgaaggtacagaaagaaaacaggtttggagatcagaaaaacctcaccttaaattatgttctgccacacactaaatacaaatctttaaatatgctatttatactttctgaaatcagctctttcattcctaaaaggaagatgaaaacaaaacttacttctattttcaatgccatgaaaatgctttgaatgttcattcaatatttcaaatatatagagagggcatttactaagtaccaggcatcaaatataagagatgatagatagatatagacagatagatcaatagatagataaaagatattcaagggatgatagatagatagatagatagatagatagatagatagatagatagatagatgatagatgatagatagtagagataatagatatttgatagatggatagatacagttcatagatagatgatagagcagagtctagaatatggaatgcaaagtatgaaattcttccttctccactcttcacttttccccccaaccatgcttagtaactttcattactaattccctatcctaagcagtttcgtatttttcaatagcaacaagtcatgttgctttatgtataccagactgagcatgctgaaaatgacgagacacagcaatgctaaggaggaagcttctaccccttgggaaactgagcatcatgaggccgaagcatactggttgttttttgggtatttttttgtagctcaatcaaatttcagtaagacatatagtttataaatgtttgtttatggatatttgttatgcagcacaagatgatatacactcagcaattcacaatggtgtaaagggcagttacacttactgctgtgttcataatcgatactaaattgatacagacaaatataatgcttttttctgtttccaagtttgaaccagctattgaatcatttatactttttccttgctggaaaattagatattcttcatattgaggatttttagaatatttgagaaaggaaaattattcagtttgccatgtgtgataacctacactgtaattcaagcaaatttacttctcaggatataaaatttcaaggcattcagataggaatattatctcagctgtttgtgggattttcatatctgtttctaatttaatgtgtgtttcgtactagagatgaagtatgattctcttgctgttatttttaatctttacaaactaaagcctccctttcaaatcaggctgttgcaatttttcctttcatagcattaaaaagtttctaacttatggtcatacagcatattaagcaaacaaaaataccaaacactcaaaattgtaagtcacgtgaatttaattatgaacacatattgactgctgtacgaaaactctaaatgtagttttatgatttgcaacaattgttctaagtaacaccagtattacaatacgtaatatcttagattcctcatatttttctttgtctccaagaaagagtgcatgaaattgatcacaaactggtaaactagaaaaatcttcagaaaatatttccacttttcttagcaatctgtttgaataattagcaagtcttatgatcagactgatttttttttcatttaatgaaacaaaagtcactcttagagattgctacccctctcctgtggtaaatgaggatatttagatatttttgacaaatacgtaagtgggaaggtggctggccttatggttaatttcacatactctgaaatgcctgttatccagaaaacattcctttcatccacttaaaaatctcagataaagctactgtgtaacttcaaacagacacatattaatataaaatatttatatgttaaattagcagacttctttatgtatttattcactctaaattatttaatgcctgcataatttagatattgttctttactcattaccataataacacataatcactgattggataaataggtctcaatttttataaaaagatagtaagaaatggtgcatgtggcatctgaaaatttacatgggaacaagaggaaagcagcaatgtctgaaaaattattttaaaagcacaagacattgaaaataaagtgtaagtaaaatcagttgaaaaatggggaatgataggtgtaaatgggtaaaaagtttcagaggagtcttttctgtgggtttccatcttacaattgtgattctttagtcctttaccaatgcctgggtttgactgtttgtgttaatactaccatgtcgtcaaccctatcaaggaaaccacctttttctctcccttcacacacactgctttttgaatgtctatcagtcgcttttctcctttctctttaacatttcactatagataaatgtgcatccaaataatttgtgctgtcaaggaagagggaagaacacaaaaatacagatgaatcggctctgattcaaatttttcatttcattatatcatgttgctagaatttaagaatattcctgtgaagatatgttagctagttctcaccttactatcaattccagtttcagagagatagtaatagccctagatattcatatcatgactagataaccactttttatttttccatccacagaaggtaaatatctcaaaacaatttactttcatccaagtatttggtttgcatgttcaaagctcccaaacttctgacacacacagccttcttgcagaagctatggccatgtaaaataactatacatgactgtaaaataatagttttcaatcactggtattcattaaagaatttacattaataaactgccttctgagatcccaagatgggcataacattacggtgcatgctacatggcctctccccttctcgagactatgaaggtcattttacaagaaccaaacacaaacccttcctttggtcatttttgctcaagtcaaaccctaactacactgcatttaagatgtttatttgtgagatgaagcatgtcccagcaattcataaaacatgaaagctctgcccaaacagtaagtgttgcatgttgtggtaaaagcattcttaaatcattctgagtgttactttccactaacgaaccctgtgaaaattggaattaccaacattccaggatcttgctcctgctttatgaatgaagataacaggtggttcagaaaagaaatagatacagcaaagaatgctgcaaagctaagttgtgaaggttcctatgattatctagaaggctcatttcaatttataataaagggaagagtcttaagcaatgaatggtttcttcattgatacagagttcattaagaggagaataagggattaacttttgatattctcagttcccaataataataccttagggtgttgtttgttaccttgacggaaagttaaattctgcaaccctaaaataatatcgttactatccttttaacccttttaaattcccttaaatgatgaccttcttgcttgtatattgttgtgtcaacagatattacaaacaagaatataagaccatttcaaaatttacgaaattctccctaattattcttggtttctagatgttactaaaaaaagaaaaaaaaaagaaaactagctttttgggggtaacaaattaggtataaaatgtattttatgtacattctatataacaaaatatgtgtgtgtatgtgtgtgtgtagtgtgtgtgtgtataatattgttatgcaacccatgactatgtgaacacatgtgtgcttgtttatatttatacagtctacctacatatacctatagatatatatacatatctatatttatacagacattttggtcgaccacagactgcatatacgactggttccatgagattttaatggagctgaaaaattcctattgcctggtggcatcttagctgttgtaacatcttagcacagcacattacccatgtgtttgtggcgatgctggtgtaaacaagcccaccctactgccagtcacataaaagtatagcacatacaattatctatagtacataatatttgataataataaatgactatattactgatttgagtgcttaatacactatactttttattgttattttagagtgtactccttcaattttttttaaagttaatccttcaggagttattccagaagagggcattgttattataaaaggtgacagcttcctgtatgttcttgcccctgaagaccttccagtgggacaggatgtagagatggaaggcagtgatattgatgatcctgattttgtctaggtctaggctaatgtgcatgttttacatttttaaatgttacttataaaaattagttttacatttaaaaaatgtaaaactaaaaaatattaatagaaaaaatttcattgaataaggatataaaggaaatattttgtacaactatacaatgtgttttaagcttagcattgttacaaaagggtcaaaaagtttaaaaactttaaacaggtataaagttaaaaagttagagtaagctatggttattattgaagaaaaaatatttttataaatttagtttagcctaagtttatagtatttatgaagtctacagtagtgtacaataatgtcctaggctttcacattcattcattactcattcacctattcacccagagcaattaccagtcctgcaaatctccattaataataagtgccctacacaggtgtaccattttttattgtacctttactatgttgagacatatttagatgcaaaaatacttaccattgcgttacaattgcctacagtattcaatatagtcacatgctatgcagttttgcaggctaggagcaatagcctaggtaggctatagtatctaggtttgtgtaagtatactcatgacgttcatacaacgattaaattgcctaatgacatatttctcagaacctattcccaccactaagcaatgcaggactatgtctttttttttgtatgtgtatttatttatttgttgtttatatatttattatactttaagttctagggtacatgtgcacaacgtgatcatgctgctataaagacacatgcacacgtacgtttattgctgcactactcacaacagcaaagacttggaaccaacccaaatgtccaacaatgatagactggattaagaaaatgtggcacatacacaccatggaatactatgctgagaatgatggtttccagcttcatccatgttcctacaaaggacatgaactcatcattttttatggctgcaaactatcgcaaggacaaaaaaacaaacaccgcatgttctcactcataggtgggaattgaacaatgggaacacttggacacaggaaggggaacatcacacaccagtactatatctatttaaaatacctgtaaaccactttcaaaattaatagcttttaacatatatatccttctttaagtattgctatgaacattgcaaagtttcacagaactgacaaaatgaatgcagttcaaaagctttcatgtccacgtgacaaatggcatgcagcatttttactgaggtatttggaacctgaagctaatgattaatcctgcaaagaatttcttggaatgtaggctggaatagtctaaattttggacccattcccccaaattttaattaccttaggaaaatggaaaaggaaatgctgtcatttgtttgtttaacttggctagaatttttttgtaatcactttcctcaataagttattattttttaagcaaatacaaatgatatgcttttagagccaacccaaaagtagcactcaatagaggaacatacttttgaatttattttaatcagtggataaatgttttataaaaatcatgctgatttgaactctgtatcaatagcataccactgactattacaccctatctacagatctcaaagcataaattcaccaacctcaaaagacagggcctactttcttgcctcaagatatcagactagcacaggggattctgtaaaattttaattttgtaaattttccatgttggaaattccataaactctcttgggagcctaattccctttgcaactcagttctgtcttttgtatgacatctacttctcatactggagaattactatagaaatctcttgctctagtctcctcgaaataattatttatcacctaaggtcttgtattaacagcttcatcttcactaattttatatatcccactaattttatatatccctaaacttgtaactttttctcagaggttttattttccattcttttgattatgttcacttactttcatctgaaaagagtgccgattctctaatttgtattttaaaaggctaatatctacatgtctcaaattgataagcggatgttgggtattatatggcacaagctaaatcatgtattgtttctctttacaatgatttgcttagaatcatggagacatcacacttcacttctcccccagaaagtaacctatttttctcagaattatgtaacctagatcagtacaaggcagctcaaagaattttctgaatggaatgccagagttgagttttaaagagaaaattaagttatggtgtagatgactggcgtaaaactcagattctcctaactgagaagtaaactattggtgggcacaaagattttctctaatccacagggattcttcgcagcaatcagctagtagtatgtagattacttatatgaagcatcctacagaatatttatggtaaaacaaaatattgtcctgtaatatttagtgctaaggcagacctcttctagagcccttggatgaagaaatttgcatttattctattaagaggcagcaagcaccgtggtaataaacaggcttcagcatcagtatgtctgggtttgggaaagaactctttcatttattggttgtgagtaaaaagacatcttacaggcagacctcaaatattgcaggtttggttctagaccacaacaataaagcaagtatcacaataaagttagtcataagatattttcggtttcctcatgcatataaaaattatatttacactagtctattaaatgtgcaagagcattatgtctaaaaaacaatgcatacactttaattggaaaaattctttgttgctaaaaaatgctaaccatcatctgagtcattagggagtcatcaacttgttgctggtggagggttttgcctccatttgatggcagccaactaatcagagtggaagttgctgaaggttggattggctgtggcaatttcttaaaatgagacaacaatgaagtctgccacagcacttcattcttcctttcacaaaatatttctctacagcatatggtgctgtttcacagcattttaccctcagaagaacttctttcaaaattgaaatcaatcttctcaaaccttgctgctgctttatcaactaagtttatgtaatattctacatattttgttaccatttcaacaaggttctcagcatctttcccagtagtagattctatttccaaaacccactttattttctcatccatatgaagcagctcctcatccgctcaagttttatcatgagattacagcaatttagctacatcttcagattctacttctaactctacttctcttattttgaccacatctgtggttactttctccactgaaattctgaacccttgaaagtcatccatgaaggttggaatcaacttcttccaaattcctgtcaaagttgacattttgacctttatccatgaatcacaaacgttattaatagcatttagaatgttaagtcctttccagaagattttctatttacttttccagatccattagagcaatcactatctatggcagctacagccttacaaaatatatttcttaagtaagaagacttcaaaatcaaaataactcatgcatccacaggctgcagaatggatattgcattagcaggcatggaaacattaatctccttgtacatcttcttcagagctctttggtgactaggtcaatgggaagtaatattttgaaagagatctttttaaaatttaatttttttgagaaagtgtctcattctgtcaccctagctggagtgcacgggcatgatcatgcctcactgcagcctcaacaatctgaactcaagcaatccttctacttcagcctcccaagtagctgggactacaggtgcacaccaccatgcctgactaaattattattttttttgtagagatcgggtctcactttgtttcctatgttgctctcaaactcctgggttcaagtgattctcccagtttggtctcccaaagtgctgggaatacaggcatgagacactgtgcccatccaggatcttttttttctgagcagtaggtcttaatagggggcttaaaatattcagcaaatcataccataaacagacatgctgtcatacaagctttattgttccatttataaagcactggcagagtaaatttagcataattgttaagggccttaggatttttggaatggtaaatgagctttggctttaagtcaccagctgcattatcccctaacaagagagtcagcctgtcctttgaaactttgaagccaggctagctctccagctctctagctttcatagttctctagctatgaaagtcctagatggcatcttcttccagtagaaggctgttttgtttccattgaaaatctattgtttattttaacaacattcatcaaaaatagcttgatcttctagataacttgctgcagcttctccatcagcacttgctgcttcaaccttgcacttttatgttacggagatggcttctttacttaaatctcatgtaccaacatcggctagcttcaaacttttcttccaaaactttcccactgctttcatccctcatagaatttaaaagcattaaggccttgctctggatttgactttgggtagagagaatgtcatagcttctatccagactacccgacgttttctacctcagcaataagacagtttcactttctttttgttgtgtattcactggagtagcactttcaatttccttcaaggacttttcctttgaattcacaactcggcttactggtgcaggcagcctagattctggcctatcatagctttcaacttgccttcctcactaagctaaatcatttacagcttttgatttaaaatgagaaatgtgtaattcatcctatcaatgaagcacctagaggatattttagggttattaattagcctattttcagtattgttgtgtctcagaaaatagggaagcctgaggagagggagatgggggaatggctggttagtggagcagtcagtgcacacacgactcttaattaagttcactgtcttatgtgggtgcagttcatggtgctctaaaacaattacaccagtaacatcaaagaccactgatcacagatcaccataacaggtgtcataatgaaaaagttggaaatatggcaaggattgctaaaattttacaaggacacacaaagtgaacacatcctgttggggaattggcactgatagacttgctggatgcaaggtgaccacaaaacttcaattagtaaaaacacaatatctgtgaagtacattaaagtgcagtgcaataaaatgtactacattttgtccagtctcagtctcctcctctgttcaatagagataattataattcttcataaggttggtgtaagattaagagggaaatatacagaaagtgtttagcataatatctgaaatttaccagcaccatataaagattttgctattatacttttatatttacaatatcatcattgtttaactttgtgcaacagtggagagcttgttcgccaataattcacgtacctaaaaccagaatttaataatctgagaaactatagaaattattttaaagaaaacaaaaagagacatatttaaaaatcaaattacatattatggttgatggccatctgtgtagcttgttcataatattagtttatggagaagaatgaatacttttttagctgtgctttgaaatctgaggtagattatcaaaatcaagatcagagtcagctttcaagttgccactgcttgactgtgtactctcagtttgaggcaagattccttgcattattcttctggtatttgttggctgcttatcattttgcctccttgtcaaaattcagtgttggctgcagtaaagcaaccgcgtttgtttcttctggcaaaaagaagtggcaggggagtgactgggaacgttgtttatagaatagcttggcatcagtgaacatttttgatctttaggtttttatcccaataaaaaccataagggaagttgcacatagtaagaatgatttatttactttattgttaaattggaatagtaacacaatttttaaaagacacagtgcgactgacacgctttaaaggctgtgtgactaacacgcctttaggtacgttaatatccaacactggatggttcgtttggctttttcttcctaaataaatatgccaggtatgaaaattaaatgggcaattgatttaaaatgtgaaagcactggtccatgtaaatgtatgtcatgtcaacatattaaaattattgatcatttaagtttttatatagggattgtatagactgactagttatatgaataaatgtgtcacttattagttggcaccaactcagggtcacaggaagaagtctaacatttccaacagtacataccctgttccactacaccatatataatccttaaaaggaaaaataaacaaaacatttctagacatgtgcagcacaagttttattataaacatccgaattttttgtatctgaggtgatttgtttccatagattttgtaatgctttgaaagagaatttactttctctttaagaaacttaaacacacaagtgtatgcgtatgcacacacacacatagcacaacagcttcttagtttgatagattctttagtttctttatttagaaacatacaatgtacccaagtaatagcagagagttctatgcataggtacatatcaattacattttccttatatttggttgttgttagagttgtgatcatgatggtgcgggtgctggtggggatttctaagtgaattgctttcaacctcacatctgagtacatgaaggtttaattataaagggtctcaaatatttagcaagtatctataacactcaaattatggctgacttaatacaaaataaacaagatgattttttctaaataacatttatttaaaatatttaccctgagatgtatacaacagaatcaaccaatcagcaaaaatgcagctctagaacataaaatgtctctcatgttacttgatatttaatttggggcattttccatcttttatatattacaaaattttgacactttatttttaaaacttttccttttggctactttttagtggtataatcaacagcatttccccaaaaaaacttgcccctgaaattgttatctatttaactccaatattacttgaagaggcttaaatgagaccacattttacctgcagccagtgcattcttctaaggaaagacaagatactaggagctcagtattctcccctacacattattctattatgattacacattaataattcccaaaatatcaaaccaggaggtagaccacatgagtttggggactagttttgctagcatctgttcccacagcaaaattcattttgcttcattttgcctcagttccctgacctatgaaatgttcagaagaatggacagttactctctattaaattattatgtatgaaagaataaaataatttttagctgtggtcacacagcataactggtattatgctgatgaaaacagtatttttgtttttaatgtaactgagtttgatgtacttttccatcattcaatatagatacttaaaaggcaatgagccccatcataggcatggttcaaacatactgcaatcgctgttcaaaataagcttgtgcttcacaaagcatgctcactaacagtacatgacttcacaattcagtgaggtgcagagggtggatttcgttacagctgtggtacacttgtcaaaaattatagattaaatgacttgtccagggtaataagactcagagtctggactcagacccaggtcttctaactctaaaagcaagttgcatcatggtacacctgcatgtgcagaggccatgttccacgtacattcacatattacttgtgatttttaaaatttgtaattgttttctttgaagtcaatctaaaatattttaaggttaacttattttaagattttaaattacatcagtaacatcaaagaccactgaccacagatcaccataacaggtgtcataataatgaagtggcaggggatttaagattttaaatcttaaaatcatttagaagtaagtatacatttttattttgggtatatgaaagtccaccattatatagtacagtttaatacttaaactttccttgcataaacgatgacaagtcctagagaaacttgtaaacctagtgtgtgtgtcactctgtaatagagtctagcactgatagaatgaattaatttcccctatatactatatttatatacagaaaaatcttctgcaacacttatttaataaaggaattcttactataaaagagatttcacttatattggtatcacataatgaatgcccccttctacgttaataaagccctcaaataaactctcattaattaaattatccttggttttacaagtatggaggttattgaaaaacccctatacttgtgaaatcaaagataattctactaggtaatcacaaagttgtgcttttattaatcacttctataagtcactgatattaaccatgaatatcatcttcagttattagaaaagaattagtcccgtatacatctctaggtaaagcacagttttgtaaagaatgatctatgtaagtaaaccagcttaacataaaaattacttcacaatgaaaacgttaattttaattttctaatttattaaaaagaagactacccagaaaatgattttttcctgtggtaaaatatatttaacataaaattaaccatatgtatcatttcgagtgtacaatttaatggcattcattatatttacactgttatatcaccatcacctctctagttccaaaccattttttactgtcccaaacaagaacttgtaatcattaagcaataactccccattcacccctccctccacccccagtaaccttgaatctactttgatatctatgaatttgtctattttagatacttcatataagtggaatcatacgcatttatcttttggtaccttgtcacctagaatttttatttatttgtttttgagacggagtctcaccttgttgcccaggctggaatacagtggtgtgatctcagctcactgcaacctttgcctcctgggttcaagtgattcttctgcctcagcctccagagtagctgggattacaggcgtctgccaccacaaccagctaattttttgtatttttagtagagacggggtttcaccgtgttagccaggatggtcttgatctcctgacctcatgatctgcctgattcggcctcccaaagtgctgggattgcaggagtgagccaccgtgcccagcccagcataatgtttttaagtttcatccatgtatcagaacttcattccttcttatggctaaataatattccaacacatgaatatacaaattttgtttatccactcatctgttgatggacactggattgtttccatattttaggctgttgtgaataatgatgcaatgaacactggcatacaagtattttgtttcatttcttttgggtttattcctaggagtgtgattgctgaaattgttaggtcgtatagtaattccatcatcagccttgcaccaatttacattcccaggagcaatgtacacatattccaccatcgtaatggtatttcattctgcttttttatttggtttccctaatgaataatgatattgagtatctttgtaaggtgcttattaaccatttgtatttttttgaaaaaacattctagcaccttgacaattttttaattgggctgttctgttgatactgagtcgtagctattctttatacattctagatattaaaacattatcagatattagatttacagtattttcttccactccataggttgcctttttagtttcttaataatgtctttgatgcagaaacatttttaattttggtaaatttttattactttttcttttctgtgcctttaatgttacatttaagaattaccaaactcaaattcaagaagatattcccctatatttttttctaagagatttatagttttagctgttacatttaggtcgttgatccattttgagttaattttttgtttaccgtatgagatgaatgttcaacatcatacttttgagtatggaaatctcgtttccccagcaatgtctgttgaagatacttctttttcctttgaatggactaagcattcttgtcaaaaatcaattgaccataaatgtcagggtttatgtctgaactcaattgtattccattagtctgtaacatatgccaatatcacactgttttgattattttagctttgttgtatgctttgcagtgatgaagtgtgagttctccaattttattcctctttttcaaaattattttggccatttgtggacccatctgaatttcaggatcagattttctatttcttcaaaaatcaaaaaaggttttttgataagaagtgcattgaacctatagatcactttgagtagtactgacatctttgcagtattaagtgttcctgtcaggagcacaagttttcttttaacttgtatatatcttctttaattttcacgatgttttatagtttttagtatacagtgtttcacctccttggttaaactttttctaaatattttattctttgtgacactattgttttcttaattttctttttgtattgttcattggtagtatatacaaatacaattcattcaatgtagtaaggcataaaaatagaacaaagaaaaaattcacatgatcatctcaaataacacagaaaaggcattttacaaattaaacaagcttttataagtaaaaacactcaaaaaagtagaaataggaatttcttgaatatgaaagagggcatttatgaatttcccactttcatcacgtttattcaacattgtgctggaagttctatcgaaggcaactaggtaagaaaaaggaataaaaggtattcaaatagaagaggcagaagtaaaactctattttcagataacatgatcctatgcatagaaagtcctaaaacatccacaagaaatcttactaaagctaaaaaatgaattcagcagtgttagggtacaagatcaacatacaaaactccatgatgtctctatacacttgtaatgaatgccatgagaagaaaattaagatttttatttgtatgcaagacttgttttatacactcaaattttgaatagtttccaatttttccaagattcataatctcagaacttctctaaataatttattttagattttcctcatcagtcttatcttctaaaatttaattcaccaattcttataaaatgaagtgtattttttatcatacaagaaaaatgataaagttaaaagactcctattttaaataccggcctttcgaagcttatttacataatgggaaaatattgttatattttaaataatccttaccatgcaggactggttttattgctctaacttggagttctgtaattctggctggtcagaaccccaaggcatcctaacaatgtcagaaacgagtctcctgatccatttttgttgaaataagattggaatttcctatgaaaactgctggtcattttaagtaaggccactgcggaggaatcaaaataattttgtaatcttttttttagttctgattatggttagacacaattcataataatgaacacgttttaaataaaaacgtagttcttacttgaaagttctaatattcttaaacctcattgctttataaaatttgtccaggtgatcatctcttattcagcattcccacagcttctactcctgcccttttccctccatagttccaaactaattttatgcaaatacatgtgttagatttatttttaggaattgttcaacatgaaagcaaataataaattcagttaacaaaatggtaggtatgtgtttgggaatatgaaagatgcaaagatggcgcaatacttttagtcaaaacttttttcaatgttatataaacagtagtattctttaccaaaaatgtacaattcttctacactgaaaattgcaaagcattgctgagagtaaacaaagaagacctaaataagtggcgagatgtaacatgctcatgttctaaaagactcaatattgtcaaaaagttaatttgtcctaaattaatctgtacattcagtggaattcaagtcataatctcctttgactttagtagaaattaacaagcacattctaaaattaataaagaaatgcaaaggatctagaatagccaaaacaatttgcaaaaataattcgcttggagaagttacactaactgactttgtgaaagagacagccattaagattgtgtgatactggtatcaagacagacatgtggatgaaaggaacagaattaagtgcacagaacctgtatttatatggtcaattgatttgtaatgaagctacaatgggaatttagtgaataaaaatagtattttcaacaaatggtgctggaacaattgggtatagatataaactttaatccataccttgaattatgggcaaaaattaactcaaaatctaccacagacctaaatttaaaacccaaaactacaaaactcccagaggaaaacataggacaaaatctttgtgaccttgggttaggcaaagacttcttagatatggaaaacaataaacaaacaccaaaacagacaaaaaaattaaaaataaacttcatcggctgggcatggtgtctcatgcctgtaattccagcactttgggaggccaaggcgggtggatcacttgaggtcaggagttcgagaccagcctggccaacatggtgaaaccccgtctctactaaaaatacaaaaattagccgggcatggtggcagaagctagtagttccagctatttgggaggctgaggcaggaaaatcactttaacctgggagccagaggctgcagtgagccgagatcgtgccattgcactccagccagggtgacagaacaagactctgtctcaaaaaaaaaaataaaaaataaaaaataaaaaaataaaaacttcatcaaaattaagaaattttgtctttgaagtacaggccaagatgctgaaactgtccttgatgatggtgatattatcatgtggcatacatataaaaagaatacattatcaaattttacacttaaacatgtacatttaaatttgttttgatcaacgaatttctctaactgtgcactttaaatagctacactttaaatagccaattatacatgtttttaaacctatttcccatcttctcaaatcgcaaaccacattttgaaaaaaatgttattttcttaagaataataaacaattttatatgttaggaagcttaaatacattcaacatatatttatttaacacctatgatataccagatgtgattctaggttctggggatgcatcagtgaacaaaattaataatgtttccctcttttggagcttaactctgataggttagattgacaataaagaaagaaaaacatataatacaatgccaggtagcagtaactgctatgaaagcaatagcgcaaggaggtaaaggtgatgagaatgaggctgctatattttagggagagagatcaaagaaagactccatgaagagaggatattttagcagagataaccaatgaagttcccacttcattggagcagagaatacaaaataagacatagaggagagcctgccaggcagaacaatccccaaatacaaaatcctgaggcaagaaagttttttgtattagaggaagagcgaggggtcaacgtggatgaagcaagtaatcagaggagaaaattgtgaggaaatcagggcagactaatagtcatagcctgattacacaggctttgctgactctgtgatttttttttctatatatgatctgacaccagtggaatactataagcaggaaagttacaggagttatagttgtatgtatcgaaaaatgttctggcagaagtgttgagaacagactatacaaagacagtagaagccaatcaatggtggtggccaggactcctgtggctgtacaaggggtgggggtgtgggaatagtggtatggtttggggcatatttgcaaggcagagccaatacaatgcacggcagattgaatgtgaaatatgagaaggtaaaaaatcacttcaaggcttggaaccgagtcactattgagttgagctgccattttctgaaatgagaacataggggaaaaacagttttggagatggaaatcaagaatttggctttgcacctatcaatttgagataactattaaacatccagttggagatgttgaataaacggtgggaaataaaaccctagggttctggggaaagatcagagctataaatataatttgggagtcatttgcccatgaagggtatttaaagccacaggaccagatgagttcaagtcattaatgaaagttgatagagaaggccaaagactagattctgaaatgtatccaaattgctcacattcaagaggaatacactttctcaatgtgtctgttatacataattttcattctgttttacttcattatggcatagccataaaagtaaagtgacaattagaagggctattggataggtcatggaactcagccatgtaactctgggtctgttggtaaccagatccatagacttgagctatatgatttccccccttgggtttcagttgcattgtctataaattacaataatgaatattgttggctgtttgagcatggggaatgaaagaaaagaggaaaactagcactaaggggttttgagatttgttagttgcctggtgggaaagttactcatttcggaaagatttagctacattgagcatggcctgtgtgatctgtcatgatctgagactcttttgcaactgttcctgaatagcactggcttcttcattctcaccttgctttcacttaattgtactgttctatacgttagtcagtgatggtttggtttcaaaaactagaaactctctgaaaataccttgaaaagaaaacagtatatattgggagttccagagtatcttgcaaaactcagggtacatagtgcttccaggctttctgagggacagaaccaagaatggaaggcttttagtctcatcctggtttcctcttctctaattacacatagtctgccctgactctgccaacatgtgccttgaatctctgaaatatgtaaactccatgtccagtttccacagataattgaccctgtctctatatgtcccaatttcaaattcctgggtgagatatctggattcaatcaatctaccctctatagtgatgttctctaaatcagttgcccactcccggtctagaaacctataaccaaaaatgggttggttcacctagtacctgcttgaaggattctaatactaaggttagaagcttaaggttggaagaacaatgcaatccctaaaaagatccaatatagaaaataaaaataaattactggttctaaattatcatacttatttttaattattcagacccattctcctccgcctaccacttcccacacatacacaaactttcaaatgctgttacaatgaagcagaaaatatgaatatgttgttctgcagcaggaaaaagtagtataaatctacaattctgcagcaggaaaaagtagtataaatctacaattccaattgcctagaatactaaagcatcaatatcctttcaaatatttcggtttgggtacatacttttttgattttttaagtccttcaccaaaactatatgttactatgacattaagacttagtacagctttttgattacatagccttctaagttttaaggctgtgtctgtaagatgcctactcaactgaataaaatatcagcatcaatcaaactatttggtttactgtacagaattttgactatatttaatctttgaaaaattaatcagaattattatcataggtatccaatttcatgaactcttctagtattcattgatgcttctttggaaattttattttctaagccaacatatttatttcttcttggggctctcttgaagtcataaaagtataccgtttcactgaaggtctgagaaacagggctaaaattgactccaagaaacaaacagttttagtatactttatatgcccactgagtctttcaaaccacattagttaatcataagtcactcagaagaacaaggttttaatgaaaaaatattctgggctttttaatttgtctcttgaatattctgaatgaaaaaataaaccttgtggcagcaggacattttgattagaaactagcatttctacaaaactttccacctgggtaatgggtaatggatggacatcttgcctaaattgcattttttttttttttttttcttgagatggagtctcgctccgtcacctaggctggagtgcagtggcgcgatcgcggctcactgcagcctctgccttctgggttcaagtgattgtcctgcctcagcctcctgagtagctgggattacaggcacccatcactgcacctggctaatttttgtcttcagtaaagatggggttcaccatattggccaggctggtctcgaactcctgacctcaggtgattcaactgcttcggcctcccaaagtgctggcattacaggcgtgagccaccgcaactggcccacattttgaaatttattcaaaaccttttagttacttatgtcacatgctttataaataattctttattaaaaaataattctttattaaaactaaaagcctttaatctaagtaaaaagaggataagaaacaatgcttttcttatagatatgtccttctgcagggaaggagttatcccttattaccgaggaaagctgtaaaagatggagatgaataatctgattgttggaagtagggtctaacagctggcataacgtaaacaaactgcaggtattgaaagagtacaggtttccagttcatttccttttttgcaaaatgtctggctccgatattctttaatcagatggactcatgcctgccagagaagtttcttggctgtatttttgcagaagatctgtaggaaatgaattgagaaacttgacaggaacagcttgaggtatttgatgaataatagagaacttccaccgttcaagtgtctgactagaacagaatgagaagtattaggaacttggaaaaaaggaaagattgatttaaaaataatacactgctctaacccactggcaaatacagttctttctaaagcactgtagacagttcacatagtgaaagagatagattaaattagattttcatagacttatttggactgtcttccctgttgttggtaacttgctgcttccttcaacccatcaaaaataaaaatacaaaaggggaaaataaaacctcgtatagaaagtaccagtgttttaagggtatgtttcttacatatgtgaggtgcaattcattttgcattctcaccctatgaaaagtgattcagttaactccttccatacttaaagtttcatatcctgtttactgagaaattaaaaatcttatttaacaaacctgttatagcatagcaaaaatttttaaatgcataggatatttccttctcatttctatgtagaagatacctagcacatacttaaatgatttgacttatattactttcatacaatgttctatatgtggacttcataagcactgaaagaatttttaaattccagcctgctgtcaaaacgaatgaagaagttggccctacaaaacaaaaggaaaataagtttgggctaacttcaccaaactttaattccctcattaataaaatgaagctgtttgctaacttcaccaaactgtaattccctcattaataaaatgaagcggtttgactagatgaactgtaaaacatctttcggctctaatagtctgtgtatctaaattactttttttgaataaaattttcttttaagcatccattgatttttttcacttaagtcatatgtttttctagttttcactaggagtcagagagtatttattatcattcagatgtatccccctggggtaggtatgtgttggcaaggaaaacaaagatttaatacaattcagaacatgtggtacagtgttgtttactattttatttggggggtagaggaggaattttttaattataattttcaaaactatgcttaaattcagtggacactttttagttctaatttgatgtcaactctgagcaactttcaacatgactgcctcctttcttgttaggaaaaaaaatatttttttctgaaaccaacctcatggctttccttctagctattcactacttttcctaatctccattacatgtccataccccattttttgctgttctatcccacaccctcttctctgcttcctctctgaacatctcactaatacccgattactgtctactaacgaatgctcgaatcaatatccccacccaacccaatttcaattttgagagacaaaccagcgtatccaactgcctagtgcctatctcttttggtctcagaaccacaaaacacaatttatgccctatcaatccagaccccagcctgctctttctctcttaactctttgtcagttaattttgccatcaaccttttaatccgtaaatcagtcatcaaagacaccagcttctccttcaacttcacatttaagcaatgattacatacgataaaatttatcttcagaaatatgtctcaaacctttcaggttttgttgttgttgttttccatgtccactgtctacaaccatcatctctgaattgcatcttgttcacagcccttctcctgtgaaaccccattcttcattcctcactctcaatatcaaaatgcagatctgatcatatcactcttaaactcctttagttgtctgccattaatcttaggataaatctgtatttttgacaaaactcacaacgccttcgttatctgaccttcactaaccctcctgcttccctctcccttgtcccacttcaaacttgatattattgctaggctgaatttctttcagttccctaaatacatcattctttcaattttctggaggcttttctgtaggttcttccttctacctagaacatgtattttcctctttttcaattctcagctgagctagtaaatatcctaaaatatgttgagtagtttctataaacaaagtcttattctaaacactatacatgttattaacttgtttgattctcattactttcctattaattatcatcatcactattttccaatgaggagtctgaaaaacagtgacgaaactgcctaagatcagaaaagcagaaattgggaaagtcaacatttgactcttgactccagagccaatgatctagagacgtatgcttaaaagtcattttctgtattaagacttgagctttctctgccccaccactcttaacccagactaagttgtatattcctgacacaaatcctgacattgtgtccactgtttccatgaccaaagcatttgtatttggagtcactgcctttgaactatctttcctgccaaactatatagatctcacaggcaggaattacatttgttaaatgaatgaatgaacaaaagaaaactattaatgctctgcattccatttagcatttgttaaagatttctaggacttcaggcaaatattttatctgtattcctactacttccttttcacaatttgtgtaattagaattatgcatgcatttcctcttaagaacagccaattcataatcatgtgtatacttcgcaagtcaacatattcatctcaatggtcccgaggagttggaaatggtctccagtcctcttttttctgctactcctcagtagcacctggctgtgcttatgcaacactgggcaatgtctatcagaggcagagaatcctctttgcaacaagcagctagtacagctgacattggaagcctgggttttcctttatcttctgtgttgctttctcagcatttgccacaggatgcatttcctcataaaccagtatttttaaaaatacacttgtattcctcagctggcccacaaatgcatatttgtcagaagactgacaccattcaaaggaaatagccaaatgttatttctttaaataaagagttctatatatcagttaacttttgtgctcttttagaaacacagccaccaccttagatacatgttcctatggcaaaattaattccatgatcaaaacaaaagtttagaaatgagctcacaaaagatgttattgtaagccagagattttgtattgcccttcaaataatacccataaatacaagaaaaaaaatgggagggaataaactgagatttatgagtgggtattttcaggaaggaatgcgattaccagaaaggcagtattttagtatgtattacagaaatctcatcgactctggggctgaagcaaacaagcactgtatgagtttggacatattatttagcctcttgttatttttttctgtaaaatattaattacctcaaataattattacaaaggttaaatatgttaagtgtacataatacagaggaaaagttagatactaattgtattaacattaatattatctgtcaaattataactatgcaagtatttttttcaaagtaaaatttatggactaggtaaaatgactatcatggaaatatttatctagccctgagtatatggcagtaattagtcaaaactatttctaaacattctctcatttactcctcacaatagctctctctctctgagttaaggactattattgttcccattttaggtgaagaaattgaaataaagagcagtacctaagttgttaaaatcctgacttaaaccccaaaagtctgaagataaaatatcttcacctcattactggtaaatgaccaggatacatgtggctaatatgaagtccaagacaaggaacagggagcttgacagaaactgaagttagctgcaaccccagagtgatttcaaatttcccaccaatatttaatctttaagagggtggacataaaatgggagttaaagcgtttgtctctgttgtttcccaaggcaatagcatcacgtacttggataaagtacctgtatttttaccagcagaggagaaataaattaatgatatgaaaagcttgatttccttaaactcctcaaaaaagaagcagatgtatcttacggaaatcaaaattttgaaagcaatgtaaaactcttacggatcttgtcttgggttttgtcatagtggaaactgttcagcagatagtcaaaattcagaaaataattgttttcattaaaaagcattacttgaagggaagttggattctttgtagtaagcactttttgagaaagtgtgaaaaaaaaaaatcacgagtgccacagaagatactaccaggtctcttggcatttttttccactaaaagattaaaaaagatgagcacatttagtaaaatggacaaaaatgacctccaggtggaaataactatattttttcactttcaagtcgaactgtcatttcaaaaatattgctgccacttaaactgaaaagtaaagaattaaaatattcctataaaaacaggtgaaccaggtgcataggaaatatagttggctacaacaaacctccctatcagacagctgtgcaaataaagcattctttctaaatgtcagttcctgtgtaatattttagtttctttcagatgacataatgtatataaaatgacttgggaaaatacaaaggaacatataaatacaacttatcagtgtaattatttggattcagctgatttgctataatataatttaatgaaagtaaaaagaatatgcctagaaatttatatgaaagcttgagtgaccaggaaaagaaatgctcccaaaaggatttaaatatcatagagtgtactaccatgttcattatatctgtttagtattaatgaccgattaacaatgagaaaatgtactaaagcaaaatcccctttaaaataggtaagccctgccaaaagtgtcattgacattgaaaaactcatattgaagtttaacaagatgtgtttactagcattgcaattaaaaaatacagtgagattaataaaccataaacagaactcaacactgaattatagtaatagcacaatatattaaagatacctatgtatatgtgagaatatattctaagtattctacttcccaaccctgttaaaacactacctaatacagacatcaagtttacttctttcccccaattccattatatttctgcatatgacaataccacttatctcaataccaactcaatttccccagaccaacatcaagcttatcctactcctttttcacttttttcccctttactgatgatttgtttttctttgaatttctatttagtcatcccatcctacctataccttctatcttgtactctcatttcctgtcatcagagctggctggagatgaccttcttaagattcttcttcctgatgttgaagttaaagttcttaaatcctacattctaaaacttcatttgcttcctgaaaactctgttgaggatgttttccatttcctcttatcatcttacaccagtctacacactgccctcattccacctacctagtcagtactagtcacccctgtatacaaaaccgcctcttcttctctctagaagccgacattctcactgctcagcagacgacaggagttttcctaagctgaccccttaccccagggccacctttctaaactcagtcctgatgatttctgctttctgtgaagtcattcctggctctttctagcttcagtcatctttgctgctcccaggttttcaaagacatttcccttctcttgcttgctatagtttcacaggaagccctgtagactggctacccagaatggaagcttagtggaagaagacagcataattcctatatcctggaatatatgcattgctcaatcatttgtgttaagtagcaggagagtaggaaataaaaagagataaaagaaaggaagaggccatatacactaccatttttcttactacatatattaatgtagcagtaaagtgaatcctgtaattttaaatcaatatcttactttaaatctaaatagcaaatgccttttgaaaaaaaaaacttctcatcttacagcataatatgtatatacttctaaaaaaattactccttatagtaaacaatctacaagcctctgtccacaattatatttatctggaagaaaaaaataaataaaattttcattaatagttcatatattccaatatattttctaagacatgacatttaaaaagcaaggaaattttctgaatgttttactggtaagaaacttttgaatccattcttgtccaaggtgaaataaaacttttaaaaatttttctttcttaaatcaatcaacacgtcagacagactgtataatttaggcatataattctacttgggacactaaaaagtctccgggaaagggaatttgaagttctcttaatctctatgatttttgatcaaatatacattgccctattcctgggaagaccccttctccagctgaaatcacagcacgatccgtgtgcctgagatttcttgctatctgaggtttcagttgaagtcaaaaggcattaagaatgaaggatttagacagtacgacatttcataatttatggtgcatataaatttacatttaatttttaaggacaccaaaggtagtcctaaaattttacatgtactagagtttgaagtcaatgcaaagatacctataatgcgcatgcaataaaaataaagacaagggtggtatataattttgaaagcataaaaaaatgcaaatgttattaattcaattcccattatggtcactttcataagtccaggtggcattttccaagtgtattaaagtgccaaagtagctccaagttatgaagaatatatatcactgcatatgctgcataacatgaattacatacttgtcagggtatcaactacagccttaatatagtatgtatatcaaatgaatactgaacagagtacaaaagtgctgtctactgagaattttatatatgacttatttaattcattatattctcttaactccattctgattctcctcactatactatgtttatgggtattctttcattgttctttatatgtccttgtaaaaggtatatgatcttaattacatgtattctgattatatataaatggaattatgctatagattgcattctgtttcataccctttttactcaatgctgtgtttttcatacttattcatgatgctacaaatacataaaatctattgattctaaaacagcatagttttctttggaatacatttttcatttctcatctctccattctttcatgagggacttagagtgcttccagcatcttgccatgacagacaatgctccagtgaatattttcatgcatatttttgtagaagacagaattctaagatgaccttccatgccgttgtgtaaatctcttccacttgaatatgggcaaggcttgtgaacatgatgagatttcattcctgtggttagatcacgttaccaggcagaagggaagatattttgcataggtagttcaggtcccaagtaagttcattttgaattactcaaaagggagattattctgggagggccttacttaatagggagaatgccctccaaagaggaacgtggtctttcttgaagaacaattctgctggccttgaaaaacccaagttgccatgagttcggcagctgtgagcaaacaaattctgccaacaacgacataagcttggcaaataaccctgagtctcagataagaccacagccccagacaacatataaattgctgccttgtgagaaactaagaagaggacttaagacaagcacagacttctgacccacacaaactgtgagataataaacctgtgttgtttcaagccatcaaagtaatagtaatttgttccatgacaatagaaaattagaatatcctgttggaaatgtttgagaatctccttaaaatatatatcccaagggacagaattttggggtcattaggtacatgtatacttagttttaccataagggtgtacaattcctagattctaacatcaatgcctacactttaattttttaccagcattaacgtatctcattaatatattgtatttcacttgtgagtttaggcaagtttcatttgcttgttttttgtccttattactttgagtttcttcttctaggggctggctaattgttcatatcctatgccctttaacaaggcttattgactttcattgccgttctgcaggagttttgggggatattctaatcctcattaatcatagacatttcaagtatcttttccctgtcatctacccattaatattttctagttaacttggaggtaaatccttgcttttcatgtcacagaattctttaatatttttcttaaaaagtattattttgagagtggaggttatcatttgagtaaaagtctttgtagatttaataagtctggggtcttatccatctaaaaatcatgtgggggagagagaaaggagacaggagacagattaggaatgacacaggaggaatgcaaagagaaggacagataacgttctgcttctgaccttcagagtaggattttgcatccagacagaaagctttcaagacataacttttgaaagacgatttttttaaaagtatatccttgtggctatcatttaacatataagtggctaatcctgatgacatagactcagaactttccccaagtgtagcaaaaatatttctggacattattcatgaagttggaaggaggcgatgacctagaagaaaatcttacaaccttccaacctgagagatgttggaaaagaaggagagatagagatcaggtaggtcaggcatgtcttcttcacgttttccagttctgagctaactgagataacagtgagggagaggaatttctctggctccatttgcaatttgggatcctgggaccaggctgctttgcatgtacacgcatgccaacctgagttactgctgagacagcaggcacagcttgcatcatctttttacttttccaaagtgccttcggttccttgatgacatcattggaagctacagtagctgaaagccctgattgggaagtcaacagagcctctgtagcacttacacagaggacacagaacacaccaccaggactaaaactagatggaagagagccagaaatgacaacggttggagtcaactgggagtgccaggagcctcaataaagagagaaaaagagaagagtccaagttccaccaaacatttccagatgaaaggacacatgagacactgagggagctacaagttaccacacctaaggatttcagtccttcccctgttacctcaggatccatacattacacacacctccaaccaaataggcaaagcatagagaaagaaacaggcaaagctcacatctggaagactgagtattcctgtccagtcatccagaccaaaagaagtgcagcaccaccaaaccagactgtttcaattaaatgctatctgtccatcccccctcaccctatctccaaaccagatgctgggaattcagaaagacgactacgtagattacacaaaataaagaagctgctcccccaccacaccccacacacctgcatggtggtgtgccttaaacattccaccctgttttatgtaaatgtgaagggactcagagattgtgaccacttagtgttaaaacatttttgtttttacttggttattttaagttagctattcatatcaatgtcttctttcttgaagtcagttaaataatacttgaaacttccagatgtttcaccctatgttgacacgtttacccaattatatgcaaaacatctggctggctggctatatttcgcacttgttcactgtatgtttgatgtgatatagattcagacaaacatttagaaacatcaccatataatccaatgcagctgaagatcattgaatgccaccccggacctcctggacctccatttgtcttgtgacatcctttagtggaacatgagcatacaccataggaaaattgagctcaagtccactatgaggaggatcacagggttctgctggtaccttgagaaagttagcatagtgttccgcctcacattcaaagacgtccactaaaatttcataagcacagcattacatggacagacagagtggcataataaacactggagactccaaaagataggaggttagaagggagttgggggatgaaatactgcctgttggatacaatgcacactattcgggtgatgaatacacgaaaagcttagacttcgccaccacgcaatacatccatgttacatccatgtaacacaattgcacttgtatccctaaatccacaaaaataaaccatttttaaaaatgaaataaaatgcaccctcccgagacgtttactatgcagagccaccttctcatacagcaaagaatctaagttaggaatggaaacagatgtaatgtatgtctacgcaaagcactgcagccatgctctcaagagactaggaatgcccatatgtcaagatctatgttcagaagactcaaagagaattgtcacattgccacaatacattttctgaagcagaaatcattttacttaagatatctgatgtgagagaccaaaggtatttctagaagatgagtttgttcagataaaacaagttactgccataaaggtgacaagtcaaatatcataaagtattatttccaattaagacatgtttaagttttatcagaaggtattcagacagactcactacagaaatcattaaagattcatttactgttttctgaattgctgaatgtagtcatggagttaaatctcaaatttattattatgaaatatttgtttaaccagagtgtggtttctgcagaacaaaatcatatgacagcccccttaggtcttatcttctattagtcaaaacagaatacaattctcagtggagacattttaatcccacagtatttttatccattgctgtctctagaactaaatatctttgagaaattaatgcaaatataaatggcattcaaatgcaaaaaagtgtatataaaatattttagggctttaaattctaaatggataactcacagctgtctatcaatcattagagtcaaatctctattattttccttatttcataccttcatgattcttttaaatacagaaaatattgaggaaaagaaaactgccaaaagtagatagagaaaagattgctaagcagtataaaagtagtggaaaatcttcctgtcaaattaattttcaaaacttttaagttatttttatggcctccctctattgcaagttaccatttttgggtcaatccaaggtataaagaaaacgagtcatgctggtacttggagcattaaggttaatgtcaaaaacaagtcaagaaaattcaaactgagactttcatgacctcataactaccagaggagccactgtttctaactgaatatgcaactgaccctctaaatttgattaatgatgtgtgcttgcataaacgtccctggctatgtcataattcctattttatgtcttaaatctaattaatcattttccacattgttttttttcgtgttttgtgcctaagttaagaatgatctatcatagccaaaaataaattgaaataggatgtgctggaaatatttgatgcatatccttggatcctacaaaattcactttacaatatgcttttacatttccagatttttttcctataggagagttcaggggcttggttcacatgattacccagtcaaaactcatacctcagtcttcattctgaactatcagtggtcctgaagttaaagatgtttctgaatattacctcaaaagagacacaccagaatttttccttgctttcatatgtcttttatttccagaataataatgagaataaaccacattcagaaagccaagtctatatttaaatgttcagaacactgatacttaaagcatgggattttttttaaaaaagctttatattataaaggagttgtatttatggagaattattagaagccactctttcaagatgatttcattttggccacacttggcatcctatgaaatgggaaaaaatttaaataattttttaacttaaaagacgttaggctatgaaataataagaaatttgaattctgcaagtatcaaccgcagataatttttaaaatgtggttaatctgttttagggtaaattggaaaagagttctctcagaaaagcagaacatatttaacttggagaaagaaaaactgcctatttatttttaaataatagttttctgtttcagagcagtggtacttggctgtttcaaagtagatctgtttgattacaaatccaaggaaaatgttctgagaacagtaacttgtttgctctaggtttagagcttgatgtaagccccattcggctggtgaaagcttactttcacaaagattttgtgttagcaaataacactcggaaatgatcccagtgagaaaattatacaaagtcgtattcatggctaggcttggcttgaatcagtaaaatgataaaatcaaattcctgttaccctgtattaggtgtgcagattttaattactccaaattaggagaaattatcattcttgcacttgaagagacctattttaataaaacatgactcttttcatgctaatttaaatttttttatacttgaaccacatgtatcatattgagattatttattccaaaagaaaattatttaaatcatatttcttgttccataatactttattacaacattactcccattttcagattgtaaactccattaactaagaatcctcctcttacacatcttaatatttgaagaagttatcaggattattggacagttttcagtgattattcaattattaagttactctattagcagtctttgtatgaagacatcatagaatcatagagacaaagactttaatagtcttgactctttgagttgcaagaaacaaaaagcattagctcaagcaaataaagaacatattgattccatgtgatagaaaagcccacaaagatgtctgacttcaggtgtgtctggatccaggagctccaataatgttatctgagctctctctgtatttctaagatacgattttctttccctgttgattgccttcccattttcagtggtttcttccatgtggccaagtaaggtggtcataaatagcatcagtaaattacccttacaatttatgtgcacaaagtaatgatgattgtgtttttgagacctgagcagaaaagtactctgattggccttgtttgaaacatgcactcatccctaaatccattaatgtacaggtatatgggcttaccaatcatatatgttctttactaaagcactcctagaatttattcattctatttttttcaatgaaaaaactgaggccaggaaatgaatgacttaaagaatgtcacaaagtaagttagtagcatatttagacaatgctaaaataattttaatgatggtctagataaaaaaatagaatctcaaaaggatataggaggagatcattagtatttaactatattgacatacacgtttaaaacgttaacttacttaaacataaagctcaaagaaactgtgagttttcaaagatcaacatggcatttgtctgcctgaatttcttaaggaattcttcttgagtttggcattaatttgggcatccataaagatggaagaactaaaaactagaacacaaattctacaaactcagtggagtaactttccaaccagatatgtaatggatttcctggagattactgaaataaaaatatttttctttgtatttctaatattttttaaaacttcttactaatctttttaaaatagactactgctattacaaggtttttaagaaaggagttactgtatcttaatgtactcattatcaccttggtgaaaatgctgcttagtgcagttaagaagtctacacattttagaacctgctcattcctcttggtaccccttgactcccttacctcctcatttactccaacccaaatttcccatggcttggaggatgcaaagtggcttccaaaaatacccacaattttggcctggcatggtggctcacacctgtagtccccgcactttgggagaccaaggtgggcagatcacttgaggtcaggagttcgagaccagcctggccaacatggtaaaaccctgtctctaataaaaatacaaaaattagctgggcatggtagcaggtgcctataatcccagctacttggaaggctgaggcagaagaatcacttgaacccaggaggcggaggttgcagtgagccgagactgccaaagcacttcagcctgggtgacagagtgagactgcgtctcaaaacaaacaaaacaaaacaaaaaaatacccacaatttagcacagtgagatacatctaacaatgaagtagagactactggaaattaaaataaaagctgggtttgagttaatatataaaatgtattcctttgaaacctagcatctttgagagaggtcagatagatatttcaatttgagcttttcagaagccaacagaaagagggaggctagattacttacttatatgattcacagcatctatataagtaaaaggaaaccagctgtcccttgtgactaatgtaatagggtgaacacaacctcctaagaagttaaacaatatgcaagatgatagcgtaacacccaagcagatttcagataaacaaattgatatagatagagtcaaagtgttgtcatccaaatacctagttctctgacaatctgtttaactgtggaatagattttagaaaatctgcataaatagataatatatatattcttcactcacttgttcattaatgcattcattctttgaaaaattgatgtttttctttatcctctgcactgtgaaatatggcaataaaaagatacagctgtccttgttctatcttaaactgattgtgtcagagctgatacagatactattcacatttttataatgcaatgttatttgtattttattgtaatacttattatggaaatacatggtattatgggacattattgcagaaaatgctaagctagacaaggagatcacagacagcctcacaggttggcaagggtaaaagatgagagagggaaggtgatgattgttccaagcacagggaatagcatgtgactataaagctttaacataattaaaggaaatttagtatatccgtaagagttaacgttagagagagaggcaggaacaagattatagaaggctttgtaaaacataagaagaagtttggatttcatccaaagataaatagaactcactgaaggatgttaagtagtaggacaatataatctgatttgaatttttgttgccctagctcagaagtcaggaaagcaccaataatggtctggattagggtaatggcagtaggactggacaggtgtggatagattcaagagacagaaaacaaatttagcgagactccgtgattgattggagaggaggaataggaagatttcacttcctggcagctaataaatgaaaaacactttgtctattaacacaatacctaattcatgaaataaagccttgtcatttattcacaagataattatttttattttctctttcaatggtaagaaaaaactttgcatattttactccaacctgttaaaaaatggtaatttataagattttaaaagcggaactgaagtgtaccactgttttatcccaatgggtattgttacacaattcatccaaaaattgcttctactaactctgacttccaaactcatattaaggggaaagttactcacaagcatcagtaacatgtatctagatagaaattataaagttagactataatcaagtactttcccacagagtcaaaggatgagagttcaataaatgcttcaaaaaatcaatacaattcctaatagattgcttcacaggttgacaaagagtgtggcagtgatgaatatgagaatatctcttcctaacgtctaatgtctgttctcccacatgcaatgttggcctgagagaccccaaattacaaactacaaaaaagaaaatgtacatgtattttagagaaaatgtataaagagataattggtatctaatgtgaagctatctctttggaaagtgaagtgactatactgctgatccagccactaagggccatagtgtaaagttggtttaaagggtaaaagttgacaagaatcgaacttaccattcagaacaaaagacagggaatcttccttggcacatcttctattgttagatttttaaatcaactgtatttattagtcatgactaaaagatgagaataagaaaaaatcttgcccctgtcaatttcttctctctcgagcttggtttgtaaagctgagaaaataatcttaatgtcaaccaagagttgagcctccaaatttttactcaccaaatgagtatctcaggtaatccatactacagaatgtttttattttcagatttattaccaaattataccctcccacatgaataattttttcaaagcctaggttcttattttaatattgttttcctaaacacacttgcattaatatgattttatataaattcataaatatgattgtataaagtgtaattattattatattctaattttgctgtttctttctgacttcgataccgcatcttttattttactacttaccttccttcactcaggtaaaattctccaaatttcttctatccttaaataataatacacaagcatcaacagagatcagctttgttttgtaaaaatggaaacatgtttttctgtatcttgattttctcagtcaatagcaacttaaggaaagctctccaaattaacctggttggctcctattcattacttttaatgactgcgtaatatttcatactattattgtatcataatttaagaatttcactactgaaggatatgaactttgtattctgtagtggtttatgttttaatttgttgtcactgtgtaacatattgcaacaaacatgtttgtaaagagatccttatttcatagtacttctatttctatgaaatattttctaactgattcacataacctagttaacatatattttaaaatatatagaatatttagtatcatgagactcttaaagctcaaatgctcaacatcttcaccagaaataagatccatgacacccctcttgcctgtatccccatcagcaatatgtgtatcttgtgtatgttactgtaaatctgattgatatgaaatgctatggtaactaattttcacttccctaaattacagtgagtctgaacatttttgtcatatatagtattctgtgatatctggataggttctcattaatttcctcttcatgtcttgtctccactgtttattgaatcacttgacttttttttgtcaattgcagggatgatttttattttgacatctttcctctgcagtgaaatattttccaaaattacttttgtttatcaactttaagtataatttgccatacaaaagtttttagtgtttgtattttcatatagaatatcttttttatagcttattttttctagttttattcaatattgtcctcttatcactagactctacatgtgttcttcaaaattttcttgcaggatttttattgtttacatttttacataaagttgtattccatctggaatttgtttctaaatattatgcaagattaggatccaaatttattttcttccagatggatagtcaattgttccagaaccagtcatttaaagattcatcttactaacaacaacaaaaaaatcatcttattctcactagcctaaaatagaattttattaagttgtcaaaacacatgggtatttaattctgtaccacttgtctgtttatgacatacaaatttagttatactggttatacagtatgctcagatacccaataaggcacttctctaatctgttttggttttttgtgtgctttctcaactatatttatgcagttatttccctaatgatatttttgcatacaattattaaagagatttaagagtaatgtaaaagactataatttttaatgatatatatgccaacttaatatttatggacattatagaactgatcattgtagagaggcatataagacacctggatgctcaaatgaaagaaataaagtctgtatgagaaaatggaaattataatgaaaactactgttattccaaatctcttttggaaagtaagtccccaacatctagcaagtaaataatggttgtccagaaacagaaaaggccttaaaaggagaagagtaataactaaatataattaaatatagagaaatttttttctaaaaatattaaaaggattcatgaagttctaagaaaactgatggggaaagaaattcatatacctaggcacattatggaagagacctgatatctaaggtaaaaagaaaaccttgcaagcttccagactgaaggatataattacttacagttgtaaaataatcagacagataataacttcctacttgtttcactggaagttagaatacaccagaatagcatctgtagatccgagagaaaggaaatacactccaagatataccaaccaaaattacatatacagaaggattcagaggaagatcctccacttcactgtgggatggagtacagtatgttttccactggaaacatactagaaatcaaattagcaagcaccaatcatctttgagacagtgacaccaatctgatgagacagtaactggagaggcgacaattcagacaggggaaggtcttaaaaagatgagttgatttatatagcagatttaacttgccctttacttgcactagtatttgccagctaggggttcaaacagcagactgagacccaggattgcacccacggagatatgccactgtggggaaagaaaatccagatgtcaaattttctctcgagatatctgttgaattctggggctgtgtaatgtagagtaagggttaaaaatttaagcagaaagcctgcgaaaagcaacacatccctttcagtagtctcaagagacaagtatcagagtataaaactaccggtaggaggaaccctggatggtccgccaaactattaacagaaactctggaaggctggaataaaccagaggtaaagtggaccttaagaaggtcacaatccttaggtcgggcacagtggctcatgcctgtaatcccagcactttgggaggccgaggcgggcggatcacctgaggtcgggagtttgagaccagcctgaccaacatgaagaaaccccgtctctactaaaaatacaaaaaaattagccaggcgtggtggcgcatgcctgtaatcccaactactcaggaggctaaggcaggacaactgctggaacctggaagccaagatcgtgccattgcactccagcctgggcaacaagagcaaaacttcgtctcaaaaaataaaaaaaaaaaaattaaaaagtcacaactctgcttttattcagcctcattcatgcatgattgctttaaggtggttagctaccaccctacttttagcccactgaaagtaaacctactcggccaggcacggtggctcacgcctgtaatctcagcactttgggaggccgcggagggcggatcacgaggtcaggagatcgaaaccatcctggctaacaccgtgaaaccccgtctctactaaaaatacaaaaaattagctgggcgtggtggtgggcacttgtagtcccagctactcaggaggctgaggcaggagaatgacgtgaaccggtagtcggagcgtgcagtgagtcgagatcacgccactgcactccagcctgggctacagagtgagactccgcgccccccccaaaaaaaaaaagaaaaaaaagaaagtaaacctactctatagaaaataatattatatcgtgcctctataattgttatacacaattcaagcaaaacttacgaaatacatgaaaagattggaacagatgaccaaaatccaagatctaaatggacccacagatgatctttacaacaagttgtctgacaaataactttaaaataactatgattaatatgcccaaggacataaagaaccactgtagaaatatataaaaagatagggaatttcacagagaaattgagcctatttttaaaaatgcaaatcatagaactaaaaataaagtatctacaaataagaattcagcgattacattactcataaatttcctatgaaaacaagtcaaaaaataactctacagaatcaagagaccacaagctgccatgaagcttatactttaaactcagcacaatactcatacttggcaattctgtcactatcactttcacaactgctgttagacatgagtcaaaactgttcaccagaacacaaaatatttgcggagtaggagactaataggaacttaaaccacttggcaagtgccattcaaatgagtcaagtatttcaaaaacttcagcacttgttgcctgagcacttacgataatgtctgcattgtgctactaactgaccaattgtaagagaaattaatattacaatgttcaatattttaagtcttatatatgtatttatgtatctgttatatttaaagtgcattcctgaaatcaaaatccttctagtgagtcagaaataagttatccaatgtttgactgtattttctcttgttttaacttttattttcaggagcaaatgtacaggtttgttacataggtaaacttgtgtcatgggggttttgttgtacagattatctcatcacgcaggtattaagcctagtatccattagttatttttcctgatcttctcactccttccaccctccaccctgcaacaggccccaatgtgtgttgttcccctctatgtgttcatgtgttctcatcatttagctcccacttataagtgaaaacatgtggtatttgattttctgttcctgtgttagtttgttaagtatattggcctccagctccatccatgtccctgaaaaggacaggattatgttatttttatggctgcatagtactccatggtgtatatgtaccacatttgaagatcaatgaatccaggggctggttttttggaaaaaaaaataataaaatagactgctagctagactaatgaagaaaagagagactactcaaataaacgcaatcagtaacaagggggatattaccaatgtattcctttttacccataacctaaacccttccacgtatcttatcagtaattttcctctacatatttatttcctcttcacgttcgtgggaactccactcaagttcccttggaataggactctccagactacaaatccctccacaaatttattatgttcttatttacataagaattggttgattgtggtaatattggcatgaagatatagcttttttacttatatatccaagaatggagcttgcttttattcttcatatatacatacatatatatatatatatatatatatatatatatatatatatatatatgagtacacacagtatttgtcttttttgaccgacatatttcacttagcataatgtccccaaggttcatccatgttgtaggaggcgacaggattcccttcctttttaaggttaaataatattccattgtatgtatatgtcacatttgctttgtccactcatttactgatgaaaatatgagttgcttcctctttggctattgtgaatagtgctgctatgaacatggttgtgcaaatatctcaagacccactgtctttccctattgagtgacattagcattccgttgaaaaccatgtacagaaagtttcatttctcgactccctaaatttattcccttgatttgtctatctttataccaggactacactgtttagattactgtaactttgtaatatattttaatatcaagacatgtaagccctttaattgttttcattttcaaaactgttttggctactttggagtccctgaagaatccctatgagttttagaatgaatttttctatttctgtaaaaaaatgccatcaggattttgatagggattgcattaagtttatagattgctttgggtagtatggatattttgacaatattaagtcttctaattcatgaacatgggctacctttccatttatttgtgtcttccttaatttctttcagctacattttgtagttttcagtgtacaagtcttttgccaccttatttaggtttattcctaagtattttattctttttcatggtattataaatgaaattgtttccatcgtttcttttcagattgttcatttttgatgtacagaaacacaactgattttcctaagctgattttgtctgtcctgtcacttactgaattttctcattaggtgcagtgggattttttgtgtggtatctttagggctttctacatataaggtcaagtcatcagtaaacagagctaattttacttctttcttcctttccaattcatatgcccttttactctggcccaattctctgcctcctcaaattgttttcatataatccaggttagtttgatccatttggtttgtgtgcttcacaaattatttggcttttgatatttgcatcatcatttgcgttaacattattaacagtcagtcttattaaacaagaccccagattcataaaacctgtttttgccagtagacctagttttaaattcagcaatttaacgatagaagaaataaagagaatctttttccatgaagcagcagaagtgattttttaaatctttattatggaaatatcaaatatataaaatgtatagtatagtgaatactacttcattagtatatttttaatactaatcagtagttgcaacaatgatcaagttctggcaaatcttatgtctatgcttatcaatttctttccacttccagataattctgactccaagatagcatttcatttcatccgcatatacttttaaatatatcataagaggacattaactacaacaacataattatactaagatattaagtacttcctccttattataaaatacctagtatttgttcaaatttcctgggttgtctcataaaattttaggttagttgttcaaatcaatgtcaataaagtttatatattgcaattagttgtcatatttcttgagttttatataatctgtaagtgcctcctttctctactttttccttatgatttatttgtgtaaaacgttgagtcaattgttccagcagtttctcatagactaggttttactgatttcatcccagtggtattgcttgacatgttcctctctctcttccatctcccttgaattggtagcatgatttagagatttgattaggtatatgttcagggtttttgtttctgataggttattagctttctcaagattacttcacaagtggtcttggtcttccattcaaaagaagtttatgtctgattttctctaggaagtagcttttctctgcctagattattattaatatacatagcattttacaacactgaaattactttcacatacacaaatatatttatccttacaatatccctcaatgtatgtgataggtccagtactggattttgcccaacttacaaactaacaaataagcctgttattactgagggatgttggcagaaaccaagagattcctgggtcagaggccaaggaatgtattactcatggcacaagcagcatgaacatcagcatattcctgttacttgccttctcgaggtcctttgagagtgatgtgaaataatagtccagatgaatgctacatattagttgggtttgtgtcatggctgggtaacccacagcctggggaccaccaagtttacggcaagcagtaagcaagtatgcacttttgctaggagagttgtaactatcttatctctcaggttactaggcatacaaataacatttaaaaatggcccatgaacaactgatcagagccttacagtcatagcacaccccagaaagaaaagtaagattactatagacccaaaaagaaatgtatctcccaacaatgggtaggatacataattgttttttttttttttcatatttccaatgacaagattaaggtttactgtgaattagggtcacacaaaacaagagagccaggactaaaacaattagaaaaacagaaatatattcatcagcaaaaacatctgatgccctgaaattaacggaatattttcaaattgctgagataaaaacaattgtcaaaataaaaatgtttataatacttaacaatcattcaaaactaaggaaaagtatgaatgattttaccatttagatggtcactgaaaacaatgacctggaaggaaaaaaattaaaccaaatgaaacgacatagatccactgatttattaactgcttcaacaagtattttttgagcagtgaccatgtgccagacatttttcctgctttggaattataattgttcaagaagcaataaagactgttaaattattttcaataactgaagcaaaaccaaatcatggagttataaggtggattgtttttcataatattatatacttctatgtcatagttaaaaacacagcctatatattcctcttttcaatctcttaaccaccccaatttgtatcaatcatgaactttacttctgcttaaccagtgtacttccttttattaaacagtaaatgctaaacaatcccttagaaacatagactaaatttttgagtctaattcgctgagcatttagcaaatatttattaaattgaattcaattgattctagttgagttgaattaagttgatccaagtatctctgtgcccaatgccagcaataaggtcagtgagagcaaaagaaacaacaaacacttataaactacatggttgaatttaagactaaagaaaaagatatttccaaaggcatccaccatccctccactcttttggtattcttagagagaatcttagatggatagcacatataaaaatagctcacacctgaagggttagatcacaaagagcaaacaaatcaaaagcaggatgtggctctgcattttataatgtctaaaaagagaaaggtttcgtggttcattaaccatacatgactcattgcttccaaacactatatgtgcatgacattgtctttgtccttgaaaaaacagctgtaatttgactaaatctgtcatcgatgttgctaaataacaagcgagaaaattacacagctgatgtaactgtgtaacttaactctctaaagtaatcatctctacagagtaacagtgcaactgttatatttgtactgaaggcagaatcttaggacagagggacaggacctcatatgtcacgatttacccagccaccctttgcccctggctgttaggcagtaatgtgattcaaataatcatgatctagtgtgctagagctggaagacactttggaggtgtctactccaaccacctcattttatgaattaggaaacagagggtgcccaaggatgatggtggggaaaagaagcagatttgattgattttgtaagtgacagttacttcttgctatcttattgtaaacctgttatttaagaacgttgtttttaacagagactccattttcatactaaatcttagaaaaaaattacagtgtagaaaggtgttgtttagctttcaggtgtaagttttctcagtcatagggaaatgaattcagtgatatttctactgctagaatgctgaccctcatctacaacatgttatttaatgtttgaattaaatttcactcacctcataaaacaagcatgggaataaaccagggtctgcaagtacagaatgtgagagtacttagggagagatagatataaaggaaatctggcagaagacttaaccggagtagaaacttaaaaataaaatagatttccttaatacatctttttgcattttgtggtacttttacaggaaaaatgtgtgtgtgtgtgtgtgtgtatacgtgtgtccctgcttttgtgtatttacacaaatgcttatgttctcttcaccctgtactatgactttggacataggcagttcacatcatgaagtaaaaaactggtcaattatttttgatttcctaaatatattcacttcgtattttggaaatcctgatcagtattatctataaaacatataaataaatggcagttatatatacaaaaaatactgaatatggttcctggaacaatacaggaagccaacaaatgtttactgatttcaaatatttataccagtaaatgtgcaacgtatttccaggagagttgaggaagcttatctctggaactctagagagcaagagtgttcctagaacctttatattctctgtccacactgctcacagatacagttggaaggaaaattattaagtttccatttggctacagctggagacattagtgttccacagggtgccatattttctcctcaacaaattttgaggaaaactgttgaaataatcgttctatgaccagaagagcttctaatgttataactcactcctgatgaagctgaatacattgtgatctataagggaaaaaaaaaagatgctttatatgtgatacatttattctatgtttcagaaaatgcaaaactgaggcacgatccctttgatgagcttgatatttcatatatttaaaagatgataagaaaataacgtccagagaaacgctgacttgacatgcctttgactggaccctaacctccacgttctcagcctcactcatggtcagctgcagacccaggaaggcccatggtgttatctctagcctgaaccaggaggcctgagaactaggagaatctacaatatagttccgattcaaaggctggcaggcttgaaacccaggaaaaaagtgatgtctcagtttgaagacacacagaggtttctctcttgctcaagagtcagcctttttgttctatttaggacattaactgattgattatctgggggcccacctacactagtgagtgcaatctgctttactcagtctacctactaacatgttaatcttattcaaaaatacctacccaaaaacactcagaataatttttgaccaaatatctgggtatcccatggcccagtaaagttgacacatgaaattaaccatcacactatctataccgatttacagtagaggaggatttacagacaggatgacaaaatcatccatcacattaatataatggtaattttaatattaataattttatcattgtttgattttaatttataagtttattgtagcctacatcataaatatacaggtatctagttgtacatttgtacatatttaataacattgtaaccaaaatcagttttctaaactggggatatatatatttaaaagcttttccatttaaaatggctctaagcttcacaaacaatgttgagaaaccatacctatcagtccgttctcacactgctataatgaactgcccgagactgggtaatttacaaaggaaagaaatttaattgacttacagttctgcagggctggtgaggcctcaggaaacttataatcataggagaaggggaagcaaaagcctctttcttcacgtggcaacaggatagagaagtgctgagcgaaggagggaaaagccccttataaaaccatcagctctagtgagaactcactcactatcataatagcctgagggaaatgatctaattacctcccatgaggtccctcccccaacacatgggaaacacaatttggattataatccaagatgagatttgggtggggacacagagccaaactatataatcatattacatagaaagacactgtaccaagataatactttagtaaagtatagattttgtttgggggctaaatttggtattgtggattcatgttgttcttaatttaattgaatccaattgctgtagtgatttttgcaatcctacctggcatccacaatcactgctgtatttatgcactacagaataaattgggaatagaatagcaacatcccagatcttgccagattgtcgcagctttagtattccataaacaagctagtatttgctaatattagtgagagtgaaatgagagagttttatcatgtgcataatgtgttccatctggtggtaagtgacagtcttcagacaataaatttgttttgaccaatatttagataacttctaacagctttacctgcacaaggtgcttgaattttgcttcatgcatccaaggagatttttgaaaaacagaactatgtggatattttgaaaaggtacatacactgtagattattatttagaaataaaaagtatgcccatctcaaagtctttcttttataatgcattttcaccattgttggtgttagaactatacacctcaaagtttgccctctttgcggggatagtgagatattctaagactacatggagatgctcatggataatcatttctctctggtccccatttactcttattccattgtgtagtatcctccaacccctacctacatagccacattctctctggattttatacttagaaatgatttttccccacctaagtctgtgctaaaactggcccttccacagaacaatgtttatcccttagagaatcaatatccttttttacatcataatactcttgaaacaataaacttctgctttgcaaagaggttctatactcttctaaaagttagagtgcagagttctgtgggaaacctgcaggaaaacttagtttacctcaagttccctgggaataggtgagccactgtgatatggtttggatttgtgtcctcgcccaaatctcatgtgaaattgtaatcctcagtattggaggaggggcctgctgagaagtgattacatcatgggggtggatttctcccttgctcttctcttgatagtgagttctcatgagatctggttgtttaaaagtcccccttcactctcttcttccttctccagccatgtacctacttccccttcaccttctgccataattgctagttcctgaggcatccccagcagtgctgtacagcctggggaaccatgagccattaaaccttttttttttttaataaattacccagtctcaggtagttctttatagcaatgtgagaagagactgatacaccctgtctttgttgagtgtgttgtatgaagatttgttttttgtatatagctaacgtttgttgagcctgtgttctataggatttttttattcaacgtgtatcaagtgctaactatataggggctcaccctacacacaaattaaataatcatctttgctgaactttgaaatgtaagcacttataagcaggtgattaactttgtagtaataattatttgataatagagatgattatttctaacttactgagttcctatttactttgcacaatgtctgactagcttttttagtggtgaaggtagtttgggcagtgagtcccgaaggcgactcctgaggacgccctgccgtagaactgagagtcaggaggctggcatgttatttctggctctgtaacctactctccaaatgaactttgcttgtcaactcactttgcctgcagtggcctctaatatgtaaataaaaatcatatttctgtcctgtgtaaaaatattaaaaagtattttttacatttatgattttattgaatttttgtatctatcctgggaaaaggccttattatgatgcagattttacagatgaagaaactgaatctcagtaagaattttctatggtttctagagcttgaccccaggttctttctactacacttcattgtctcctagcatgaattctgtgagtttatgtagctctaatttaataaattaaaaagagtaaagtgttcgtttatatatcaaacttatttttactaagttatatattttaaaaaccacttactaaatgtagggtactatgaagagctacttataagccctaggaatagaaaacaaaaataaacataattgcaactttaaggggcttaaaatcaagtagatgggatcaatatataaactcaaatataagtgacaaaaatatatagacatatagacatatatgactctctgtgtgtgactctgtgtgtgtgtctatatatatcttaagctgggtgatgaaaataagaaggaaacacacacacttgggtaaaacaccacagcatttataattggaaagtgtatgaggacaaggacaaaaagaactgacatgattgttgttagatggatctacaccagaaacaacattaggtggaaaactatgcactgcattatcatatgtcacatgggattagatactgaggaaacaatgaaatatgggtttgagagagaatgagtatgatttttattccaggagatggagtgcaagcatagaaaaatttccatactgggtcaagtcaggtgatcctgtaatattcaaaatccatataattcccctgctttcaatatgagtgttctctcctcacacacgcatctgttattttcataagatcttgttgacccaaggtacagcaaataatatccttaattatgttacatagtcccatctaaatacacacctccagttaagaacaccataggggcaagcaaagaaccatcatcacagcctaaggtcttctcctcatgtgtgtggtgctctatggatatcttcatggataatgttgctcttcttcttagaaatgatagcaatgactgtctctctgtattttgtttagctatcccctgggccaatggaattgcttctttaagaataatgtacacagaatatttagaggttgaagtattaagttaaatatagcaatttataatacacatgatggataggatatacaagccaagataatttatttccatttaataaatgtaataagcatcacaatctctcctgcacaatattcttagatattttgacaatttttaagctctaaggattagctgtttaatattcttcacttactgaagtaaaacagaggcaaattttttcctgaagttaatttttacctttcactgggagaaaagatgcctttcatatgagtgttcacattatacttgctgcagctaatttttaacaaagactagtaagtaaaaatggcatctattcaatcaatgcccaatccagtgctgaatgatatgcatatgggttcaatagaaaagtctaaatgaaagaaaatatttaaagggccaaaaatatttaaagggtaaaaattacagcaattcttaatattccaaccatccccatagctctagtaagtttctcggcaaaatgaaacactgctcagtatttttaatcacaatagtcttcatatcaaggatgatcatcaagaataattagtatctacagcagggatgctgaccaattagaacagacactgacatgaactacaccagtgcaaactgattgccaaccctgccatagacatagccagagagtcatgacaaagattcagtggcaagaccccggaaatgttcagtaagttgacatcaaagtgacagattgatcagacacacctaattgtattccctcctacaatcccactaaaataaatatacaaccttttttttaacaaaaacttaaatttactgagagcagaggaattggaagaagagatagcaataacaacatttgaaagctggagagcagatgatacgtggtgcctaacataggatgcccaagaaagccaactccctcacagcattgaggaaagcagagaaccaactcaatttgctctatagattcctctaaagatagagggataggctgggcacagttattcacacctgtaatccaagcactttgggaagccaaggcaggcgaatgacttgaggtcaggagctcgagaccagcatggccaacatggtgaaacctcatccctactaaaaatacaaaaattagccgagtgtggtggtgggcacctgtagcacagctacttgagaggctgagacaggagaatcgctggaacccaggaggtggaggctgtagtaagccgatgttgtgccactgcactccagcctaggcaacagagcgagactccatctcaagaaagaaaaaaaaaatcatacagggatagatagcatcagttatccttggtagagaggttaaagaagaaaggtctataaagtaaggattagtcaaaagctgtaacgaggagttatcccttcctccactccaaaccaacaggtgtctgtctctcccatacatcagtactatgtaggagatataattttggaaaggacttgagaattctcagtacagttgagggtaaaagtaaaagtattattgtgaaagaaaaagtattaaatctatctacctacttacctactgtattagtccattctcactctgctataaagaaatacctaagactgcataacttataaataaaagagtttaaattggctcatggttctttaggctgtacaggaagcatggaggcatctagccctggggaggcctcaggaaacttacagacacagcagaaggcaaaaaggaagcaggcatgtcttgcatgtcttacatttccagagcagcaagagaaagagaagggggaggtgctacatacttttaaataaccagatataatgagaactcactcagtatcatgacacagtaccaagggggaaatctgcccccatgatccaatcacctcccaccaggccccacctccagcactggggattactatttgacatgagatttggacggggacacagatccaaaccatatcacctacctacctataaaaaatactgacatctacactctggtcccagcctacttctcccatttggctcccagaatttttgcaaccagggagttgctctcaggcaagacgctggaagagtcttctctcagtatctgcctagtttaagaggaaacaaagacaaaagaggcatgagacatggcttttgatctatagtatttctggatctccctttgtgtacatggtagaactacacatttgttgtaatttgtattattatgttttctcttgaatttagtcttaaagtctctcttttgctcaagaatggccataagccggtcgggcacagtggctcgctcctgtaatccgagcactttgggaggccaaggagggcggatcacaagatcaggagattgagaccatcctggctaacacggtgaaactccatctctactaaaaatgaaaaaaaaaaaaaaattagccaggcgtggtggtgggtgcctgtagtcccagctgctcaggaggctgaggcaggagaatggcgtgaaccggaaggcagagcttgcagtgagccaagatggccccagtgcactccagcctgagtgacagagcaagactccgtctcaaaaaaaaaaaaaaaaaaaaagaatagccataagccaagatagccactctgtaagagagccctgaccaggaggaaagttaggctctgagatacaatgaggaggtgaaaccaaaatgcatgaaacagaaaaaaaatttattcctcgctggtcccagagagattcggagtaccaacaggaggacaacaggaagtccagaggcatcagggcactcaacctgtatgcagagtgaaagaaagaggaattcttggattaagtcttttttaagaaccatgagctcttatcacttagacttttccttggtgcttgtggatgggctagtttaaagaaaacactcacaaagaggggaacgtatttacacgactctggtttgaccattacgttgtagcgtgtttagcaactgtggttgtgttggggtttggggtcagtgagatgagggataagcaagctacacagcaaacaaccaaaaggggagaagcggttttaactaggtcaaaggtgatgggatttgggggttcaaatcacttatgtcaagcctaaaacttgataaatgcaacaacaactatattaaacaaatttatgacataattcctgcaccctgagtttcagaaacatcctgcaactcattttgaccaatgacctagtaagcagaagtgacacatgttccttccaggtggaagctttttttattttttattttttagagatgggatctcactctgttgcccaggctggaatgcaatgatgctatcatagttcattgcagcctttagctccaggcctcaagtgatcttcccaccttggcctcccaaagcactgggattacaggcatgagccactgtgcctggtccccagacggaagctcctacttggcagtttgtgtctccacacctgtgtcctactgctctggtgagctttgaagcatatattgatatgaaggtgagataccaagtggtaatatacagagtcacctggactaaaaggggccattgctgccaatattttgggggcaatttgtttttccagcctgacctaccttatcctggctgacaaacataggttccctaacaagcacctaagtcagatcacacttgtctaacaattgctgagctccatttgcacatcagagttagagtttcgaccagcttttcagtccccattcttaaatgttagcatatagccataatcaggggtcaccacttatgttaagtgtataacatgaaaaatggttaaatctacaagcagaaaaaaaatccaactttaaacagagactctactgagagaagaaaacttttcaaaaatgtagtcctccttatctgagattttagtttctgtggtttcatttacctgtgatcaaccccaatctgaagacagataagtacactacaatgaggtattttcagagagagagagtctacattcacatgacacagatggtgataattgttgtagtttatgatgatttattgtggttaatctcttactgtgcctaatttacaaattaaaccatctcataagtatgtatatctaggaagatatataggatatatagggtttgtcactatccaaagtttcaggcatctactaggggtcttggaatatatccccatccgataaggcgagaatactgtactgtcattaccatcttaataggcctgagaagatttaaacaaacaaaaacaataacacaagttccacttggagaaacaaaggctagtaagcttaaaacctatgaaattatcaacaaagtgactgagtaataaagttcaagaaatctcctagaaagtagagtaaaatgaacactagaagaagaaactggagaacatgttcagggtttccattgttcaaataatgagactttcagacacaacagagaaaatgaaataattcaagaacatttccccaaatagatatgcatttctagatgaaaagggcccagcgagatgcccagcacagaatatccaatagtgccgcatcaaaggacatcatgataaaatttcagaacacaatgtaagagacactatatataaacttaagtcttctcatctataaacttgctgcatctctacatttatttagatcttcttttaagaccatagatgatagttgtagggatcatggttctcctttagttttggctttcaattttattgtgttgtcgtcaagggctccatgttctttgtgttaaaaccatttgctaatagttaatatttcctttttgccttaatatatgctctcttttctaaatatcttatgtgagctttaatttatgtgctatatccactagtcattaccccacctgtagtgatggtatagagatatatatattatatatatgttattcaataaatatatattaatatatttaacagtttattgaatatagatatcctatatatatatagaaaaatatatatatttattgaatatatatagattaccccaactgtagtgatgttatctatgaatatatatatattagtcaatagatattaaatatatatttattgatttattacataaagctttaatttcaagccaatgcaataagaaacattcctttaagaagttagaaacaactaaaatacaagtatcagacagataaaaataaaaatatcagcgattttactattaaaacccagactggaaaatgtgattacatatgatatgtaatatttcacctaagaattattatcaagtcagaagcatagctgaaaaaatatcactgacttttctcaaagggaatagagtctgcctcatttactccatgataaagcgcagggaagaatgtaccttcaccgtagcctggcaaatccaaaagaggatgagaaatctaaaagtttagcacattttgttttatgtgtttgttttttgagtcgagttccttataaattcaggaaattattaccctgccaaataaatagtttgcaaatttttttctattctgcaggttttctattcactctattatttgttttgctgtagagaagctttttagtttaaaaatgttacatttgtctatttttatttttgttgcctatgcttctaagatcttaatcatgaattcttcgctgagaccaatgcccaaataagtttccttagattttcttctagtatttttgtggtttcaggtctaacatttaaatctttaaaagaaagcatataaatgcaaatgactaatgggcatattttgcttctattttgtttctaacttcagaagaaaaagaatgtttctaactctactggttccaaacacaactcctatcaaactgtagatatgatcactacagttaatgactagtatatatagcaccaggcttctttgtttgttcatttgtttcttcttgacttctattaaatgtcattaatactcttttcctcagtggattaggaatgtatacatcctatattaattatttaagtggttaactttgaatttttaatattcaataaaatacatatttgtgtgaatataacataaagttaattaagatttcacacttcttcctaatacaaacatgttagaataaacaattatttccaagtgttgtaattacattatgatttgaactccctaatataaccattgctttgctttttcagccaacattaatagacagttacttagatgcttgtcagttaccttgatcactattacaactttcataccactctttcattctgggttgagtttcctgcatttttaattgtggtcttaaataattttttagaattgaaaaaaaaaaagtgaagacccaaacacagtcagaaatgacaaaagtgacattataaatgatcccacagactacaaaagatcctcaaagaccactatgaacatctcagtcccataaactagaaaatcttgagaaaatggataaattcctagaaacacaccacctcccaagattgaatcaggaagaaagtgaaatcctgaacagaccagtaacaagttccaaaattaaatccgtaataaatttttaaaaactctatgaaccaaaaaaagccttgcaccagatggattcacagctgaattctaccagatgtacaaagagaagctggtaccagtccccctgaaactattccaaaaaagtaaggaagaatgactccttcctaactcattctatgaagccaatatcattgtgataccaaaacctggcaaaaacacaataaaataagaaaacagcaggccagtatccctgatgaacatagatgcaaaaatcctcagcaaaatagcaaactggattcagcagcacaaaaaaatttaactcatcataatcatatgggttttattcctgggatgcaaggttgggtcaatatacacaaataaataaatgcgattcaccacataaacagaattctaataaaagcacatagttatctcaatagacacagaaaaggcctttgataaaatccgacatctttcatgataaaaacagagtaagcactgaaggaaaatacctgtaaagaagagccgtctatgacaaacacacaagtaacatcccactgaatgggcaaaagctagaagtgtttcccttaagaagtgaaacaagacaaaacgtctactctctctactcctattcaatgtaatattgaaagtgccacccagaggaaagagaaagaaataaaaggtatccaaataggaaatgaggaagtcaaattatctctctttgctgacaatacaattctatgcctaaaaaattctaaagaatgccaaaagtctcctaaacctgataagcaacttcagtaaagtttcaggatacaaaatcaatgtacaaaaatcaatattattactatatactaataacattcaagctgagagccaaatcaatagcataatcccatttgtaatagccttaaaaaataaaatacctaggaatacatctaaccaagaaggtgaaagatctctacaagaagaactacaaaacacttatgaaagaaattgcagatgacacaaagggggaaacattccacactcatggattagaagaatcaatattgttaaagtggttatactgccaaaagcaatctatagattcaatgctactcctatcaaatgaccaatgtcatttttcacagaattagggaaaaaaaatcaaaatttatatggaacaaaaaaaagcctgaatagccaaagcaatcctaggcaaaaagaacaaagctggaagcatgacattggccagcttcaaagtatacaaggctacagtaacaaaaacagcatggtaccggtacaaaaacacagacgaaatggaacagaatagataatgcagaaatgaagcagcacacatagaaagaactgatctttgacaaagttgacaaacataagcaatggggaacagactccctattcaataaatggtactgggaaaactggctaaccatatacagaagaattaaactggactcctacatgtcaccatatacaaaaattaaccgaaaatggattaaagacctaaatgtaagacctcaaagtataaaaatcccagaagaaaacataggaaatacccttctggacttcatccttggtaaaaaatttatgaccaagtccttaaaagcaattgcagcagaaataaaagttgacaagttggacctaattaaaccaaagagcttctgtacagcaaaagaaactattaacaaagtaaacagacaccttacataatggataaaaatatttacaacctatgcatctgtcaaaggtctactatccagagtctataaggaagttaaacaaatcaaaaagcaaaacacaaataacctcatcaaaaagtgggcaaagtacatgaagagacacttctcaaaagaaaacacagaagcaaccaataaacatatgaaaaaaatgcttaacatcattaatcattccagaaatgcaaatcaaaatcacaatgagatagcatctcacaccagtcagaatggctattattaaaaagtcaaaaaacaacagatgctggcaaggctgggaagaaaagggaatatttatacatttctgacggatatgtaaattagttcacctgtggaaagcagtttggagatttctcaatgaaataaaaacagaactaccattccacccagcaatccgattactggtatatacccaaaggaaaagaaattgttctaccaaaaagtcacacgcactcatatgttcatcacagaactattcacaatagcaaagacctagaaccaacttaggtgcccatcagtggtagactggataaataaaatgtggtatgtagacactgatatggtttggctgtgttcccacccaaatctcatcttgtagttcccataattcccctgtgtcatgggagggacctggttggaggtaattgaatcatggggacaggtctttctgtgctgttctcatgatagtgaataagtctcatgagatctgatggttttataaagggcagttcccctgcacacgctgtcttgcctgccaccatccctttgctcttcctttgtcttccgccatgatggtgaggcctccccagctatgtggaactgtgagttaattaaaactctttccttcataaattacccactctcaggtatgtcttccttagcagcatgagaacaaactaatacagacaccatgcagctataaaaaaatgacatagtgtcctttgcagcaacatggatgcagctggagaccattaccctaggtgaatcaatgcagaaacaggaaatcaaatatcacatgttcttagttaacagtgagagttaaatcttgcctacacacagatatagacgaaaatagacaatggtgactccaaaaagagggagggcaggaggagggcaagggctgaaaaagttcctattgggtacaatgttcactgtctgggtgatgggatcaccagaagtccaagcctcaatatcacataatatacctgtgttacgaacctgcacatgtaccccatgaaactaagataaaaatggaaattaaaaccaaaaaaagaatttgtcagggagtggttagaaatactctttcttgaaagtactcatttcttctacataatttaactctgtatagaattctatatagataattactttctttcatgtttaaaataaattattctgacctggtgtgtggctcacacctataatcccaacattttgggaaaccaaggcaggggtatcacttgaggccagtagttcaagaccagcctggacagcaaagcaaaacccccatctctacaaaaaactttttttaaaaaaaattatcaaggtatggtggcatgtgactgtagccccagcttcttgagaggctgaagcaagaggattgcttgagcccaggagttctagactgcagtgagctatgatggtatcactgcactccagcatgggcaacatagaaagaccctatctctaaaaataataacaaaaataacaatagaacaaattattctacttattttagcctctgttattgtttctttaaaattaatctaatgttttgttctgttaacagccacctttttttctggtcatttgaaaaaatttctctttgtctttggtactgcagactatcactaccatatgtcgagacatagatatgcatttttaaattattttaatttttaatagcactttaagtccatattatcactaacctaaataagatataaaattttctaatttcattaactcatagtatttttcagccttatactttttaaaaataattttctgaatcattagtaataattattccaaattacctgtaaattcttatcactaagaactagtatataactgagtactgtggtatatttaatagatatacttttaatacttagttttaattaccaattatgcaaaaatgaccttttaaattttctatttgtatattcgttctagaagtaatttcacaagaatgataaaaatcataacatcagtattgctataaaatagcttaaaataatatgttctttcaaaatcagatgtgtgttcttttgctaaattcttcaaaaatcaataaagcaaacttaggaaaaagaactgggtgaccattattggatgaaatatagcatcaggaactgtcaaaagatctaaacaatattcccttcatctttaaacttcaatccagaaaaaaaagtctagttattattcattattagagagccactaataatttatctgatacagtgacaatttccttgctattactcagagctataatttcaaaataaattatactattttaccttaatctttggtttacagtcagaatatctcattacttcatttcattcattgtttcacttattaacaatttggataactccattatttttacataatttatcaaaaaaggaaggctactattgctataaaacattaagatcaaaaagagaactatatctcaaaattctgtttcacaaggaatagaaaaggctttcatgaagacagttgcattgcccttcagttacgagtgttgatgaggctatagggctaccgggaaccttgtatctttagccatacagtcactcttctttggttctcgggttatacagaatccctaggttttggaaaacaactcatcattttaaaaagtatatcctcaactcaactgacccaacatactggatgcacccaccaatcatatttactaggagacatgacctgactgaattagctcctcatactttctttaaaaatgggaaatagttatgctaagccatctcagatttgttagaatccttaatgtccagccaaaatacatgtggctaatgttagcataaatgacaagaattagtctagtaactagtgaccaaagttaacagtttaaatttaacataataagattcgtagcaattttattcagaagatatttgtcaagtcagtttcctcataatgaatcttttccatgatatttaccacctgtcttattaaatgtaaaattctaattcacatctaattctaatcctttattttacagtctgagttgctgcaatataatttttgtttttatattaaaagacactaagagaaacatatttgtattatttagtaattttatgccctggattaaattcattcaacttattcattcacctaattattgctaaatgcttgctaggtcaatacagaaattaatgagagagtctctactctcaaggaaacacagcaatagactattagaattaaaagaacattaaagagcatgaaagtatatatatacatgtattttattaaaatttatatacattaagtgctatcaaaatacatttttctgtattaataaatatttactccttaaagagttttaaataaatgaatgcaccttaattttcttaacccaattccctaccaattggcacttaatttgcttaggattttcattaacaatgcacagattaacatttttgaataaatatgtgcacatactcttcattattcacacagaattgctgcataaaagtggaattatttggtctaagcaaatgaacattttaaacacttttaatatattttggcaaattctctaatgaagggctgtacccttgcccaactggttacactctcctctctgtcttgcttttaacacctggacaatagataattgacacttcattgtgtgtatgatagtacttatttgttgtccagtgaagaagactttccctttttcttattattgtaaatatccatttctgttctttcaccatttctctacaggaacatttgtagttttcacatggattgtaacaactatttttacgttcaagacatctttttgctgcaatctataatgcaaaattttctccatttttctgtgtgtatcctcaattttgttgtggtgttttttgttgtaccaaaggttcttttcttgtgtgatatcaaaactattaattttctttttatagattctgacttaaaatatgtaggctttactcaactgtatataaataaaaatatagacctatatattttgtttacttcctcattatttttacttaagttttggtcccacagacatttactttagacaatgctatgggataaaattctagcttattttttcaaatattgatttaataatttagccagaaagatgttttgattaactctcctctcttactgaaaatgctctcatttgaaagttccaagaaatgtgggtcatagctaaagtcaaccagctagactgtggcaaagccagaatttgacctcgagttcaatgctttgaatgtgtagtggcaaacagtatggctctggaatcaatgaggaccacatttgaatggggcacaactggaattctgccacagctatgttaccttgagtaaattacttcttctacacctgttccaaatatttagaataagggaacttaattatatcaaacttcctaatctttagaataaggggaaataattatatcaaccttatcctgttcttgtgtaaatgagtcattattcaatttattcattcaacaatattaattaaaagtgttctttgtaatagatattttttgaggtgtcatgactatagctaccttaaaaatggatattttccagaaataaattattttgacttcattattaacttagtgttgaattcaaataatgatctataggatctggagtcctgctcccagcattccatctgccccgtactctcaccattggaatggtgaaaaagatacctggtggagatatatatatagatagatatatagatatatagatatttgactcgtctaagtgtcaagaaatctggtgtcagatatatctagtggagatagatagacagatagatagatagatagatagatagatagatagatagatagatttgactcgtctaagtgtgaaggaaaaggctgtaagtacacactgtatattcactctccagcacaatacctgacacagagctggcagtgaatagattttataaatgaacgagcaaattaacaatgtatacgttcttgtccatgcaattttattaaaaatagaacaaattgtctctaaacatacttgcctttccttagtgaaactaaaagcatttttaaaatacgtagacagatgaaatagagatagaggaaaatacccacactctcctgcctctgtgtaaatgacaaaaagaaggtgctgtcctctcagattcatcaggccattctgattcgtcatcattaacttgcccacatggattctacctctgaatacttccagttacttgattaataccccaaagtagcacctactcagccattccagatgacaaggaaggagagaaaacactcctaatgcactttgtaggtaacataatttatcttttttgttctcaatttaagtattgacttggtggtgccaagcaatgtgcttggaatcagggaggcaggtgatcagagcacagactgggtctagacttctggatttgatcttggctccactgcttatggtcacttaactttctagtgcctcagtttcctcatctataaaagcaggtaataataacagtgcctattttatgcgactgttgtgaaaattaaatgacttaacatttgtgaagtacttggaactgtacctgacaccacagcaagggctctgtagatattatcaaataaattaatacactttaccacttccttagcagagcactccctgaccaagttacatccctttaccttatttcgagatggagtttcgttcttgctgcccaggctggagtgcaatggcacaatctaggctcaccgcaacctccacctcccgagttcaagtgattctcctgcctcggcttcccaagtagctgggattacaggcacgcaccaccacacctggctaattttgtatttttagtagagacggggtttctccatgttggtcaggctggtcttgtactcccgacctcaggtgatctgcctgcatcagcctcccaaagtgctgagattacaggtgtgagccactgctctcggcctaccatatttcatagcaccaatcaccaggtctgtctctgtgtaataatatttccttcattttttaataacgcaattttctttccccatcagaccataaaccactaagagcaaaactatgaatttattcacacctttgtgtgttgctgttatgcatataagagtattcaaaaattactttgtttttctttaatgtattaatacaataaatctccaaactaattttttcttttataggtctttataagccttggtataatttataagcttggttaattaaatttctttatgaaaataatcattgcatcaaatattcatggagctagaatttttggcatgctaatgtctttttacagatgacaaggttgtgatttgatccataactacggccatgactgccaggctcttgaaaagatcttgaattcttttcacatacttattactcaaaggccatattccttagaactgttacatttatttattagtaacaccttaatgtaagatggtaaaatagcatctgattgaaggcagaaaagctctcctgccattgtctggcttgcaggcataagatttaacatctttctacttacatattttcacccatgatggcatccactaaacctaaatcagtgtctggctcatgaatgaacaaaatataagctcagaatggcataagaaaaccttattcatggatcccatccaaacacaaattcacaatgcttaaaaatgaaaagtaaatcctgtaatgctcaaatttatgtagttatcttagaaaaaaaaaatatttttaattgcctggagtcctcatagcttcttgttaagcttaacaagaggtataaagccatgactaaaatattcacactccactctagtccctatttaaaaaaaataaaaaagggaatcactagtttattcatcttgcctaatgacacagaagggcaaaacaagcacccaaacaatgaataataatgtaagagctcagactgtaaaatcaatatgtcagatcagcagagctttgcttcgttttagtgctctcatgtctgaatgcagcacagcttatcttctgaattatatatatatatattggcctaattacataaatattgacttttccttatatgaagtttattctttcaatctctctgtaattaccatgtcaatatttgtggctgtagtaacaatgaatttaaatctgttaattgtgactgatagtggcatgctatgagataattcagtcacttagtctcagaacactgatggcactagataataagtgatgaatcagtaattccctaggtatatcgtactaaggtaaacatctttaaaaagcaattctttcaacccagttaattaaggggatagttttttcctcaacttgtcaggtttcataacgtacggaagtaataaccagaatgcgactggatcttggtgtatgactttgcccgcttttttttaaatgaaacactttatccctaacttcattctccagtccacccattaacaacttctttgatctgttgatagatatctacacctccatcctcacagctgtatgtgtgtatggaagatataatttaacatttgttgctattattctttgctatttgctatttccataaaggtcctaattcctgatctcacttacatgtggaatctaaaatagctgaagtcataaaaggggaaagtaaaagggtggctgccaggggatggatgtggggaagggaggggagatggtggttggagggtacaaagtttagttagacaggaggaagaaatgttttagaccattgcgcagcatggtaactatcattcataatgtactgtatatttccaaattgccaagaaggtacatttcaaatgttccctccacaagaaaaatgctaaggatgtgaggtgatggatatgctagccagcttgactttatcattcctcctggtatacttgtcaaaatatcacattgtaccccatcaatatctataaaatttgtcaagtaaaaatgaaaataaatttgaaaaagatcttaggcctactttattctaatgtaaaatatgatctgtagaaattctacttttaaaaaatattttattcaattatatcccctcaactggttttattttcatgggaaaagttttcagttactgaaggtgataaatctctgaaacaagaactaatcccatacctaggatatattaattaattaaatgtcttcacttacttaccagtggcagagaaatgttccaaaaattttaaaaagctaaaaatcttttcactttgctcttataatatttgagaattttcacacaagagcttgaactctccaatctaagtaggacagaaatacctgtgtcatattaattatgttagagttaggtgaacatagagaatggtccccaaaaacaatgctgtccacactttgagtttaagagttgttctagacgtattatggtgaagtggtcatgcatcacctgtgctttcttatttgcctctacagggatgccagatgatatgaacttcagtgatgtaaagcaaatccatcaaacagacactggcagtactttagacacaacaggagcaggatgtgcagtggcgactgaatctatgacattcactctgataagtgtggtgatgttacttcccgggatttggtaactgaactcttctgtcctgacataccttactgaagtctcgatttcttctctctctgcatatgcctggaataagagatcctttttcaatgtaacaattatatttatgaaaagatatgttacactaacttctcagaagccaagctgaaatattcataaagtccctaaaactcaacgtttaaatgacacactttaaaaatatgtcttttttcaatctaactgaaaaccttcttaacttctaatatattaaatctgaagatgtgaagggcacagaagtgactttgaataagaagaatttagtgtatctgtaattttattatcaattccaagccccttcctttctaaattaaaaatgttttcatttgaaagtgtatttgccagacaatgaaaacagtatgcagtatttcttaaagtattgaaattagaatatcatgaaataaatcaaaacatacaatggcaagtagtatgcatgcatattcaagagactcttccatttttgcaagctgtagaaggaaatgtctgaatgtctataagttatggggtagattcttgagaagcatttcatataatttcactgaagaaccttgataattttgacccactgtaacttagccactgatgaaccttaaagctgagtattttattaacacctgatttgtattccattatattcaaaatgcatctttggtattgtgcctctgctcccatctctctctttgcctcatagatttagctatgttgggaagcacatgcttgctctaggaatatctccaataaagctgttaactatttggtggaa
